United States Patent 10,597,667 (STRESS TOLERANCE IN PLANTS) - sequence listing, part 2

SEQ ID NO: 4050 - DNA, 2514 bp, Artificial Sequence
  P1086 (35S::G1804)
cggaacacaaagccaccggtttttagacacacagatttcattttcaggttaacacttttcttgttttataatttttcaagatcttggattagaagactgttaaataaatctatctctttatttataagtttaggtcttcgttttctggtccttacttatctgcgtattaccaaatattaaactttgtggtaaagtgatacttagtaatagacggatataatgatgacccaagctaatgattaatttattttactaatcatcaggttaagctctagattatcttttgtttaaaaccgtattaataaatgattaaagaggaaaaaaatcttgtgttgataagttcgctttaagaagaaaacgagtgggttaagatattttcctcttttggtaacgaaaactttattggaagagtaaattattagtttatttattgctaattttagtatcgtttgtcgctgtcacgatgtggaccgttcttctttattttcacgtggaccgacttaattaccttctttcattcttgttatttcaatattttttacgtcatttaaactccactttaccaaaataatttatttcattctttgagagcatcaattatcaaataattcaattgtcttttttcgtgatagttgaataagggacaactattaagtgagtttcgtgaatagctgaacagggacaagtaactgaagtttggtcaaaataatacgatgaatttaatatataagagacaaaattgttattgtcgtttaggtggtatccatatttcaatatagtttgtgtgaatacagatataaaaatggttattgttgtgtatatgatgcagttgttaaatggtaactagagaaacgaagttgacgtcagagcgagaagtagagtcgtccatggcgcaagcgagacataatggaggaggtggtggtgagaatcatccgtttacttctttgggaagacaatcctctatctactcattgacccttgacgagttccaacatgctttatgtgagaacggcaagaactttgggtccatgaacatggacgagtttcttgtctctatttggaacgcagaggagaataataacaatcaacaacaagcagcagcagctgcaggttcacattctgttccggctaatcacaatggtttcaacaacaacaataacaatggaggcgagggtggtgttggtgtctttagtggtggttctagaggcaacgaagatgctaacaataagagagggatagcgaacgagtctagtcttcctcgacaaggctctttgacacttccagctccgctttgtaggaagactgttgatgaggtttggtctgagatacatagaggtggtggtagcggtaatggaggagacagcaatggacgtagtagtagtagtaatggacagaacaatgctcagaacggcggtgagactgcggctagacaaccgacttttggagagatgacacttgaggatttcttggtgaaggctggtgtggttagagaacatcccactaatcctaaacctaatccaaacccgaaccaaaaccaaaacccgtctagtgtaatacccgcagctgcacagcaacagctttatggtgtgtttcaaggaaccggtgatccttcattcccgggtcaagctatgggtgtgggtgacccatcaggttatgctaaaaggacaggaggaggagggtatcagcaggcgccaccagttcaggcaggtgtttgctatggaggtggcgttgggtttggagcgggtggacagcaaatgggaatggttggaccgttaagcccggtgtcttcagatggattaggacatggacaagtggataacataggaggtcagtatggagtagatatgggagggctaaggggaaggaaaagagtagtggatggtccagtggagaaagtagtggagagaagacagaggaggatgatcaagaaccgcgagtctgctgctagatctagagcaagaaaacaagtaaatagagaccttcttcattccttttatgatgtttcttgttgaaaaaaatctaatgtttgttgttgttgttttgggaaggcatatacagtggaattggaagctgaacttaaccagttgaaagaagagaatgcgcagctaaaacatgcattggtatatatttactcatctcgttaaagagtttattctttttgtgaaagtgagtttgtaacaatttagcctttgttatgttttcatcaaggcggagttggagaggaagaggaagcaacaggtaaagacacctattgagtttgcattactaagatggttgcagtattttggtcagaagaaaactacaaaatggaattgttggtttatggttgcagtattttgagagtttgaagtcaagggcacaaccgaaattgccgaaatcgaacgggagattgcggacattgatgaggaacccgagttgtccactctaaacaaacaataggaagatggagaagaagtcggagacagaacgagggaaaaactgatgattttctacgttgttgttttgtctttgagg

SEQ ID NO: 4051 - DNA, 1307 bp, Artificial Sequence; identical to SEQ ID NO: 1337
  P1089 (35S::G2057)

SEQ ID NO: 4052 - DNA, 818 bp, Artificial Sequence; identical to SEQ ID NO: 77
  P1090 (35S::G46)

SEQ ID NO: 4053 - DNA, 678 bp, Artificial Sequence
  P1092 (35S::G1049)
ctaactttcttcccaagtaaacttcaaaatgcagccgcaaacagacgttttcagcctccataactacctaaactcatcgatactgcagtctccgtatccttctaatttcccgatatctacgccatttccaaccaacggtcaaaacccgtacctcctctacggattccaaagccctacaaacaatccacaatccatgagcctaagcagcaacaactcaacatcagatgaagcagaagagcagcagacgaacaacaatataatcaacgagcggaagcagagaaggatgatttcaaaccgagaatccgcaaggagatcgcgtatgaggaagcaaagacaccttgacgagctttggtcacaagtgatgtggttaaggatcgagaatcatcagttgcttgataagcttaacaatctctctgagtctcacgacaaggttcttcaagagaatgctcagcttaaagaagaaacatttgagcttaagcaagtgatcagcgatatgcaaattcaaagccctttctcttgctttagagacgatataatccccattgaataaagcatttttccccgattcatatttatgaaaattttcttcaagagtatgtttctttgtatgtatatgtggagatgtatttcagggttttgataatatgaccctttacgacgacgtttttagattgtagt

SEQ ID NO: 4054 - DNA, 944 bp, Artificial Sequence
  P1093 (35S::G643)
cgacgtgtcgttttccagaagcagtttccggcgatctgtttaagcctttttggatggaggaaggaacttcaggttcacggagaacacggtctcaagttgctccagaatgggcagtcaaagattgtctagtcctcgtgaatgagatcgctgcggttgaagccgattgttcgaatgctttatctagcttccagaaatggacaatgatcacagagaactgcaacgctttggatgttagcagaaatctaaaccaatgcaggaggaaatgggattctttgatgtctgattacaatcagatcaagaagtgggaatctcagtaccgaggcactggtcgttcctattggtccctgagtagtgacaagaggaagttacttaatctcccgggggatatcgatatcgagctttttgaagccatcaatgcggttgtgatgatccaagatgaaaaagctgggactgaatctgatagtgaccctgaagcgcaagacgttgttgatctctctgctgaattagcttttgtaggatcaaaaagatcaagacagcgaacaatggtcatgaaggagacaaagaaagaagagccacggactagccgagttcaagtaaacactcgagagaaacctataactacaaaagcaacccatcagaacaaaaccatgggagagaagaagccggtggaagatatgtccacagatgaagaagaagatgaaacaatgaacatagaagaggatgtagaagtgatggaagcgaagctaagttataaaattgacttgatacatgcgatagtcgggagaaatctagcaaaggataatgaaacaaaggatggtgttagtatggacgacaagttgaagtctgtgagacagcaaggagacgagctcatcggttgtctgagtgaaattgttagtacccttaataggcttcatgaagttccacaagaaatcgagtgatttacg

SEQ ID NO: 4055 - DNA, 505 bp, Artificial Sequence
  P1094 (35S::G3)
gtttgtcttttatcaatggaaagagaacaagaagagtctacgatgagaaagagaaggcagccacctcaagaagaagtgcctaaccacgtggctacaaggaagccgtacagagggatacggaggaggaagtggggcaagtgggtggctgagattcgtgagcctaacaaacgctcacggctttggcttggctcttacacaaccgatatcgccgccgctagagcctacgacgtggccgtcttctacctccgtggcccctccgcacgtctcaacttccctgatcttctcttgcaagaagaggaccatctctcagccgccaccaccgctgacatgcccgcagctcttataagggaaaaagcggcggaggtcggcgccagagtcgacgctcttctagcttctgccgctccttcgatggctcactccactccgccggtaataaaacccgacttgaatcaaatacccgaatccggagatatatagtcaatttatatacatgtagtttgttttg

SEQ ID NO: 4056 - DNA, 1312 bp, Artificial Sequence
  P1096 (35S::G1517)
cgaagcttctcctgcttatttgatacatattctctcttccagttactctacatggaaccattcgttgttaaggagaacatcgtcgcatccgcttcttcgccgatgaagaagcgacggatcgatcacactgagtcagctgatggttctgcgattaacgcttctaactctagtagcatcggtggtaacgatacggtgatgaacatggcggagtttggtaacgacaactccaacaatcaggagtctcaacaagtttgcactttcttcaagaagccaacgaaaagtaaaaacataaggaaaagaaccattgacgctgatgaagaagacggagattcgaaaagcgaaagctctattttacaaaatctaaagaaagttgcaaaacccgatagcaacttgtacttttcttctggaccatctactagaacgagtggagctcctgagagacccgtttttcactacgattcatccaaggaaatccaggttcagaacgacagtggagcaacagcgacccttgaaactgaaaccgacttcaatcaagacgctcgagctatccgtgaaagagttcttaaaaaagcagaccatgcattgaaggggaataagaaaaaggcttcagatgagaagctgtacaaaggaattcatggatatacagatcacaaagctgggtttagaagagaacaaacaatctcgagcgagaaagctggaggctcacacgggcctttaagagcttctgctcacatcagagtatcggctagattcgattaccagccagacatttgcaaggattacaaggaaaccggatactgtggatatggagattcgtgtaagttcttgcatgaccgtggggattacaagccgggatggcagatagagaaagagtgggaagaggcagagaaagttaggaagagaaataaagctatgggagttgaggatgacgatgatgaggctgacaaggatagcgacgaagacgaaaatgcattgccctttgcttgcttcatttgcagggagccttttcttgatccagttgtcaccaaatgcaagcattacttctgtgagcattgtgctttaaagcatcacacgaagaacaagaaatgctttgtgtgtaaccaaccaacaatggggattttcaatgcagcacatgagatcaagaagagaatggctgaagaacggagtaaagctgaacaaggattgtgaagtccttctttcacaggacaaaaaggcaaaaactatacatttgattatttgcttgaggaaagctttttgttttgttgtactcactggcctatatactgtatattcggatgacgatggttgtttc

SEQ ID NO: 4057 - DNA, 1028 bp, Artificial Sequence
  P1099 (35S::G1488)
acaactctttagttttaatcaacgaaacttatggaagatgaagcacatgaattcttccacacatctgattttgccgttgatgaccttttagttgatttctctaacgatgatgacgaagaaaacgatgttgttgctgattccaccactaccaccaccataaccgacagctctaacttctccgctgctgatcttcccagtttccacggtgatgttcaagacggcactagcttctccggtgacctttgtataccttctgatgatttggctgatgagttagagtggctttcgaacattgtggatgaatcattgtcgcctgaagatgtacacaagctcgagctaatatccggttttaagagtcgaccggacccgaaatccgataccggaagcccggaaaacccgaatagcagcagtccgatttttactaccgacgtttctgtaccggccaaagctagaagcaaacgctcacgcgccgctgcgtgtaattgggcctcacgtgggcttctcaaggaaacgttttacgacagtcctttcaccggagaaaccattctctctagccaacaacacttgtctccgccaacctcgccgcctttgttgatggctccgctagggaaaaagcaagccgttgatggaggacaccgacggaagaaggatgtttcttcaccggagtctggtggcgcagaggagagacggtgtctccactgcgccacggataagactccgcaatggcggacaggcccaatgggcccgaagacgttgtgcaacgcttgcggtgttaggtacaaatcgggacgtttagtgccggagtatcggcccgcggcgagtccgacgtttgtgctggcgaaacactcaaattctcatcggaaagttatggagctccggcgacagaaggagatgagtagggcccatcatgagttcatacatcaccatcacggtacggacactgccatgattttcgacgtttcatcggacggtgatgattacttgatccaccacaacgttggcccagatttcagacagcttatttgatt

SEQ ID NO: 4058 - DNA, 1116 bp, Artificial Sequence; identical to SEQ ID NO: 801
  P1178 (35S::G1069)

SEQ ID NO: 4059 - DNA, 738 bp, Artificial Sequence; identical to SEQ ID NO: 879
  P1184 (35S::G1249)

SEQ ID NO: 4060 - DNA, 3518 bp, Artificial Sequence
  P1187 (35S::G1382)
ctctcatttcgccatagctgagagcttcttctactttcccttagcttcttttttccttcatttttgttctacccttgcgaatctctgaaatgaaccctcaagctaatgaccggaaggagtttcagggagattgttcggcgacgggagatctcacggcaaagcacgattcagctggaggaaacggaggtggaggtgctaggtataagctgatgtcaccggccaagcttccgatctcgaggtcgactgatatcacgattcctcctgggttgagtccgacttcgtttttggaatctcctgttttcatctccaacatcaaggtttaagcagctactttactatctctttcttcttcttcttcttcgattttggtaaatgcaatcacagtttcacctcatttttgttgtcgatttgagaaattaggttttctgatttcatatttttaagacctaaaggatttttcatgaaattggattgtgccattttgaaactgagtttggaattggaattgattcataacattgacattttgtcccacttgttcggtttctcgttgcttcaatttcgatttggatcactgttcatgttagtggggaatttctggtaatttggtggagatgctctctgcttgctcactaggaaaaacattggacttgggtttccatttttgtttcttagtccattacaagtgattaaaaaactatgatttgtttgcttacgttagggactttggccaagattctgattctttgtgctactatactctgcattggtttgcatttgtgtccgttcagattgttctttcgaataaaccttttttttttatcatgttctattggtgctggatactttatttatatcctcttgctctttgtcgtttcttcttcatactgtctagtgtctatcttccatgtgtttggtgcttctcttttctttttccattctttgtacatttaggtttcggttagctgcgtctgtgtggggattccttttacttatatgagctattgaatgattctgttggtgagaaaatgtactttactcgcatgttcaccatttagatctatagagtattcgttttgttcaattaagttatgaataataggttatatgctatgtgctcaattttattttgcatctcttagttatatcttcttatcccttgattgaacaagatattgtttttgtttttagaagactgttttttttaaaacatcatgtttattgatagatcaggttcatgttttacaaaatctgatatgtattgttttattcatgccattaataatatgccactttctttaactttcagccagaaccttcccctactactggttctttgttcaagcctcgaccagtgcacatttctgctagctcaagttcttatacaggcagggggttccatcagaacacctttactgagcagaagtccagtgaatttgagttcagacctcctgcatcaaatatggtattgtccaaaacaatgctgtttgttatgctttgcatgtaatgtactgttcagatagtcgacgacatatgaaccccgaacagtggctgacctaatttttctgcacgaagtctatttattcagcgcttggattgcttgtaaatctcaaaatctttcgcctttgcatacatataataccatgccagccttaaattgtttcataaggagccttgtatccaaaagctcacagtttataagttacttgtatattgttgggggatgactttgtctaaacatctttattgatttcaaggtatatgcagagcttggcaagattagaagtgagccaccagtacattttcaaggccagggccatggatcctcacactcaccttcttcgatcagtgatgctgcaggttcctcaagtgagctaagccggccaactcctccttgtcagatgacaccaacgagctcagatattccggctggatctgatcaagaggaatcaatccagacttcccaaaatgactccagaggaagcactccatccatcttggctgatgatggttataactggagaaaatatggtcaaaagcatgtcaaagggagtgaatttccccggagctattataaatgtacacatcctaattgtgaagtgaaaaagttatttgaaagatctcatgatgggcagatcaccgatattatatacaagggtacacatgaccatcctaaacctcaacctggtcgccgaaactctggtggtatggctgcacaagaagaaaggctagacaagtatccttcttcaactggccgagatggtaatcataactaaaacttgagacaaatatgcacttactcccttggcaatatctataactttttccttctactcttatgtctgcatacagagaagggatctggcgtctacaacttgtctaaccccaatgaacaaactggtaaccctgaagtacctcctatctcagcatctgacgatggtggagaagcggcagcgtcaaataggaataaagatgagccggacgatgatgatccattctcaaaacggaggtattagagtttaacaaaggattcaggtgcttgatttgaatctgtgatttgacatgattaaaactttattttaactttatgtaggaggatggagggtgcgatggaaataactccactagtgaaacccatccgggagcctcgggttgttgttcaaactctgagtgaggttgacattctggatgatggttatagatggcgcaaatatgggcagaaagtcgtaagggggaacccaaatcccaggtttgtacagcattaaagcttttaacaccccaaaaaattccttgcttttttctcgaatgaacatacataaacataacttgcgagttcaaaatggtagctagaacagtttagtccttgtcttcaggacctagttatttgacatgtgcataaagtgttgcttcttttaggaatttggtttggaatatggaagatagtgatcttaacagactcaacatgtgcgcaatggagatattatgtttcatgatgttcctcggccttttgtaggagctactacaaatgcacagctcatggatgcccagtgagaaaacacgtggagagagcatcacatgatccaaaagctgtaataacaacatacgaaggcaaacacgatcatgatgttcccacttcaaagtctagcagcaatcacgaaatccagcctcggttcagaccagatgaaacagacaccatcagcctcaatcttggtgttggaatctcatctgatggacctaaccacgcttccaacgaacatcagcaccagaatcaacaacttgtcaaccaaactcacccaaatggagtcaatttcaggtttgttcatgctagtcccatgtcatcctactatgctagcttaaatagcggtatgaatcagtacggccagagagaaacaaagaacgagactcaaaatggtgacatctcgtccttgaacaattcatcttacccatatccgcccaacatggggagagtacaatcgggtccgtaaaacaaaaagtaagcaacattatgtacgggatct

SEQ ID NO: 4061 - DNA, 766 bp, Artificial Sequence; identical to SEQ ID NO: 595
  P1192 (35S::G779)

SEQ ID NO: 4062 - DNA, 1196 bp, Artificial Sequence; identical to SEQ ID NO: 867
  P1195 (35S::G1228)

SEQ ID NO: 4063 - DNA, 4471 bp, Artificial Sequence
  P1196 (35S::G447)
gaactctgtttcttccctgcaccaaaccaattttttcgttctttctataaaccatgaaagctccatcaaatggatttcttccaagttccaacgaaggtacacaagctttatatttatcttcttcttttccagattttatactattcaatttcttcatcaaggagtttctgcatttcatgtttgtgattttctcattgaaaaaatgaattttgttattcaatttcaactttggagtcagcacaaagtcacaaatcgagttcttctatcactttatttaataaagtggttgaaacataaatgccgctcataaaatttccagactttaaatgaaactatgcaaaaattctatcacttttaacagatttgaatatgtgtgtgatgatgatgaacaggagagaagaagccaatcaattctcaactatggcacgcttgtgcagggcctttagtttcattacctcctgtgggaagtcttgtggtttacttccctcaaggacacagcgagcaagtaagttcattgcgtttcaaactattttgaaacctttggtagcaatctaagtaatatgttcaatgaaaccttttttcaggttgcagcatcgatgcagaagcaaacagattttataccaaattacccaaatcttccttctaagctgatttgcttgcttcacagtgttacattacatgtaagtctcttctgactccaacttgtgaatcaacaagaagatgaactaatcaggacttttgtgaaattctgaatcaggctgataccgaaacagatgaagtctatgcacaaatgactcttcaacctgtgaataaggtctgaattatatcattcttcttgtgctatcttggtttaaagttgaggactttaatgctgatctttgctcaaaatgtgtgacagtatgatagagaagcattgctagcttctgatatgggcttgaagctaaacagacaacctactgagtttttttgcaagactcttactgcaagtgacacaagcactcatggtggattctctgtaccgcgtcgtgcagctgagaaaatattccctcctcttgtatgtctctctgatcaaagctactctcagtttcttttgcttcaaacttttgaatctgttttgctaaaagttctaagggtgcttaaaataggatttctcgatgcaaccgcctgcgcaagagattgtagctaaagatttacatgatactacatggactttcagacatatctatcgaggtttgaatcatctaaagtttgttttattagtctaaaagattgaaaacttcaacctgatttgttttctttgatgtaatctgatctcaggccaaccaaaaagacacttgcttaccacaggttggagcgtttttgttagcacaaagagactatttgcgggtgattcagttttgtttgtaaggtatgagtcatactttgatcaaaacattaagcagaattggactttcatcttctcataagggtacttgggtttgcagagatgagaaatcacagctgatgttgggtataagacgtgcaaatagacaaactccgactctttcctcatcggtcatatccagcgacagtatgcacattgggatacttgcagctgcagctcatgctaatgccaatagtagcccttttaccatcttcttcaatccaagggcaagtccttcagagtttgtagttcctttagccaaatacaacaaagccttatacgctcaagtatctctaggaatgagattccggatgatgtttgagactgaggattgtggggttcgtagatatatgggtacagtcacaggtattagtgatcttgaccctgtaagatggaaaggctcacaatggcgtaatcttcaggtaatgacatatccgagttatgctaaactgtttatgatggtcatttcttctgaatcttttgttcatggtttaaacaggtaggatgggatgaatcaacagctggagataggccaagccgagtatccatatgggaaatcgaacccgtcataactcctttttacatatgtcctcctccatttttcagacctaagtacccgaggcaacccgggatgccaggtgagtttactgctttcgttcatttttttcccatagatctttgactgagtttccggatactaaccttggtggtttgttgcagatgatgagttagacatggaaaatgctttcaaaagagcaatgccttggatgggagaagactttgggatgaaggacgcacagagttcgatgttccctggtttaagtctagttcaatggatgagtatgcagcaaaacaatccattgtcaggttctgctactcctcagctcccgtccgcgctctcatcttttaacctaccaaacaattttgcttccaacgacccttccaagctgttgaacttccaatccccaaacctctcttccgcaaattcccaattcaacaaaccgaacacggttaaccatatcagccaacagatgcaagcacaaccagccatggtgaaatctcaacaacaacaacaacaacaacaacaacaacaccaacaccaacaacaacaactgcaacaacaacaacaactacagatgtcacagcaacaggtgcagcaacaagggatttataacaatggtacgattgctgttgctaaccaagtctcttgtcaaagtccaaaccaacctactggattctctcagtctcagcttcagcagcagtcaatgctccctactggtgctaaaatgacacaccagaacataaattctatggggaataaaggcttgtctcaaatgacatcgtttgcgcaagaaatgcagtttcagcagcaactggaaatgcataacagtagccagttattaagaaaccagcaagaacagtcctctctccattcattacaacaaaatctgtcccaaaatcctcagcaactccaaatgcaacaacaatcatcaaaaccaagtccttcacaacagcttcagttgcagctactgcagaagctacagcagcagcaacagcagcagtcgattcctccagtaagctcatccttacagccacaattatcagcgttgcagcagacacaaagccatcaattgcaacaacttctgtcgtctcaaaatcaacagcccttggcacatggtaataacagcttcccagcttcaactttcatgcagcctccacagattcaggtgagtcctcagcagcaaggacagatgagtaacaaaaatcttgtagccgctggaagatcacattctggccacacagatggagaagctccttcttgttcaacctcaccttccgccaataacacgggacatgataatgtttcaccgacaaatttcctgagcagaaatcaacagcaaggacaagctgcatctgtatctgcatctgattcagtctttgagcgcgcaagcaatccggtccaagagctttatacaaaaactgagagccggatcagtcaaggcatgatgaatatgaagagtgctggtgaacatttcagatttaaaagcgcggtaacagatcaaatcgatgtatccacagcgggaacgacgtactgtcctgatgttgttggccctgtacagcagcaacaaactttcccactaccatcatttggttttgatggagactgccaatctcatcatccaagaaacaacttagctttccctggtaatctcgaagccgtaacttctgatccactctattctcaaaaggactttcaaaacttggttcccaactatggcaacacaccaagagacattgagacggagctgtccagtgctgcaatcagttctcagtcatttggtattcccagcattccctttaagcccggatgttcaaatgaggttggcggcatcaatgattcaggaatcatgaatggtggaggactgtggcccaatcagactcaacgaatgcgaacatatacaaaggttagagatctttctctccctttccatagctctaatcttttgcttcttaattttcgaatgctaaatgccgaaagttgttaaatcattgaaggttcaaaaacgagggtcagtaggtagatcaatagatgttacccgttatagcggctatgatgaacttaggcatgacttagcgagaatgtttggcatcgaaggacagctcgaagatccgctaacctctgattggaaactcgtctacaccgatcacgaaaacgatattttactagttggtgatgatccttgggagtacgttccagacctgaaaaatctatctgtaacagtcaagattgaacaattctgataattcttgtctgtttgttttttccacagagagtttgtgaactgcgtgcagaacataaagatactatcatcagtagaagttcagcaaatgagcttagacggagatcttgcagctatcccaaccacaaaccaagcctgcagcgaaacagacagcggaaatgcttggaaagtacactatgaagacacttctgctgcagcttctttcaacagatagaaataaaaagatgcaaatataccaagtcaactt

SEQ ID NO: 4064 - DNA, 1953 bp, Artificial Sequence
  P1209 (35S::G1242)
ggatcttgaagtggttaatggtggtggagaacgcaaacgtctgttgaacatagcaatgcaattgcggaaatgctgcaatcacccttatctcttccagggtgcggagcctggtcccccatatactacaggagatcaccttgtaacaaacgcaggtaagatggttctcttagataaattgctacctaagttgaaggatcgagattcaagggttctgatattttctcagatgacaaggcttttggatattctcgaggattacctaatgtatcgtggttaccagtactgccgtattgatggaaatactggtggtgacgaacgagatgcttccatagaagcctataacaagccaggaagtgagaaattcgttttcttgttatccactagagctggaggacttggtatcaatcttgctactgcagatgttgtgatcctctatgatagtgactggaaccctcaagttgacttgcaagctcaggatcgtgcacataggattggtcaaaaaaaagaagttcaagtgttccggttctgcaccgagaatgctattgaggctaaagtcattgagagagcttacaagaagttggcacttgatgctctggttattcagcaagggagattggcagaacagaaaactgttaataaggatgagttgcttcaaatggtgagatatggtgctgaaatggtgtttagttctaaagatagcacaattacggatgaggatattgacagaatcattgccaaaggagaagaggcaacggctgaacttgatgccaagatgaagaaatttactgaagatgcaatacagtttaaaatggatgacagtgctgacttttatgattttgacgatgacaacaaggatgagagcaaggtggattttaaaaagattgtgagtgaaaattggaatgatccaccaaaaagagagagaaagcgcaactactctgaagttgaatacttcaagcaaacgttgcgacaaggtgctccagctaaacctaaagagcctagaattccacgcatgccccaattgcatgattttcagttctttaacattcagaggctgactgagctgtatgaaaaagaagtgcgataccttatgcaagcacatcagaaaactcaaatgaaagacacaattgaggttgatgaacctgaagaagttggagatcccttaactgctgaagaagtggaagaaaaggagctattgctggaagagggtttctcaacatggagcagaagagacttcaatgccttcattagggcttgtgagaagtatggccggaacgacataaagagtattgcctctgagatggaagggaaaactgaggaagaggttgaacgatatgctcaagttttccaagtgcgatataaagagctgaatgattacgacagaatcatcaagaatattgagagaggggaagcaagaatctctaggaaagatgaaatcatgaaagctattgggaagaaactggatcgctacagaaacccgtggctggaactgaagattcaatatggtcagaacaaagggaagctgtacaatgaagagtgcgaccgtttcatgatatgcatggtccataaacttgggtatggaaactgggatgagctaaaggcagcgtttcggacatcccccttgtttaggtttgactggtttgtaaaatcccgcacaactcaggaacttgcaaggagatgtgacacactaatcaggttgattgagaaagagaatcaagaatttgatgagagagagaggcaagcccgaaaagagaagaagctttcaaagagtgcaacgccatcaaaacgaccttcgggtaggcaagcaaatgagagcccttcatctcttctgaagaaacgaaagcagctgtcaatggatgattatggaaagcgtaggaaataagaaggcttgtgttgaatccatcactaagtaatcagaaagatttatgatcacttctaggtttgattccgaatcgg

SEQ ID NO: 4065 - DNA, 1306 bp, Artificial Sequence; identical to SEQ ID NO: 973
  P1211 (35S::G1420)

SEQ ID NO: 4066 - DNA, 3083 bp, Artificial Sequence
  P1214 (35S::G600)
ccaaggtatttcatactctcattcgcagtcttttatatttgtgtgtaccatcattggtaaactaatgagtattaaatctagatatggagtctgtacggtgtccacctcccaaggctctatctcctactacatctgctgcatctggaggcgaaaagaaaccagctcctagtaacaacaatgagacttcaactctaaagccgtcaatagaaatagcagagatcacaagtgcttgggcgtctgcagaaatagttaaagtggaaaagccagttgatgcatctgcaaacattcaaggatcctcaaatggcaaggaagcagcagtttcacaactgaatacgcagccccccaaggaagaaatgccgcagcaggttgcttctggggagcaaggtaatcactggctattgtcccattagcacgagaaacttatgcatttaaagaagagaaagcatcaccttttacacattatataatatacattgatgtttggcgattagtatcatcagtaaagtaataatgcatacttttgctcttcagcaggaaaaaggaagaagaagaaacctcggatgagtggaaccggtaggtttttcttattttgatgtggactacccatgctctttcttcccagactatgttaactgtatagagaggcttaacagattgtttgtcttccttttcctttgccagatctagcaggccctgactatatgatgcccatgggcccaggtcccggtaatcagtacttcaatggtttccaacccggcttcaacggcgttcaacatgggttcaatggcgttcaacctgggttcaatggctttcatcatggtttcaatgggtttccaggcccttttcctggtgcgatgcctccttttgttggctatggatttggcggtgtgatccatccagatcctttcgctgcacagggctttgggttccctaatataccaccaccttataggtactgagaagctgagacttgctctctcagttcatagatagtttgtgattttgtatcttcattatagctattagtaaccaggacatgtgacttgagcagggaccttgcggagatggggaatcgtatgaatctccagcatcctataatggggagagaagaatttgaagctaagaaaactgagatgaaaagaaagcgtgaaaacgagattcgacgatcggaagggtaaagcactgtctgtgcattcactagtttcaggcttatgtatgtatactgcagcatgttgactagttgtttgtttttgtgtggtacagagggaatgtcgtcagggacagtgaaaagagcagaataatgaacaactcggcagtcacttcctcacccgtgaagccaaaatctgtatgtatcattttgttgtctcagttctctctcgctctctctctctctctctcggccaattggtttggtttgcaagagatgacgttttctcagcaccctctttctctctttttatttctatatttttcgctctctgcatatccttttacgttaaaaagaaaggggttgattccacaattgctaaataggcgtctgctttatagttgatttggtttaggggtaaaactcaaaggagagacatttaagattagaatgaggtagatgtagaaattgaattgacaccataaaatgtattgacttgcgatagaatatatgcataaatgaaatgaattgaaagttatttccacatagtcttctcgttggcagtttggtcacaagtaatgctcgactgatcccataatttttggcctcttcaagacagaaaaatttgtagggaacaaaagactaaagtagaaagtcgtaggaaatgtttttaatttcagggtagtatatcttatcgtacgggttaatatggccctatagacttacatgaagcgtggtcccaaacagaccagttggctttatattgccgaccttataaaatattatttttctaacattatattttacctaaatagttttttttttttttttttttttgacgaaatttttttttacaatattaaatttttgttatctattaaaatgtagatatttgatctactttatttttaaagtaaacgttaaatactgatatcaaaatcatattaaatcaggactatattaaatacgtctttttatattttgaaaccaaaacacgtttgtaatccacgtgtaaggatagtagtggtcactctttatcctccaaaattaagattttactgggaagctataaagtataaacctttgtttgctttctcttttctttgtttcttcgttaaataagctatttagagtaaagtaaaagataaatgggttgggcccaatatatctcttattgggctcaagatttaaatttcttttctgttattttaccaataatggccttgttcttgaataaacagagacaaggacctccgccgccgatttcgtctgattacgaccgtcgcaggcgatcggatagatcgtcaccggagcgtcagtcatctcgaaggttcacctctcctcctcgatcatccagcaggaaatctgagcgtgatcgtcaccatgacctcgattccgaacacgaccgccgccgtgaccgtcccagagagacagatcgcaagcaccgtaagagatccgaaaagtcatcatcggatccaactgtagagatagacgataacaataagtctaacgtgttcactcggataagctttccagaggaatcttctggcaaacaacgaaagacatcaaagtcttctccagcgcctccagagagctcagtcgccccagtttcatcgggtcgtcgtcatcacagtcgaagagaaagagagatggtggaatacgattcaagtgatgatgaagacagacatttcaagaggaagccatcaaggtacaagcgatctccttcggttgcaccttctgacgccggtgatgagcatttccgtcattctaagcgatctaaaggagaaagagcgcgagcttgattcgaagaatgaagaagattcaaatgtgtgcgtaaatgactaaaacgcccttcattatcttcacggagacgaacccatggcctggtactatgacgagaatgccctatgactcagagatggaagatgactagatg

SEQ ID NO: 4067 - DNA, 702 bp, Artificial Sequence
  P1216 (35S::G12)
cgccgtcaatatcacatctttcttcttctttatctttaaaatctctttagatcgattcttttgtggattcttgaaatctccggagaaaaccactatggagacggcgactgaagtggccacggtggtgtcaactccggcggttacggttgcggcggtggcgacgaggaagagagataagccgtataaagggataaggatgaggaagtgggggaagtgggtggcggagataagagagcctaataaaaggtcaaggatctggcttggctcttactctactcctgaagcggcggcgcgtgcttacgacacggcggtgttttatctccgaggtccttctgctcggcttaacttcccggagcttttagccggagtgacggtgacgggaggaggcggaggaggagtgaacggtggtggagatatgtcggcggcgtatataaggagaaaagcggcggaggttggagcacaagtggatgcgttagaagcggcgggggcgggagggaatcgtcatcatcatcatcatcaacatcaacgtggtaatcatgattacgtagataatcatagtgattatcgtattaatgatgatcttatggagtgtagtagtaaagaagggtttaagaggtgtaatggatcgttggaacgggttgatttaaacaaattacccgatccggaaacttcagatgacgattaggaaagcaaaaaatagaa

SEQ ID NO: 4068 - DNA, 1460 bp, Artificial Sequence
  P1218 (35S::G8)
taatcgttgttgctgtagaagacgatctctaacaactgattccttcatcatcaccttcgctagatttgtaattttcagagcttgagatgttggatcttaacctcaacgctgattctcccgagtcgactcagtacggtggtgactcatacttagatcggcagacatcagacaactccgccgggaatcgagtggaagagtccggtacatcgacgtcgtcagttatcaatgccgatggagacgaagactcttgctctactcgagctttcactctcagtttcgatattttaaaagtcggaagtagtagcggcggagacgaaagccccgccgcttcagcttccgttactaaagagttttttccggtgagtggagactgtggacatctacgagatgttgaaggatcatcaagctctagaaactggatagatctttcttttgaccgtattggtgacggagaaacgaaattggtaactccggttccgactccggctccggttccggctcaggttaaaaagagtcggagaggaccaaggtctagaagttcacagtatagaggagttactttttatagaagaactggtcgatgggagtcacatatttgggattgtgggaaacaagtttatttaggtggtttcgacactgctcatgctgcagctagagcttatgatcgagctgctattaaatttagaggtgttgatgctgatatcaactttactcttggtgattatgaggaagatatgaaacaggtacaaaacttgagtaaggaagagtttgtgcatatactgcgtagacagagcacggggttttcgcgggggagttcgaagtatcgaggggttacgttacacaaatgtggtagatgggaagctaggatggggcagtttcttggtaaaaaggcttatgacaaggctgcaatcaacactaatggtagagaagcagtcacgaacttcgagatgagttcataccaaaatgagattaactctgagagcaataactctgagattgacctcaacttgggaatctctttatcgaccggtaatgcgccaaagcaaaatgggaggctctttcacttcccttctaatacttatgaaactcagcgtggagttagcttgaggatagataacgaatacatgggaaagccggtgaatacacctcttccttatggatcctcggatcatcgcctttactggaacggagcatgcccgagttataataatcccgccgagggaagagcaacagaaaagagaagtgaagctgaagggatgatgagtaactggggatggcagagaccggggcaaacaagcgccgtgagaccgcagccaccgggaccacaaccaccaccattgttctcagttgcagcagcatcatcaggattctcacatttccggccacaacctcccaatgacaatgcaacacgtggttacttttatccacacccttaacttgtaaggggacatatgagagtt

SEQ ID NO: 4069 - DNA, 971 bp, Artificial Sequence
  P1219 (35S::G161)
tcctatattttagcttctcaaatatcactaaaaatggtgaaaaaaagcaaaggtcgtcaaaaaatagagatggtcaaaatgaaaaatgaaagtaaccttcaagttactttttcaaaaagaagatctggacttttcaaaaaggctagtgagctttgcacactttgtggtgcagaagtggccatagttgtgttctcacctggtcgaaaagtcttttcttttggtcatccaaatgttgattctgtaattgatcgattcataaacaataaccctctacctcctcaccaacacaacaacatgcaacttagagaaactcgtcgaaattcgattgttcaggatctgaataatcatcttactcaggtgttgagtcaattagaaacagagaaaaagaagtacgacgagttaaagaaaataagagaaaagacaaaagcccttgggaattggtgggaagatcccgttgaggaacttgcgttatctcaactcgaggggttcaaaggtaatcttgaaaatttgaagaaagtagttacagtcgaagcttccagattttttcaggcaaatgttccaaacttctatgtgggaagttctagtaataatgctgcttttgggattgatgatggtagtcatatcaaccctgatatggatctctttagccaaagaagaatgatggacataaatgccttcaactacaaccagaaccaaattcaccctaatcatgcattaccaccctttggaaacaatgcttatggtattaatgaagggtttgttccagaatacaatgtgaacttcagaccagagtataacccaaaccaaaaccaaatccaaaaccaaaatcaagttcaaatccaaatccaaaaccagagttttaagagagaaaacatctctgaatatgaacatcatcatggttatcctccccagtctagatctgattactattaaccctttgttgtgtgatccaacttaagtctctagacaaa

SEQ ID NO: 4070 - DNA, 751 bp, Artificial Sequence
  P1223 (35S::G154)
tatcaaacccttttagccaatcgggaaattaactaaagaagaagatatggtgaggggcaaaactcagatgaagagaatagagaatgcaacaagcagacaagtgactttctccaaaagaaggaatggtttgttgaagaaagcctttgagctctcagtgctttgtgatgctgaagtttctcttatcatcttctctcctaaaggcaaactttatgaattcgccagctccaatatgcaagataccatagatcgttatctgaggcatactaaggatcgagtcagcaccaaaccggtttctgaagaaaatatgcagcatttgaaatatgaagcagcaaacatgatgaagaaaattgaacaactcgaagcttctaaacgtaaactcttgggagaaggcataggaacatgctcaatcgaggagctgcaacagattgagcaacagcttgagaaaagtgtcaaatgtattcgagcaagaaagactcaagtgtttaaggaacaaattgagcagctcaagcaaaaggagaaagctctagctgcagaaaacgagaagctctctgaaaagtggggatctcatgaaagcgaagtttggtcaaataagaatcaagaaagtactggaagaggtgatgaagagagtagcccaagttctgaagtagagacgcaattgttcattgggttaccttgttcttcaagaaagtgatctccactcaacaaaaaaaacaaaaaaacaaactaagtaaaaacaggtttagcagtactg

SEQ ID NO: 4071 - DNA, 699 bp, Artificial Sequence
  P1224 (35S::G1758)
ccctcctcttagcttcaaccgccggaaaaactaaacaaccttcttggaaaaaaagagaaactaaaaatgaactatccttcaaaccctaaccctagctccacagatttcactgaatttttcaagttcgatgattttgacgatacttttgagaagatcatggaagaaatcggccgtgaggaccactcgtcgtcaccgactttgagttggagttcatcggaaaagttagtggctgcagaaatcacaagcccgcttcaaacaagcctagctacctcacctatgagctttgaaataggtgacaaagatgaaatcaaaaagaggaagagacacaaagaagatccgattattcacgtcttcaaaacgaaatcatcaattgatgaaaaggttgctttagatgatgggtataaatggaggaaatacggaaagaagccgataacgggtagtccatttccaaggcattatcacaagtgttcgagcccagattgcaacgtgaagaagaagatcgaaagagatacgaacaatccagattacatattgacaacatacgaaggtagacataaccacccaagcccttctgtagtttattgtgattcagacgactttgatcttaactctctcaacaattggtcctttcagacggcaaatacgtatagtttctctcattctgctccatattgatcgatcgtagttacaagtttgtgt

SEQ ID NO: 4072 - DNA, 992 bp, Artificial Sequence; identical to SEQ ID NO: 377
  P1226 (35S::G464)

SEQ ID NO: 4073 - DNA, 1544 bp, Artificial Sequence
  P1227 (35S::G618)
cagataacgaccatttcttagattctccgtcgccgcctcttctagagatgagacaccaccaatcagcgacggagaacggtggtggttgcggagagattgtggaggtacaaggaggtcacattgttcggtcaacaggaagaaaagacagacatagtaaagtatgtacagcgaaaggaccacgtgaccggcgcgtgagactctcagctccgacggcgattcaattctacgatgttcaagatagacttggttttgatcgaccaagtaaagctgttgattggcttattactaaagctaaatccgccattgatgatcttgctcagcttcctccttggaaccccgccgatactcttcgtcaacacgccgccgctgctgctaacgctaaacccagaaaaaccaaaactttaatttctccgccaccgccacaaccggaagaaacagagcatcatcgaatcggagaagaagaagataacgaatcgagttttcttccggcgtcaatggattctgattcgatagctgacactataaagtcgttttttccggtagcttcaacgcaacagagctatcatcatcagccaccgtcacgaggcaatacacagaaccaagatcttcttcgtctctcgcttcaatctttccaaaatggtccaccttttcctaatcaaacagaacctgctctgttctccggccagagcaataatcagttagcgtttgactcatcgacggcaagctgggaacagagtcatcagtcaccggaatttggaaagatacagagactagtgtcatggaacaacgtcggagcagctgaatccgccggaagtaccggaggatttgtgtttgcttctccgtcgtcgttgcatccagtttatagccaaagtcagcttttatcacagaggggtccccttcagtccattaacacacctatgattcgtgcttggtttgatcctcaccatcatcatcatcatcatcagcagtccatgaccactgacgatctccaccatcatcatccctaccatatccctcccgggattcaccaatctgctattccaggcattgcatttgcttcaagtggtgaattctccggttttcgtataccagcacggtttcaaggcgaacaagaggagcacggcggcgacaacaagccgtcctctgcttcatccgattctcgccattaaacaagttccaaaaacacataagattgtgcaacacaacaggtttcttttcatattccagggcgcttcgaatgcgtggaatagtgaaggcggttttcgttgttgtgtgtttcgaatatccaaatggcctataaatctgatcaacagtttcaggttcttcttaagtctttaaaagcctaggccttggttaatttgaattcatcttgtatcaattagagaacgttctgtaagttcaattctgttttacaatgtttagctctagctacatgagctcacatcttgtttgttgtaacttgttctacaattacttgtcgtttctttatgttcttgtgttggaaacctttaaccccacttgaagctaaagtcttttgtttgccc

SEQ ID NO: 4074 - DNA, 780 bp, Artificial Sequence
  P1228 (35S::G450)
gacatatatagacagcaagaagagatatgaaccttaaggagacggagctttgtcttggcctccccggaggcactgaaaccgttgaaagtccggccaagtcgggtgttgggaacaagagaggcttctccgagaccgttgatctcaaacttaatcttcaatctaacaaacaaggacatgtggatctcaacactaatggagctcccaaggagaagaccttccttaaagacccttctaagcctcctgctaaagcacaagtggtgggttggccaccggtgaggaactaccggaaaaatgttatggctaatcagaagagcggcgaagcagaggaggcaatgagtagtggtggaggaaccgtcgcctttgtgaaggtttccatggatggagctccttatcttcggaaggttgacctcaagatgtacaccagctacaaggatctctctgatgccttggccaaaatgttcagctcctttaccatggggagttatggagcacaagggatgatagatttcatgaacgagagtaaagtgatggatctgttgaacagttctgagtatgttccaagctacgaggacaaagatggtgactggatgctcgttggtgatgtcccctggccgatgtttgtcgagtcatgcaaacgtttgcgcataatgaaaggatccgaagcaattggacttgctccaagagcaatggagaagttcaagaacagatcatgaacaaaaaaaaaagaggacaatatgcattgatttttttttttttggtattgttatgatcatgtgtttt

SEQ ID NO: 4075 - DNA, 1501 bp, Artificial Sequence; identical to SEQ ID NO: 163
  P1232 (35S::G196)

SEQ ID NO: 4076 - DNA, 2834 bp, Artificial Sequence
  P1233 (35S::G916)
caatctaagatatctatcaagatcttaagatatctacatttatagagatgtttcgttttccggtaagtcttggaggaggtccacgtgagaatctgaagccatcagatgagcagcatcaacgtgcggtggtgaatgaggttgactttttccgatcagcggagaagagagatagggtttcacgtgaagaacaaaacattatcgccgatgagactcatagggttcatgtcaaaagggagaattcacgtgttgatgatcatgacgatcgttctactgatcacatcaatgtaagcagatggttaactcatcgcttttgttttctttgttttttttttattatctagaagttcaagctaaaaattctacatttccgatatgcgaaacccacattagattaaattcattttttttggagaagagatcgttcccaacgtgcatcaaacccagtacatccacatgagaaatttaccactggaccaacagctcgttggttacttcattgttttccttttcgtcaatatcatttaattacttcggattttagttagtaatattataaaacaataatttcgttatatagatgaaaactttgttcattgaaatgtgtatgattattgtaaatagattggacttaatcttctcactgcgaatacgggaagcgacgagtcaatggtggatgatggattgtctgtggatatggaagagaaacgtacaaagtgtgaggtacacttattattcaattagtatagatcatttttgagtaataataacaaaaaaaagacacaactagtgtatttatcgcacgaaccaaagaaaaagagattgtcaaaatccaacaaataaaaaatgattgtcaaaaaccatcaagagtgtatatttttgtgcgtctgttacgtacgtaaacaattttccgcttttctgattcgtcagaattttaaataatatctgatgacaaaaaaaataaaaatatttttatgctaaattttgattatttttactgttcatcttcattttgtcacataattaagcataaaaagatattttctgattttctctacaaattttttatttcttaagaattagtaaaaatataccgttttcgtagacttagacattctatttttatatgttgttcgtatcggtccgtaagatccggacatgttagagagatttactctttcttactagaatgatttaatgtctgatacatgatttttttgttttttaataaaatgaagaatgcacaacttcgcgaagagctaaagaaggcgagtgaagataatcaaagactaaagcaaatgctaagtcaaacaaccaacaacttcaattccttgcagatgcaacttgttgctgtcatgaggcaacaagaagatcatcatcacctagtaattaattaacactctaatacgtcttaatcatttatttcatataattagttaaagattttatacccttgtttttcatcaggctacgaccgagaacaatgacaatgtaaagaaccgacatgaagtgcctgaaatggttccaagacagttcatcgatttgggaccgcattctgacgaagtgtcgtccgaggagaggacgacggttcggtcgggatctcctccctcgcttctagagaaatctagctcacgtcaaaacggaaagagagtgcttgtaagagaagaaagcccggaaaccgaatccaacggctggagaaaccctaacaaagttcctaaacaccatgcatcatccagcatttgcggtggcaatggcagtgaaaatgcaagtagcaaggtcattgagcaagcggccgccgaagccaccatgcgtaaagcccgtgtctcggttcgtgctcgatccgaagctcccatggtaatactaattaatcttcctctctagaatttctatgaagattgatctctacaaatgtttttggaggttcattaacatcaatgacattgttttacagttaagcgatggatgtcaatggagaaaatacggacaaaaaatggcgaaaggaaacccgtgccctcgagcttattaccgttgcacaatggctgttggatgtcctgttcgcaagcaagtacgttacctaaacaattcacacatctaaaattatgtttgaaggtgatcaatcaagtgtaataatttagagaaaaaaaaaataatgtattgtaacaaactcatgatgacctaacaggtgcaacgttgcgcggaagatagaaccattctcataacaacctacgaaggaaaccataaccatccattacctcctgcggctatgaacatggcttcaactacaacagcagccgcaagcatgcttctctcaggctccaccatgtcgaaccaagacggtttaatgaacccaacaaatctcttggctcgaaccatattaccgtgttcctcaagcatggctactatctcagcctctgcaccattcccaaccattacattagacctcacagagtcacccaacgggaacaatccaaccaataacccgctgatgcaattctctcaacggtctggtttggtggagttgaaccaatcggttttgcctcatatgatgggtcaggctttgtactacaaccaacagtctaagttttcgggtttacatatgccgtctcagccgctaaacgctggtgagagtgttagcgccgctactgccgcaatcgcctccaatcccaactttgccgcggctctagctgcagccataacttcgattatcaacggttcgaacaatcagcagaatgggaacaacaataacagtaatgttacaacgagcaacgttgacaataggcaataacatttttttataagttttagttagggactttttatcggtcgattttgttttg

SEQ ID NO: 4077 - DNA, 2021 bp, Artificial Sequence
  P1235 (35S::G175)
cttgagcccaagttaaagctgaaacttgggtttgcaatggctggtattgataataaagctgctgtaatgggagaatggttcgactgtagtactactaaccacaggaagagatcgaaagcggaacttggtagagagttttctttaaattacatcaagaatgaggattctttgcaaaccacctttcaagaaagttcacgaggagctcttcgtgaaaggattgctgcgagatccgggtttaatgcaccgtggttaaacactgaggatattcttcagtcgaaatctttaaccatctcttctcctggtcttagtcctgcaactctgttagagtctcctgttttcctctcaaaccctttggtaactttttcttttcaacatttcattatggtctctctctttcgtgaatcagtgctctaaaatctcttatcatttgtaagctcagctatctccaacaaccgggaagctctcatcagtaccttctgataaggctaaagctgagttatttgacgacattaccacatccttagccttccaaaccatttcaggaagtggccttgatcctactaacatcgctttagaacccgatgattcccaagactatgaagaaagacagctcggcggtttaggagactcgatggcttgttgtgcacctgcagatgatggatacaactggagaaaatatggacaaaagctagttaaaggaagtgagtatccgcggagctattacaagtgcacgcacccgaattgtgaggccaagaagaaggttgaacggtctcgggaaggtcatattatagagatcatatacacaggagatcatatacacagcaaacctccacctaaccgccggtcagggattggatcatccggtactggccaagacatgcaaatagatgcaaccgaatacgaaggttttgctggaaccaatgagaacatagaatggacatcacctgtatctgcagagctcgaatacggaagccattcaggatcaatgcaggttcaaaacgggactcatcagttcgggtatggtgatgcagcagctgatgccttatatagagatgaaaacgaagatgatcgcacgtcccacatgagtgtttccctgacttacgatggagaggtagaagagtccgaatcaaagagaaggtataaaaagttgctctagtaaccattataatacttagaaagacaagacgttctgacttctgagctctgatggcattcccgtatcaggaaactagaagcttatgcaacagaaacgagtggatcaaccagagccagccgtgagccaagagttgtggtgcagaccacaagtgacattgacatcctcgatgatggttatcgctggcgcaagtatgggcaaaaagtcgttaaaggaaacccgaatccaaggttcttgtatccaaatgctctgttctgctgctatccctttgttgaatttaataaaatcagttttctatgttttcaggagctactataaatgcacagctaatggatgtaccgtaacgaagcatgtagagagagcctctgatgacttcaagagcgtactaacaacttatataggcaagcacacccacgttgtaccagcagcacgcaacagcagccacgtcggtgcaggcagttcagggactctccaaggcagtttagcgactcagacccacaaccacaatgtgcactatccaatgccacacagtagatctgagggactggccacagccaactcatctctatttgacttccagtcacacctgaggcatcctacaggtttctccgtttacataggccaatctgagctttctgatctttcaatgcctggtctaactattgggcaagagaagcttaccagcctgcaggcgcctgacattggggatccaactggcctaatgttgcagttagcagcacagccgaaggtggaaccagtgtcaccacaacagggacttgatttgtcagcgagctcattgatatgcagagagatgttgagtagattacgacagatatgaaacaaatctctttgttcactgattgctcaa

SEQ ID NO: 4078 - DNA, 674 bp, Artificial Sequence
  P1238 (35S::G462)
atttcataattgtatcaaattgtgagaggaaaaaaagaagttcaagaaatggagaaggaaggactcgggcttgagataacggagctgagattggggcttccggggagagatgtggcagagaagatgatgaagaagagagctttcacggagatgaatatgacgtcgtcgggtagtaatagtgatcaatgtgaaagcggcgtcgtttcatctggtggtgacgctgagaaggttaatgattcgccggcggcgaaaagccaggtggtggggtggccaccggtttgttcttaccggaagaaaaacagctgtaaggaagcttcgaccacgaaagtggggttagggtatgtgaaagtgagcatggatggtgtgccttatttgaggaagatggatcttggttcgagccaaggctatgatgatctagcctttgctcttgataagctcttcggtttccgtggcatcggtgtggccttgaaagatggtgacaactgcgaatacgttaccatatacgaagacaaagatggagactggatgctcgccggtgatgtaccttgggggatgtttctagagtcatgcaagaggttgagaataatgaaaagatcggatgctaccgggtttgggctgcagcctagaggagtagacgagtgatgatgacttgaacaagaagcaaggagctggtt

SEQ ID NO: 4079 - DNA, 897 bp, Artificial Sequence
  P1240 (35S::G1499)
tccttaattgcatcaccaacctaacccctcatcatatgatcacctttctttttttcctttaatatatatatatgctcacacacacacatatatatatacatataagcatcgcctcaagcattaaaatttttacgaaccaaacaaacaaaaattatgaataattataatatgaacccatctctcttccaaaattacacttggaacaacatcatcaacagcagcaacaacaacaacaagaatgatgatcatcatcatcaacataataatgatccaatcggtatggccatggaccagtacacacagctccatatcttcaatcctttctcttcttctcatttccctcctctctcttcttccctcacaaccaccactcttctctccggagatcaagaagacgacgaagacgaagaagaacctctagaggaactcggtgctatgaaggaaatgatgtacaagatcgcagccatgcaatcggttgacatcgacccagcaaccgtcaagaaacccaaacgccgtaacgtgaggatctccgacgaccctcagagtgtggcggctagacatcgccgtgagagaatcagtgagaggatcagaattcttcagagactcgtgccaggtggcactaaaatggatacggcttcaatgctcgatgaagctatacgctatgtcaagttcttgaaacggcagatccggctactcaataataataccggatatactcctccgccgccgcaagatcaagcttctcaggcggtgacgacgtcatgggtttcaccgccaccaccgccaagtttcggccgtgggggaagaggagtaggagaattaatctagacaagatgacatttccattagtagtaactaaattatgctataatgtgtgagtaatggtgcaattatgga

SEQ ID NO: 4080 - DNA, 985 bp, Artificial Sequence
  P1245 (35S::G227)
cgtcgacgatccggcgatgtcaaacccgacccgtaagaatatggagaggattaaaggtccatggagtccagaagaagatgatctgttgcagaggcttgttcagaaacatggtccgaggaactggtctttgattagcaaatcaatccctggacgttccggcaaatcttgtcgtctccggtggtgtaaccagctatctccggaggtagagcaccgtgctttttcgcaggaagaagacgagacgattattcgagctcacgctcggtttggtaacaagtgggctacgatctctcgtcttctcaatggacgaaccgataacgctatcaagaatcattggaactcgacgctgaagcgaaaatgcagcgtcgaagggcaaagttgtgattttggtggtaatggagggtatgatggtaatttaggagaagagcaaccgttgaaacgtacggcgagtggtggtggtggtgtctcgactggcttgtatatgagtcccggaagtccatcgggatctgacgtcagcgagcaatctagtggtggtgcacacgtgtttaaaccaacggttagatctgaggttacagcgtcatcgtctggtgaagatcctccaacttatcttagtttgtctcttccttggactgacgagacggttcgagtcaacgagccggttcaacttaaccagaatacggttatggacggtggttatacggcggagctgtttccggttagaaaggaagagcaagtggaagtagaagaagaagaagcgaaggggatatctggtggattcggtggtgagttcatgacggtggttcaggagatgataaggacggaggtgaggagttacatggcggatttacagcgaggaaacgtcggtggtagtagttctggcggcggaggtggcggttcgtgtatgccacaaagtgtaaacagccgtcgtgttgggtttagagagtttatagtgaaccaaatcggaattgggaagatggagtaggcggcc

SEQ ID NO: 4081 - DNA, 812 bp, Artificial Sequence
  P1246 (35S::G247)
tcgggatcaagaaaagtgaagaagaatgagaatgacaagagatggaaaagaacatgaatacaagaaaggtttatggacagtggaagaagacaagatcctcatggattatgtccgaactcatggccagggccactggaaccgcatcgccaagaaaactgggctcaagagatgtgggaaaagctgtaggttgagatggatgaactacttaagccctaatgttaacagaggcaattttactgaccaagaagaagatctcatcatcagactccacaagctcctcggcaacagatggtcgttgatagcgaaaagagttccgggaagaacagacaaccaagtaaagaattactggaacacacatctcagcaagaaacttggtctcggagatcattcaactgccgtcaaagccgcatgcggtgtagagtctccaccgtctatggcccttataaccacaacgtcctcctctcatcaagagatctccggtggaaaaaattcaactctaaggttcgacactttagttgacgaatccaaactcaaaccaaaatccaaactagtccacgcaacaccaactgacgtagaagttgcagctacggttccaaatctgttcgataccttttgggttcttgaagacgacttcgagcttagttcactcactatgatggattttactaatgggtattgcctttgaatatctttgatgattagcttctaaaaagtaattaattatcgaataatagattataatgaccaataataataatatgaatacaattaaatttttttccgaatatttgcttgtagcttttgtactttct

SEQ ID NO: 4082 - DNA, 1185 bp, Artificial Sequence
  P1247 (35S::G971)
ccctcttttagaactctctctctctctcgtttttgacacttatcctctctcttttttctctctccctctctctctggccggaaaaaagaacaacgtcgtttatagctaaagattcgatcatgttggatcttaacctaaagatcttttcttcttataacgaagatcaagatcggaaagtaccattaatgatctcaaccaccggtgaagaagaatctaactcatcttcctcctccacaacagactctgcagcgagagatgctttcatcgcttttggaattctcaaacgcgacgatgaccttgttcctcctcctcctcctcctcctcataaagaaacaggagatctctttccggtggtggctgatgctcgtcggaatatagaattctccgtggaagacagtcactggttgaatctttcttctttacaaagaaatacacagaaaatggtgaagaagagcagaagaggaccaaggtctcgtagctcccaatatcgtggcgtcactttttaccgtcgcaccggtcgttgggaatctcatatttgggattgtggaaagcaagtttatttgggcgggtttgatactgcttacgcagcagcaagggcttacgaccgagctgctatcaaattccgtggtctcgatgcagacatcaatttcgtcgtggatgattataggcatgacatcgataagatgaagaatttaaataaggtggagttcgtgcaaacacttaggcgagagagtgcgagtttcggaagaggaagttccaaatacaaaggcttggctcttcaaaaatgcacccaattcaaaactcatgatcagattcatctcttccaaaacaggggatgggatgcagcagcaataaaatacaatgagttgggaaagggagaaggagccatgaagtttggtgcccatatcaaaggaaatggtcacaatgatcttgaactaagtctcggaatttcatcatcatcggaaagtataaagttgacaacaggcgattactataagggtatcaatcggtccacgatgggtttatacggtaagcaatcatcgatatttttacccatggcaaccatgaaacctctgaagacagttgcagcatcatcaggattcccttttatcagcatgacaagttcctcttcctccatgtccaattgttttgatccataggatcgttctacactctcttaactaa

SEQ ID NO: 4083 - DNA, 638 bp, Artificial Sequence
  P1249 (35S::G557)
aagacaacaaatctttccctctctctctcgcctgatcgatcttcaaagagtaagaaaaatgcaggaacaagcgactagctctttagctgcaagctctttaccatcaagcagcgagaggtcatcaagctctgctccacatttggagatcaaagaaggaattgaaagcgatgaggagatacggcgagtgccggagtttggaggagaagctgtcggaaaagaaacttccggtagagaatctggatcggcgaccggtcaggagcggacacaggcgactgtcggagaaagtcaaaggaagcgagggaggacaccggcggagaaagagaacaagcggctgaagaggttgttgaggaacagagtttcagctcagcaagcaagagagaggaaaaaggcttacttgagcgagttggaaaacagagtgaaagacttggagaacaaaaactctgaacttgaagagcgactctctactcttcagaacgagaaccagatgcttagacatattctgaagaacacaacaggaaacaagagaggaggtggtggtggttctaatgctgatgcaagcctttgatctccttcttcttcttgtgttatatttttgtggataaaatttacagagaattgtatcaataattatcatgtta

SEQ ID NO: 4084 - DNA, 1595 bp, Artificial Sequence
  P1254 (35S::G1506)
tgtataagctcaattagtagcaaacaagaaaaaacaatcttaaactcaatttcacaaaatctctgattcttgtgaaaatttgtatattgcaaaactttggaaaaaaaagagaaaaaagatggggaagcaaggtccttgctatcactgtggagttacaagtacacctctatggagaaacgggccaccagagaagccggtgttgtgcaatgcgtgtggttcgaggtggagaactaaaggatcattagtaaactacacacctcttcatgctcgtgctgaaggtgatgagactgagattgaggatcatagaactcaaacggtgatgattaagggaatgtctttgaacaaaaagattcccaagaggaaaccatatcaagaaaacttcacagtgaaaagagctaacttggaattccataccggtttcaagaggaaggctctggatgaagaagctagcaatagatcgagttcaggatcggttgtatcaaactccgagagctgtgcacaatctaatgcgtgggactcgacttttccttgtaagagaaggacatgtgtgggacgtccaaaggcagcttcttctgttgaaaagctcacaaaggatctttatactattctacaagaacagcaatcttcttgtctctctggtacttcagaggaagatttgctttttgagaatgaaacaccaatgctgttaggacatggtagtgttcttatgagagatcctcactcaggtgctcgagaagaggaatctgaagctagctcactcttagttgagagcagcaagtcttcatcagttcattctgttaaatttggtggaaaagcaatgaagcaggagcaagtgaagaggagcaaatctcaagtcttaggaagacatagttcactactctgtagcatagatttgaaggatgttttcaactttgatgagttcatagaaaatttcacagaggaagaacagcaaaaactgatgaaattacttcctcaagttgactctgttgatcgtcctgatagcctcagaagcatgtttgagagttctcaattcaaagagaacttatccttgtttcagcaacttgtggcagatggtgtttttgagacaaattcgtcttatgcaaaacttgaagacattaagacacttgcaaagcttgctttatcagatcctaacaaatcccatttgttggaaagctattacatgctcaagagaagagagattgaagactgtgttactacaacatcaagggtctcaagcttgagtccatcgaataataatagtcttgtaaccattgaaagaccttgtgaaagcttaaaccaaaacttctcagagacaagaggtgtgatgagaagcccgaaagaagtgatgaagattagatcaaagcacaccgaagagaatttagagaatagtgtatcttcctttaaacctgtgagctgtggtggacctctggtgtttagctatgaagataatgatatttctgatcaggatcttcttcttgatgtgccgtcgaacggctcattccctcaagcagagcttctaaacatgatatgaaagaagataaagtttctcaaactcattggttaaactcattgtgtttctcagaacaaagacagac

SEQ ID NO: 4085 - DNA, 958 bp, Artificial Sequence; identical to SEQ ID NO: 3847
  P1257 (35S::G1048)

SEQ ID NO: 4086 - DNA, 1183 bp, Artificial Sequence
  P1258 (35S::G568)
caaccaaagactaaagctgtgttgttggttcacttctgttctcttttccaatgttgtcatcagctaagcatcagagaaaccatagactctctgctacaaacaagaaccagactctcaccaaagtttcttccatttcatcctcatcaccatcgtcttcttcttcatcatcatcaacctcatcatcatctcctttaccttctcaagactctcaagcccagaagagatctcttgtcaccatggaagaagtttggaatgacatcaaccttgcttccatccaccacctaaaccgacacagccctcatccacaacacaaccacgagccaaggttcaggggccaaaaccaccacaaccaaaaccctaactcaatcttccaagattttctcaaaggatctttgaaccaggaaccagcacccacaagccagaccacgggttctgcgcctaatggcgattccaccacggtcactgttctttacagctctccttttccacctcctgcaactgttctgagcttgaattccggcgctggcttcgagtttctcgataaccaagatcctcttgttacctcaaactctaatcttcatacccaccatcacctctcaaacgctcatgccttcaacacctctttcgaggctctggttccatccagttcttttggtaagaaaagaggccaagattccaatgaaggttcagggaatagaagacataagcgtatgatcaagaacagagaatctgcagctcgttcccgcgctaggaaacaggcttatacaaacgagttagaacttgaagttgctcacttgcaggcagaaaatgcaagactcaagagacaacaagatcaaaaaatggctgcagcaattcagcaacccaaaaagaacacacttcaacggtcttccacagctccattttgagaaatctacaagtccttgtttctcttttggggattgagattgtctcatgaagaagtgaaaaaatggcaaaagtttgtacccttttttattagctataagtataactaagcctaaaattgtagaactaagatattgtaggggaaaaaagaagatgtaaaacaaaagacccggaaagagaaaaggatctttcaatttcctaaggcacaggaacacctgtcctgggtcctctcttaatgttctgtcgttttcctatgcaaacccttttttcacttctgtac

SEQ ID NO: 4087 - DNA, 1559 bp, Artificial Sequence
  P1263 (35S::G1145)
tggctatttatcaaattgagcattagggtttctgatttgtgggttcagaattgtttttatctatctgtcttgttgttttttgtccgctacaaaagcctatggattctcagaggggtattgttgaacaagctaaatctcagtccttgaataggcaaagctctctttacagcttaacacttgatgaggttcaaaatcacttggggagttctggtaaagctctgggaagcatgaaccttgatgagcttttgaagagtgtctgttctgttgaagctaatcagccatcgtctatggctgtcaatggtggagcagctgctcaggagggtctttctcgccaggggagtttgactttgcctcgggatctcagcaaaaagactgttgatgaggtttggaaagacattcagcagaataagaatggaggtagtgctcatgagaggagggataagcagcctacacttggggaaatgacgcttgaagacctgttgttgaaagcaggagtggtcactgagactatccctggttcgaaccatgatggtcctgttggtggtggtagtgctggttcaggtgctggtttagggcaaaacattactcaagttggcccatggattcaatatcatcagctcccatcaatgccacagcctcaagcatttatgccctatccggtttcagatatgcaagcaatggtgtctcagtcttctttgatgggtggtttgtcagatacacaaactcctggaaggaagagggtagcttcaggagaagttgtagagaagactgtagagaggaggcagaagagaatgataaagaacagagagtctgctgctcgttcccgagctaggaaacaggtgagaaacaactaatttgttgttgttattcttcttgtcaagtcatgctcgtttttgttttaacattggatattgatgagcaggcttacactcatgagctagagatcaaagtttcacggttagaagaagaaaacgaaagactcaggaagcaaaaggtaatgcattgtaggtttttctccctttttacaacacatgcattgattaaatttgtgattactagaaacttgtaagagctgatcgttgattagttctggattcatattaaagggaatgatagatgatagaagatgtagtgaagtatagaatagggcacacgcatagtagacaatatatgatagaaaatataaccacgaacaagagacaggaggaataggtttagaccaaacgtcttaggagacatagttttcctttacccggaacaagttggtcttgctggtttctagtcttcatggactttctgttcttcaattttgtctgcgtttatgtgtggccaaagctaatccttacattactttgcaggaggtggaaaaaatcctcccaagtgtaccaccgcctgatcccaagcggcagctccgacggacaagctcggctcctttctgatctctaaactctttttgtctttttctttttttctcttctgtgtcggttcacttataaaaaagagaggaaaacagctttgtttctttgtacattccgtagactttcttgacttggagcaat

SEQ ID NO: 4088 - DNA, 1475 bp, Artificial Sequence
  P1264 (35S::G1340)
gctacctcttggtaaatccaaagagacacatatatggctgacgctgatccatcgagtggtgaacagatagttatgagagagtgcagaaaagggaattggacagtgagtgagactttggttctcatagaagccaagaagatggacgaccagaggcgtgtacggcgatcggaaaaacaacctgaaggcagaaacaaaccagcagagctccggtggaaatggatagaggagtattgctggagaagaggatgttaccgcaaccagaatcagtgcaacgataagtgggacaatctcatgagggattacaagaagatcagagagtacgagagatcaagggtagaatcgtcttttaacaccgtcacttcttcctcttactggaagatggacaagactgagaggaaagagaagaacttgccgagtaacatgttgcctcagatatacgacgtgttgtctgagcttgttgacagaaaaactcttccttcctcctcctccgccgccgccgccgtaggaaacggtaacggtggccagatcctaagagtttgccaacaaagtttaggatttgtagctccgatgatggctcagccgatgcatcaaatcccgactactatagtgttatctcttccgccaccaccgccacagtctcttagcttatcacttccttcgccgcctcaacctccaccatcgtcttcatttcacgctgagcctataccgcccacagtaggtaccttccgttttatctctcttcttattcttaaagcctaattaaatgaccactaaagttagattttatattaaatctataaagtggatttcgacattccaacaaacaccctcaagtcaacttgttattaattataatcaatctaattataaatttaaaatcaaaacttatacaattactatgaaggaaaaaatgtaaccctaaatttgcttgtgtgtgcatagacaattctttacaataaagttcttgagtacattaagattaaagtagtaattaaacccgcattttggtcgatgaagagactgataagagtgtgtacattcaggtacatcatcgacaaagcgaaggagaacaacgccgggagaaaccaccgctggaggagagagggaggtagaggaggatgcggttggggtggcgttgtctagatgcacgtctgtgatcacacaagtgataagagagaatgaggagggacaagagaggaggcataaggaagtggtgaggctacaagagaggagactaaagattgaggaatcaaaaactgaaataaatagacaaggtatgaatggtttggtagacgccattaatcaactcgcaagctctattcttgctttggcttcttcttcttgccataataatcgcaatcatcaaggaggtccaccatgatacctatattgaatagatgtgttactttaatacttaagttgatgattagttgcttagttaatatgtaggtatgtgtatataaagtgacgttatg

SEQ ID NO: 4089 - DNA, 624 bp, Artificial Sequence
  P1266 (35S::G977)
caccaaactcacctgaaaccctatttccatttaccattcacactaatggcacgaccacaacaacgctttcgaggcgttagacagaggcattggggctcttgggtctccgaaattcgtcaccctctcttgaaaacaagaatctggctagggacgtttgagacagcggaggatgcagcaagggcctacgacgaggcggctaggctaatgtgtggcccgagagctcgtactaatttcccatacaaccctaatgccattcctacttcctcttccaagcttctatcagcaactcttaccgctaaactccacaaatgctacatggcttctcttcaaatgaccaagcaaacgcaaacacaaacgcaaacgcagaccgcaagatcacaatccgcggacagtgacggtgtgacggctaacgaaagtcatttgaacagaggagtaacggagacgacagagatcaagtgggaagatggaaatgcgaatatgcaacagaattttaggccattggaggaagatcatatcgagcaaatgattgaggagctgcttcactacggttccattgagctttgctctgttttaccaactcagacgctgtgagaaatggccttgtcgttttagcgtattcttttc

SEQ ID NO: 4090 - DNA, 1099 bp, Artificial Sequence
  P1268 (35S::G993)
caaatatggaatacagctgtgtagacgacagtagtacaacgtcagaatctctctccatctctactactccaaagccgacaacgacgacggagaagaaactctcttctccgccggcgacgtcgatgcgtctctacagaatgggaagcggcggaagcagcgtcgttttggattcagagaacggcgtcgagaccgagtcacgtaagcttccttcgtcgaaatataaaggcgttgtgcctcagcctaacggaagatggggagctcagatttacgagaagcatcagcgagtttggctcggtactttcaacgaggaagaagaagctgcgtcttcttacgacatcgccgtgaggagattccgcggccgcgacgccgtcactaacttcaaatctcaagttgatggaaacgacgccgaatcggcttttcttgacgctcattctaaagctgagatcgtggatatgttgaggaaacacacttacgccgatgagtttgagcagagtagacggaagtttgttaacggcgacggaaaacgctctgggttggagacggcgacgtacggaaacgacgctgttttgagagcgcgtgaggttttgttcgagaagactgttacgccgagcgacgtcgggaagctgaaccgtttagtgataccgaaacaacacgcggagaagcattttccgttaccggcgatgacgacggcgatggggatgaatccgtctccgacgaaaggcgttttgattaacttggaagatagaacagggaaagtgtggcggttccgttacagttactggaacagcagtcaaagttacgtgttgaccaagggctggagccggttcgttaaagagaagaatcttcgagccggtgatgtggtttgtttcgagagatcaaccggaccagaccggcaattgtatatccactggaaagtccggtctagtccggttcagactgtggttaggctattcggagtcaacattttcaatgtgagtaacgagaaaccaaacgacgtcgcagtagagtgtgttggcaagaagagatctcgggaagatgatttgttttcgttagggtgttccaagaagcaggcgattatcaacatcttgtgacaaattct

SEQ ID NO: 4091 - DNA, 1080 bp, Artificial Sequence
  P1269 (35S::G860)
acaaaaccacatctctgaactgaaccaatttctcttctcccccttccggttatcggattaccagatctcgtttcccgcgatctagtttattctttgaaaaagtgatagaagcagaaatgggaaggggcaagatcgcgattaagaggatcaataactctacgagccgtcaggttacgttctcgaagcgaaggaatggattgttgaagaaagctaaggagcttgcgattctctgcgatgctgaggttggtgtcatcatcttctccagcaccggtaggctctacgatttctccagctccagcatgaaatcggtcatagagagatacagcgatgccaaaggagaaaccagttcagaaaatgatcccgcttcagaaattcagttctggcaaaaggaggctgcgattctaaagcgtcagctacataacttgcaagaaaaccaccggcaaatgatgggggaggagctctctggactaagtgtagaagctttacagaatttggaaaatcagcttgaattgagccttcgtggcgttcgaatgaaaaaggatcaaatgttaatcgaagaaatacaagtacttaaccgagaggggaatctcgttcaccaagagaatttagacctccacaagaaagtaaacctaatgcaccaacagaacatggaactacatgaaaaggtttcagaggtcgagggtgtgaaaatcgcaaacaagaattctcttctcacaaatggtctagacatgagagatacctcgaacgaacatgtccatcttcagctcagccaaccgcagcatgatcatgagacgcattcaaaagctatccaactcaactatttttccttcattgcataatataattcggtgtgccaacacacttatgttgacctcgtcggaatcatatcacaattcactgtgtcagcttgcctctgcataagcgaaaataaaaacataaacatgatcagtttgcattccatatctatcaaacaccagctttgtaacttttaaaactttttctccgtgcaaagacctttggtttggcgcttaagcatgtagtttgatgatcaaaggaaatgggtgttttagcataaagttg

SEQ ID NO: 4092 - DNA, 1149 bp, Artificial Sequence
  P1270 (35S::G1421)
ctccttctttagtgtcctccttcaccaaactcttgattccataagcatatattaaaaaagctctctgctttcttcaactttcccgggaaaatcttcttgttacaaagcatcaatctcttgttttaccaattttctctctttattccttttttgccctttacttttcctaactttggtctttatatataaacacacgacacaaagaagaacacacataagttaaaactattacaacagttttaaagagagagatttaaaaaatggagacagagaagaaagtttctctcccaagaatcttacgaatctctgttactgatccttacgcaacagattcgtcaagcgacgaagaagaagaagttgattttgatgcattatctacaaaacgacgtcgtgttaagaagtacgtgaaggaagtggtgcttgattcggtggtttctgataaagagaagccgatgaagaagaagagaaagaagcgcgttgttactgttccagtggttgttacgacggcgacgaggaagtttcgtggagtgaggcaaagaccgtggggaaaatgggcggcggagattagagatccgagtagacgtgttagggtttggttaggtacttttgacacggcggaggaagctgccattgtttacgataacgcagctattcagctacgtggtcctaacgcagagcttaacttccctcctcctccggtgacggagaatgttgaagaagcttcgacggaggtgaaaggagtttcggattttatcattggcggtggagaatgtcttcgttcgccggtttctgttctcgaatctccgttctccggcgagtctactgcggttaaagaggagtttgtcggtgtatcgacggcggagattgtggttaaaaaggagccgtcttttaacggttcagatttctcggcgccgttgttctcggacgacgacgtttttggtttctcgacgtcgatgagtgaaagtttcggcggcgatttatttggagataatctttttgcggatatgagttttggatccgggtttggattcgggtctgggtctggattctccagctggcacgttgaggaccattttcaagatattggggatttattcgggtcggatcctgtcttaactgtttaagaaataactggccgtttaacggcgt

SEQ ID NO: 4093 - DNA, 960 bp, Artificial Sequence
  P1271 (35S::G1043)
aaataagataccactcaccaaaaacttcctcaaaactaacaaatggatactaataaagcaaaaaagcttaaagttatgaaccaactcgttgaaggccatgacttaacaactcagcttcagcaactcctctctcaacccgggtccggtctagaggatctagtggctaaaatcttagtgtgtttcaataacaccatctccgttcttgataccttcgaacccatctcctcctcctcatccctcgccgccgttgagggatctcaaaatgcttcatgtgataacgacggcaagtttgaagattccggcgatagtcggaaaagattgggacccgttaagggtaaaagaggatgctacaaaagaaaaaagagatcggagacgtgtactatagagtcgactatacttgaggacgcattttcttggaggaaatatggacaaaaggagattcttaatgccaaattcccaagaagttactttagatgcacacacaagtatacccaagggtgcaaggcaacaaagcaagtccagaaggttgagctcgaacccaagatgttcagtatcacatacataggaaaccacacgtgtaacaccaacgcagaaactcccaagagcaagacttgtgaccatcatgatgagatcttcatggattccgaagatcacaagagtcctagtttatctacctcaatgaaggaagaagacaatcctcatcgtcatcatggttcgtccacggagaatgacttgtcattggtgtggccagaaatggttttcgaagaagattatcatcatcaggccagttacgtcaatgggaaaacgagtacatctatcgatgttttgggttctcaggatctcatggtgtttggaggtggcggcgatttcgagtttagcgaaaatgagcacttctctatcttcagttcatgttcgaatctatcttgagtttaccactactataggactaagaccatgagt

SEQ ID NO: 4094 - DNA, 897 bp, Artificial Sequence
  P1277 (35S::G255)
agcatcatcatcatcagaagaagagagtcatgggaagatctccttgctgcgagaaagaacacatgaacaaaggtgcttggactaaagaagaagatgagagactagtctcttacatcaagtctcacggtgaaggttgttggcgatctcttcctagagccgctggtctccttcgctgcggtaaaagctgccgtcttcggtggattaactatctccgacctgatctcaaaagaggaaactttacacatgatgaagatgaacttatcatcaagcttcatagcctcctaggcaacaagtggtctttgattgcggcgagattacctggaagaacagataacgagatcaagaactactggaacacacatataaagaggaagcttttgagcaaagggattgatccagccactcatagagggatcaacgaggcaaaaatttctgatttgaagaaaacaaaggaccaaattgtaaaagatgtttcttttgtgacaaagtttgaggaaacagacaagtctggggaccagaagcaaaataagtatattcgaaatgggttagtttgcaaagaagagagagttgttgttgaagaaaaaataggcccagatttgaatcttgagcttaggatcagtccaccatggcaaaaccagagagaaatatctacttgcactgcgtcccgtttttacatggaaaacgacatggagtgtagtagtgaaactgtgaaatgtcaaacagagaatagtagcagcattagctattcttctattgatattagtagtagtaacgttggttatgacttcttgggtttgaagacaagaattttggattttcgaagcttggaaatgaaataaatgaatagtattagattcttaatttgtaggtctgataatgaatgttagattcgcggcc

SEQ ID NO: 4095 - DNA, 583 bp, Artificial Sequence
  P1278 (35S::G2010)
ctccaacaaaccatctttataagactccaaaatggagggtaagagatcacaaggacaaggttacatgaaaaagaagtcttaccttgtggaagaagatatggagactgatacggatgaagaagaggaagtaggtagggatagagttagagggtctagaggtagcatcaatcgtggtggctcgttgcggctttgccaagtagatagatgcacagctgatatgaaagaggcaaaactgtatcaccggagacacaaagtgtgtgaagttcatgcaaaggcatcttctgtctttctctcaggacttaaccaacgcttttgtcaacaatgcagtaggtttcatgacctccaagagtttgatgaagctaagagaagttgcaggaggcgcttagctggacacaatgagcgaagaaggaagagctctggtgagagtacttatggagaaggatcaggtcggagaggaatcaatggtcaggtggtgatgcagaatcaagaaagatcaagggtagagatgacacttcctatgccaaactcatcattcaagcgaccacagattagatagagaagctgttctgctctctctcttctg

SEQ ID NO: 4096 - DNA, 1575 bp, Artificial Sequence
  P1279 (35S::G1786)
ccctgacgttctaccaatcacccgggacgcagagggggcaatgatcgtgtacggtgggggagcatccgaggacggtgaaggtggaggggtggttctgaagaaagggccatggacggtggccgaggacgagacactggcggcttacgtacgggaatacggtgaagggaactggaattctgttcagaagaagacatggctggctaggtgtggcaagagctgccgcctccgctgggctaaccacttacgacctaatctcaggaaaggctccttcacccccgaggaagaacgtctcatcatacaactccactctcagctaggcaacaaatgggctcgcatggctgctcaggttaatgatcaatcctacacttatataaatctgataaaactgcattgcttctctctgttttctaggcttcttagttcttcatgctctcttcttcttcttccagctctcaaaaaactttaaccattgtcttcttctactgtttgttttgaatagttaccaggcagaacagataacgagatcaagaactactggaacacgaggttgaaacgcttccaacgccaaggcctccctctctaccctccagaatattcccaaaacaatcatcaacaacaaatgtatcctcaacagccctcctcacctctcccgtcccaaacacctgcttcttcctttacctttcctctcctccaaccgccttctctgtgtcccaaacgttgttataacactgccttctctcccaaggcctcatatatttcttctccaaccaatttccttgtctcgtctccgacctttcttcacacccattcctctctttcctcctatcagtctaccaatccggtttactccatgaaacatgagctctcttcaaaccaaattccatactctgcctctttaggagtctatcaagtaagcaagttctcagacaatggggattgtaaccaaaacctgaacaccggtttgcatacaaatacctgtcagctgttagaggatcttatggaggaggccgaggctctagctgatagctttcgtgctcctaagcggagacaaatcatggctgcgcttgaggacaacaacaacaacaacaactttttctcgggaggtttcggacatcgtgtttcttccaacagtctatgttccttgcaaggtaataataatcagacaactcaaaatgcttcaatctgcaaaaacaagtgtttgaattttattttattttgattgacacaggtttaacaccaaaggaagatgagtctctccagatgaacacaatgcaagatgaggacataacaaagcttcttgactggggaagtgaaagtgaagaaatctcaaacgggcaatcctctgtgataacaacagagaacaaccttgtccttgacgatcaccagttcgcttttctgtttccagttgatgatgacaccaacaacttgccagggatctgctagagaaagacgaaacaactaaatggaaacatgttcctgattgtacaattaaaatcctgaatatacctgtcaaatatgttattaaagcaatatgatcctcatgtatagagatcttagcattgttcatctgttaca

SEQ ID NO: 4097 - DNA, 734 bp, Artificial Sequence
  P1284 (35S::G1820)
tctcacttccaacatccaaatccctagaaattgtaaatggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaattgaagtgtagatttagggtttgtaaccgcctatgtgggaaatttgaaatttggtggtgtttattagggttcttcaattcgtcggatttgctt

SEQ ID NO: 4098 - DNA, 800 bp, Artificial Sequence
  P1285 (35S::G1819)
aatagttgggctgatttcgtagcccacttaatcagcctttaaatatggaaaccctagcctagaaagtgaacaagaaaaacgtaaagatcaaaatggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaattgaaaagtgttgattgggttttagggttgtaatgcttttgtgagaatttgtatctctatggagtcatgtttg

SEQ ID NO: 4099 - DNA, 746 bp, Artificial Sequence
  Artificial sequence
  P1286 (35S::G1821)
accgcgcatgcagacgtcatcgaagccattatgcactaaaacttccatttttcttatttttgttaggattagcagcgaattttctgatggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtactgagaacaatggctaataacatagacagctgacagagtcataact

SEQ ID NO: 4100 - DNA, 1164 bp, Artificial Sequence; identical to SEQ ID NO: 1341
  P1294 (35S::G2060)

SEQ ID NO: 4101 - DNA, 1219 bp, Artificial Sequence; identical to SEQ ID NO: 829
  P1298 (35S::G1129)

SEQ ID NO: 4102 - DNA, 913 bp, Artificial Sequence
  P1301 (35S::G1143)
agaagaagaaataaatgggtggaggaagcagatttcaagaaccagtgaggatgagccgtaggaaacaagtaacaaaagagaaggaagaagatgaaaacttcaaatctccaaatcttgaagcagagagacgtagaagagagaagcttcattgtcggcttatggctctgcgatctcatgtccccattgtcaccaacgtaagtcccaaatctcgattattattttatgggtattttggtgatgattgttgttgtttttgtttcgttttcagatgactaaagcaagtattgttgaagatgcgattacttacataggagagcttcaaaacaatgttaagaatctcttagagacatttcatgaaatggaagaagctcctcctgagattgatgaagaacaaacggatccaatgataaaacctgaagttgaaactagtgatcttaacgaagagatgaagaaactcggaatcgaggtttttaaaatttctctaatcgatttttgattcattttctttatctttcttgatgattttttatttttgggacaggagaatgtgcaattgtgtaagattggggagaggaagttttggttaaagatcataacagagaagagagatgggatctttactaaattcatggaggttatgagatttctcggattcgagattatcgatattagtctaacaacttcaaatggagcaattcttattagtgcctctgttcagacacaggaactctgtgatgttgaacagacaaaagattttcttttggaagttatgagaagcaatccataagtattaattatatacatcttggaaatttcttgatctaataacatttccattggtttttattacattgttgttccattttaaatatgatatgattcagatgaaaaagagtttgtgttacaagccaat

SEQ ID NO: 4103 - DNA, 2205 bp, Artificial Sequence
  P1302 (35S::G1652)
gcaagtccaaatctccctctctctctctctatctatctctctatagaaggtaaacttcaacttcatctttcttagactgcttaaatttctcaaattcttgtaaagcttttggaattcaagaaatattaatgttatataatttcattttcttgggttaatagtttcctcatatgattaccaattttcagattttttaactaagaagctagcgatcatggccacagcgatgaacgttttctctaccaaatggtcctccgaattggtatatttctatacacacatacatacatatttatgtgtgcctctctttcctcatatgattttgtatatatataaaatctatattcatgttcttttaacctactttttcttaggcaaatttcacgaatctttattatttgcttttcgtataggatatagaagaatatagtatcatccaccaattccacatgaactcactcgtcggagatgttccacagtctctctcatctcttgatgataccaccacttgttataaccttgatgcttcttgtaataaaagtttggtagaagaaagaccttcaaagatcctcaagaccactcacatatcaccaaacttacatcctttttcttcttctaatcctcctcctccaaagcaccagccctcttctaggattctttcttttgaaaagacaggtttacatgttatgaatcacaactctccaaacttaatatttagccccaaggacgaagaaattggattaccagagcataagaaagccgagctgataataagagggacaaagagagctcaatccttgactcgaagccaatcaaatgctcaagatcacatactggcagagagaaaacggagagagaagcttactcaaagatttgtagctctttccgcgctaattcctggcctaaagaaggtacacatatgtaaaaataaatcttctcttcttcttcttgtttaataaagaggcgcataccaaccaaatgatagtgtagtcttttcttaaataattctattttgctaggcaagaaaccaattttcatggacagtattcactcttttcttatacccacaatgaaagttttgacttcagatctcccggttatgagactaaattatttgaccaggaccgactttgtgaaactcgaaatatactaaaacaaatcctctatatataagaattattacttttttacaaatcatttgcagttccggcttgaaggtttttcatttcgattaaatataaatatatttacatgctatatattgaaatatgcatctatgtcattatagatggacaaggcttctgtgttgggagatgcaataaagcatataaagtacctccaagagagtgtgaaagagtatgaggaacaaaagaaggaaaagacaatggaatcagtggttcttgtaaagaagtctagtctggttttagatgaaaatcatcaaccatcatcatcatcttcctcagatggaaatcgcaatagctcgagctcaaatcttccagaaatagaagttagggtttcaggaaaagatgttcttattaagatcctatgcgagaagcaaaagggtaatgtgatcaagattatgggggagattgaaaagcttggtttgtctatcaccaacagcaatgtcttgccctttggacccacttttgacatctctattatcgctcaggtaactatatattttctcatataagctacaacataactttattctagtattcaacataaatatatatatcgtgtgacaacataaatcaattctatagataatgtacatgtttcagaattagtatgactttggacttaaatattctagtattcgaaaattctaatgatatagtttattctttgcagaagaataacaattttgatatgaaaatcgaggatgttgtgaagaacttgagttttggcttatcaaagctcacttaattggtttcacgttacatacatatacacattcatcatcgatttctccgatcgaagaatccaaaatcagtttttccatgaaagtggttttttagttgttaagtttgttgtatggagattcttaagtcatttaaagatccttgttcttgtgttgttaagtgtgctttaagatgcatatcatcaaatgtttagtaattatttctctccagtttcatttgggacggaatttttttcgcagttgttggatatatatttcctgcgatgtaaagcatttcgtta

SEQ ID NO: 4104 - DNA, 1445 bp, Artificial Sequence; identical to SEQ ID NO: 1285
  P1305 (35S::G1944)

SEQ ID NO: 4105 - DNA, 895 bp, Artificial Sequence
  P1308 (35S::G1759)
aacgcttagtatctccggcgacttgaacccaaacctgaggatcaaattagggcacaaagccctctcggagagaagccatgggaagaaaaaaactagaaatcaagcgaattgagaacaaaagtagccgacaagtcaccttctccaaacgtcgcaacggtctcatcgagaaagctcgtcagctttctgttctctgtgacgcatccgtcgctcttctcgtcgtctccgcctccggcaagctctacagcttctcctccggcgataacctggtcaagatccttgatcgatatgggaaacagcatgctgatgatcttaaagccttggatcatcagtcaaaagctctgaactatggttcacactatgagctacttgaacttgtggatagcaagcttgtgggatcaaatgtcaaaaatgtgagtatcgatgctcttgttcaactggaggaacaccttgagactgccctctccgtgactagagccaagaagaccgaactcatgttgaagcttgttgagaatcttaaagaaaaggagaaaatgctgaaagaagagaaccaggttttggctagccagatggagaataatcatcatgtgggagcagaagctgagatggagatgtcacctgctggacaaatctccgacaatcttccggtgactctcccactacttaattagccaccttaaatcggcggttgaaatcaaaatccaaaacatatataattatgaagaaaaaaaaaataagatatgtaattattccgctgataagggcgagcgtttgtatatcttaatactctctctttggccaagagactttgtgtgtgatacttaagtagacggaactaagtcaatactatctgttttaagacaaaaggttgatgaactttgtaccttattcgtgtgag

SEQ ID NO: 4106 - DNA, 1163 bp, Artificial Sequence
  P1310 (35S::G1930)
acattcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagattatttatg

SEQ ID NO: 4107 - DNA, 1190 bp, Artificial Sequence
  P1313 (35S::G168)
acaaccacacaaaacaaaaaacaaattcatggggatgaagaaggtaaagctatctttgatagctaatgaaatatcaagggaaacatccttcatgaagaggaaaaatgggataatgaagaaactctacgagttgtcaactctatgtggtgtccaagcttgtactctcatctacagtccattcattccggttccagagtttctggagatgtcgccgacagcccgaacaaggaagatgatgaatcaagaaacgtatctaatggagaggattaccaaagcaaaagagcaactacagaacctggttggtgcgaaccaagagttacaggttagacgatttatgtttgattgtgttgaaggcaaaatgtcgcagtatcgttatgatgcaaaagaccttcaagatttgttatcttgtataaatctatatctcgatcagcttaacggaaggatcgagatccttaaagaacacggtgactcgttgccttccgtctctccttttcctactagaattggtgttgaagaaactggtgatgagtcgtcttccgactctcctattcttgctacaactggggttgtagatactcctaatgctacaaatcctcgtgttcttgtggccgatacgactcattttcttgatgcgaatgcaactgcggtaactgctccctttggattttctaatcatattcaatataagaatatgaatatgagtcaagatctgcatcgaccgtttcaacaccttgttcctactaacttttgtgatttttttcaaaatcagaatatgaatcaggttcaataccaggctcctcctaatgatatgtttaatcagattcaacgagagttctacaacattaatttgaatcagaaatcaaatcagtatatgaatcaacaacaaccattcatgaatccgatggtggaacaacatatgagtcatgttggagggcgtgagagcattcctttcatggacggaaactactacaactacaatcaactaccagtcgttgatcatggttccacaagttacatgccttccaccaccggtgtttatgatccttacttcaacaataatctctaatcaaaagagggagattttctaatctaagtgttcagttgtttgtatttgtgttttcttcatttcaaaagacaaaaactaattttgtttattaataattgttgtaatggttaaagtgtctctcttt

SEQ ID NO: 4108 - DNA, 1921 bp, Artificial Sequence; identical to SEQ ID NO: 459
  P1329 (35S::G581)

SEQ ID NO: 4109 - DNA, 1613 bp, Artificial Sequence; identical to SEQ ID NO: 239
  P1330 (35S::G264)

SEQ ID NO: 4110 - DNA, 677 bp, Artificial Sequence
  Artificial sequence
  P1344 (35S::G353)
accaaactcaaaaaacacaaaccacaagaggatcatttcattttttattgtttcgttttaatcatcatcatcagaagaaaaatggttgcgatatcggagatcaagtcgacggtggatgtcacggcggcgaattgtttgatgcttttatctagagttggacaagaaaacgttgacggtggcgatcaaaaacgcgttttcacatgtaaaacgtgtttgaagcagtttcattcgttccaagccttaggaggtcaccgtgcgagtcacaagaagcctaacaacgacgctttgtcgtctggattgatgaagaaggtgaaaacgtcgtcgcatccttgtcccatatgtggagtggagtttccgatgggacaagctttgggaggacacatgaggagacacaggaacgagagtggggctgctggtggcgcgttggttacacgcgctttgttgccggagcccacggtgactacgttgaagaaatctagcagtgggaagagagtggcttgtttggatctgagtctagggatggtggacaatttgaatctcaagttggagcttggaagaacagtttattgattttatttattttccttaaattttctgaatatatttgtttctctcattctttgaatttttcttaatattctagattatacatacatccgcagatttaggaaactttc

SEQ ID NO: 4111 - DNA, 1740 bp, Artificial Sequence
  P1345 (35S::G878)
gagaaacacgacacgaattttgtataattaagattacacaaaaaaaagtgttagaaagagaaatatcttcttcttttttctgtgtgagttgggtttgttaaagttttatcctttttgttctcaaaatcaagaatcgatggcggagaaggaagaaaaagaaccatcgaagttaaaatcatccaccggagtttcacggccaacgatttcactacctcctcgaccgtttggtgaaatgttttttagcggtggcgttggatttagtcctggaccaatgactctcgtctcaaatttattctctgatcctgatgagttcaagtctttctctcagcttttagctggagctatggcttctccggcggcagctgctgttgccgccgctgctgtggttgctactgctcatcatcagacacctgtgagctctgtcggtgatggcggtggaagcggtggtgatgttgacccgaggtttaagcagagtagaccaacgggattgatgataactcaaccaccggggatgtttactgtaccgccggggttaagtccggctactcttttggattctccgagcttctttggtcttttttcacctcttcagggaacatttggtatgacacatcaacaagctttagcacaagtcactgcacaagcagttcaaggcaataatgttcatatgcagcaatcacaacaatctgaatatccttcttctacacaacaacaacaacaacaacaacaacaagcttcattgactgagattccatcattttcttctgcacctaggtctcagattcgagcctcggttcaagaaacatcgcagggtcagagagagacttcggaaatatctgtctttgagcatcggtcacagcctcaaaatgctgacaaaccagctgatgatggatacaactggcggaaatatgggcagaagcaagtgaaggggagcgattttcctcggagttattacaaatgtacgcatccagcttgtcctgtcaagaagaaagtggagaggtcactcgatggacaagtaacggaaatcatctacaagggtcaacacaatcatgagcttcctcaaaagcgcggtaacaataacgggagttgtaaaagttctgatattgcaaatcagtttcaaacaagtaatagcagtctcaacaagagtaagagggaccaggaaacaagccaagttacaacaacagagcagatgtctgaagcaagtgatagcgaggaggttgggaatgcagagactagtgtgggagaaagacatgaggatgagcctgatcccaagcgaagaaatacagaagttcgggtttcagaaccagttgcttcatcgcatagaactgtgacagagcctaggattattgtccaaacgacgagtgaagttgacctcttagatgatggatataggtggcgcaagtatggtcagaaagtagtcaaaggaaatccttatccgaggagctactataagtgtacaacaccagattgcggagtaaggaaacatgtagagagagcagcaactgacccaaaagctgttgtaacaacatatgaaggtaaacataaccatgatgttccagctgctagaaccagcagccatcagttaagaccaaacaatcaacacaacacctcaacggttaacttcaatcatcaacagcctgttgcacgtttaaggcttaaagaagagcaaatcacttgacagagaagaagaatacgacggcgcttgagcttttgtgagtttaatgaatcttctttttggtt

SEQ ID NO: 4112 - DNA, 1086 bp, Artificial Sequence
  P1349 (35S::G200)
cagagagatctagaggaagagagagagagaaagatgggtaggcctccatgctgtgacaagatagggatcaagaaaggaccatggactcctgaagaagatatcattcttgtttcttacattcaagaacatggtcctggaaactggagatcagttcccaccaacactggtcattatcttttctcaacatgttttcttctagtgtctttcttttctttgtttgtatatgtgtcctgatgtttgtatcttaatttggcttttaaaagggttattgagatgcagcaaaagttgtagactgagatggacaaattatctgagacctggaattaaacgtggaaactttactcctcatgaagaaggaatgatcattcacttgcaagccttattgggtaacaagtaatctcagacaaaaggatctacatctctttatacttgaatgttttgtgtatatattttgatgatgtgaaccctaaactggcttatttgtttacatatggttgtggtaagatgggcgtccatagcttcatacctaccacaaagaacggacaatgatatcaagaactactggaacacacatttaaagaagaagctcaacaagtctgacagtgatgagaggagcagatcagagaacattgcgctgcaaacttcttcgacaagaaacaccattaatcatagatctacctatgcttcaagcaccgaaaacatttcccgccttcttgagggttggatgagagcgtctccaaagagtagtacaagtactactttcttggaacacaaaatgcagaaccggacaaacaatttcatcgatcatcacagcgatcagtttccatacgagcagcttcaaggttcttgggaagagggtcatagcaaaggaatcaacggggatgatgaccagggtataaagaattcagagaataacaacggtgatgatgttcatcatgaagatggtgatcatgaggatgatgatgatcataatgctacaccaccattgacatttattgagaaatggcttttggaggaaacaagtactactgggggtcaaatggaagagatgagccacttgatggagctctctaatatgctttaatt

SEQ ID NO: 4113 - DNA, 1380 bp, Artificial Sequence
  P1350 (35S::G979)
cctctgaggaatcaaatcactcacactccaaaaaaaaatctaaactttctcagagtttaatgaagaagcgcttaaccacttccacttgttcttcttctccatcttcctctgtttcttcttctactactacttcctctcctattcagtcggaggctccaaggcctaaacgagccaaaagggctaagaaatcttctccttctggtgataaatctcataacccgacaagccctgcttctacccgacgcagctctatctacagaggagtcactagacatagatggactgggagattcgaggctcatctttgggacaaaagctcttggaattcgattcagaacaagaaaggcaaacaagtttatctgggagcatatgacagtgaagaagcagcagcacatacgtacgatctggctgctctcaagtactggggacccgacaccatcttgaattttccggcagagacgtacacaaaggaattggaagaaatgcagagagtgacaaaggaagaatatttggcttctctccgccgccagagcagtggtttctccagaggcgtctctaaatatcgcggcgtcgctaggcatcaccacaacggaagatgggaggctcggatcggaagagtgtttgggaacaagtacttgtacctcggcacctataatacgcaggaggaagctgctgcagcatatgacatggctgcgattgagtatcgaggcgcaaacgcggttactaatttcgacattagtaattacattgaccggttaaagaagaaaggtgttttcccgttccctgtgaaccaagctaaccatcaagagggtattcttgttgaagccaaacaagaagttgaaacgagagaagcgaaggaagagcctagagaagaagtgaaacaacagtacgtggaagaaccaccgcaagaagaagaagagaaggaagaagagaaagcagagcaacaagaagcagagattgtaggatattcagaagaagcagcagtggtcaattgctgcatagactcttcaaccataatggaaatggatcgttgtggggacaacaatgagctggcttggaacttctgtatgatggatacagggttttctccgtttttgactgatcagaatctcgcgaatgagaatcccatagagtatccggagctattcaatgagttagcatttgaggacaacatcgacttcatgttcgatgatgggaagcacgagtgcttgaacttggaaaatctggattgttgcgtggtgggaagagagagcccaccctcttcttcttcaccattgtcttgcttatctactgactctgcttcatcaacaacaacaacaacaacctcggtttcttgtaactatttggtctgagagagagagctttgccttctagtttgaa

SEQ ID NO: 4114 - DNA, 1672 bp, Artificial Sequence
  P1351 (35S::G884)
gtttgttaattttggggatcgatgtcggaaaaggaagaagctccgtcgacatcgaagtccaccggagctccgtcgcgtccgactttatctcttcctccacggccgtttagtgagatgttctttaacggtggcgttggattcagtcctggtccgatgactctggtctctaatatgttccctgattccgatgagtttaggtctttctctcagcttctcgctggagccatgtcttctccagcgactgcagctgctgctgctgctgctgcgacggctagtgattaccagagacttggtgaagggactaatagctctagtggtgatgttgacccgagattcaagcaaaacagaccaaccggtttgatgatttctcaatctcaatcgccgtcgatgttcaccgtaccgcctggtttaagtccagctatgttgctcgattcaccaagctttttgggtcttttctctcccgttcagggatcatatggaatgacacatcagcaagctctagctcaagtcactgctcaagcagttcaagccaatgccaatatgcaaccacaaacagagtaccctcctccctctcaagttcaatcattttcatcgggtcaagcgcagatcccgacctcggctccactaccagctcaaagagaaacctcagatgtaaccatcatagagcacaggtcacaacagcctctaaatgttgacaaaccagctgatgatggctataactggcgaaaatatgggcaaaagcaagttaaaggtagcgagtttccacgaagctattacaagtgtactaatccaggatgtcctgtcaagaagaaggttgagagatctcttgatggacaagtaacggagattatctacaaaggtcagcacaatcatgaacctcctcaaaacactaagcgaggtaacaaagataacaccgcgaatataaatgggagttcgataaataacaatcgcgggagttctgaattgggggcatcacagtttcaaactaatagctccaacaagactaagagagagcaacatgaagcagtaagtcaagctacgacaacagagcacttgtctgaggcaagtgacggtgaagaagttggtaatggagaaactgatgtgagagagaaagatgagaatgagcctgatcccaagagaagaagtacagaagttcggatttcagaaccagctcctgctgcttcacatagaactgtgacagagcctagaattattgtccaaacgacgagtgaagttgatcttctagatgatggatataggtggcgtaaatatggacagaaagttgtcaaagggaatccttatccgaggagctactacaagtgcacaacaccaggatgtggtgtgaggaaacatgtagagagagcagcaacagatccaaaagctgtagtaacaacatatgaaggaaaacataaccatgaccttcccgctgctaaatcaagcagccatgccgctgcagcggcacagttaaggccagataatcgacctggcggtttggctaacttaaatcaacagcagcagcaacagcccgttgcgcggctaaggcttaaagaagagcaaacaacttgagagaagaaaactcttgaccgtttttcattacaaaagctttcaaattccactcacacacttgtctgaaaaatctagcagtttgcaggaaagaaacagcttcaagagg

SEQ ID NO: 4115 - DNA, 1152 bp, Artificial Sequence
  P1353 (35S::G1100)
cctcttacaagaattgtgagagtgaatgattacatccttagtttttctaaaccacaaaataaaaactttcgttcatgaaatcttatggtaagttttgagagaaatatccgagtattgcttcagtccgttgcatacgaatcaagcgagacgatggtgcagcctggaaccgagataaaagcaagcgacctaaccctactagtaatcacgattatactcttcgcaatcttcatcgttggcttggcttcggtttgcttccgctggacctctcgccaattttactcacaagaatccatcaaccctttcactgactccgacgttgaatcccgtacgagtattacggcggtgcgtgggctcgacgaggctatcatcaactcatttccgacgtttctctactcggaggtgaaggagcggagaatcgggataggtggcgtcgagtgtgcagtgtgtatctgtgagttcgaagaccatgaaacgctccgtttgatgcctgaatgctgccacgtgtttcatgctgattgtgtaagtgtctggctctctgatcactccacgtgtccactctgtcgtgtggatctttgcttacaaccgggtgagagaagctacttgaatccggaaccggatcttgtagaatctacaaactcgcatttgtttgatggtgtgacgtggaccaataggaacagaccgtctcggtcatggtcaacgagattgtctcaatgtcgagtctcccagatattaatctcgagatcgcattcgaccggacattctgtggttcaaccgctagataatttagaccggtttacgcttcggttaccagaagaagtccggaggcaactgacgaaaaaaacggtggacaacgtggcattttctcaggctaggagctcacggcgtggttacagaagcagaagtgccggaagcgagaggagtgtcttctcgtaccaacggcggatgcattccttctctgattgtgcatggtccacctcctgtggcggagaagcggtggctccgtcaaaggattcccgccgaatatcagttgaacaatcccagctagatgatcgagtgtagtagataggcaattttcttggtgtgtgttttttgctaacaacatttgtgtttgtctgtttgtctgtttgctatcatttgcttttcgaacatgac

SEQ ID NO: 4116 - DNA, 624 bp, Artificial Sequence
  P1354 (35S::G377)
ctttcaaagactctcagtttctatctctgtgaatataatcttagttataaaaaaatgggtctctcgcattttccaacagcgtcagaaggagtactaccacttctggtgatgaacacggttgtttcaatcactctgttgaagaacatggtgaggtctgtttttcaaattgttgcatccgagactgaatcttccatggagatagacgacgagcctgaagatgattttgttactagaagaatctcgataacacagttcaagtctctatgtgagaacatagaagaggaagaagaagagaaaggtgtggagtgttgtgtgtgcctttgtgggtttaaagaggaagaggaagtgagtgagttggtttcttgcaagcatttcttccacagagcttgtctagacaactggtttggtaataaccacaccacatgccctctttgcaggtccattctctagtggtggaatcttgttttacactttccttttgttttgctttgctataggaaaataccacattctctatcctctgttttaccctttttggtgtttatgtttttccccttcttttttcttggtatggagaaggggttttttcataataaaggactatacaattgatgtgtgtgaatg

SEQ ID NO: 4117 - DNA, 1280 bp, Artificial Sequence
  P1355 (35S::G1095)
ctactgaatatttcccttcaaatcctagagggagcttttcatttagattgttttgtagtcaaatggatctaacagaccgtcgtaacccttttaacaatcttgtttttccgccgccgcctccgccgccatccacgaccttcacaagccctatattcccacgaacaagctcttccggcaccaatttccccattctggccatcgcagtgattggaatcttagccactgcgttcttacttgtaagttactacatcttcgtgatcaaatgctgtcttaattggcaccaaatcgacatctttcgccgccgcagacgaagcagtgaccaaaaccctctaatgatttactctcctcatgaggtaaacagaggactagacgaatccgccattagagctatcccagtcttcaaattcaagaagagagacgttgttgcaggagaagaagatcagagtaagaactctcaagaatgctctgtttgtttaaacgagtttcaagaagacgagaagctaaggattattcctaactgctgccacgtgtttcacattgattgcattgatatctggcttcagggcaacgcaaattgtcccttgtgcagaaccagcgtttcttgcgaagcaagtttcactcttgacctaatctctgcaccgagctctcctcgggagaatagccctcattctcggaacaggaatctcgaacccggcctggttctaggaggcgatgatgacttcgtcgtcatagagcttggggccagtaatggtaacaacagagaaagcgtgagaaacatagacttccttacggagcaagaaagggttacctcgaatgaggtctcgaccggaaacagcccgaaatcggtgagtcctttgcctataaagtttggtaatcggggaatgtataagaaagaaaggaaatttcacaaagtgacgagtatgggagacgaatgtatcgatactagaggcaaagatggtcattttggtgaaattcagcccataagaagatcgatctcgatggattcatcagtggatcgtcagctgtacttggcggtccaagaggaaatcagccggagaaacaggcagattccggtagctggagacggtgaagatagtagcagtagtggtggtggtaatagcagagtcatgaagagatgtttcttctcttttggaagtagtagaacttcaaaaagttcttcaatattacctgtttatttggaaccctaattctgtattttcctcttcttgattcattgttcaaaaaaattattttttgtatttgttatttgctgaggtgaa

SEQ ID NO: 4118 - DNA, 2596 bp, Artificial Sequence
  P1359 (35S::G760)
cagatatctgattatctcttgtatttcttctactcgatttgctcccataaaaacccttactttcttcaagttctggttttcaccgattgatgggtcgtggctcagtgacgtcgcttgctcctgggttccgttttcacccgacggatgaggaacttgttcgctactaccttaagcgtaaggtctgcaacaaaccctttaagttcgatgctatttccgtcaccgacatatacaagtctgagccttgggatctaccaggttacaactttttctctcaatctctcttttttgttgtctagttagatcgaattatggagcttgattatgaatgatctagaattctgattgattcgattgattttgtgtgtgtatagataagtcgaagctgaaaagtagagacttggaatggtacttctttagtatgctggataagaagtacagtaatggttccaagacgaatcgtgctacggagaaagggtattggaagacgactgggaaagatcgggagattcgtaatggttcaagagtcgttgggatgaagaagacacttgtttatcacaagggtcgagctcctcgtggtgaaaggaccaattgggttatgcatgagtatcggctttctgatgaggacttgaagaaagctggtgtgccacaagtaagttttgagcaattgggtttgttttgttttccatttttgatctgaaagttgttttcttttgtgtctatggagagttattgactttgttgagtctttttggtggttggtggagaaggaagcatatgtgttatgtaggatattccagaaaagtggtacgggtcctaagaatggggagcagtatggtgctccttatcttgaggaggagtgggaagaagatggaatgacttatgtacctgctcaagatgctttcagtgaaggattggctttgaatgatgatgtttatgtcgatattgatgacattgacgaggtagcctacctttttcttcaaccgttccagaaattatttctctttgtgattagtgtgtagtgtaaaagtgattagttatatggttagaaagatggcttggaatatcgcaaatgcgaaagagtgataaatgcagtgttttcgtgttagcaagccttgggtgccttttgcttatgtgctggaatagtatacctgtttaggtttaagatgagtgatggatgttagttagctttaggtcttggcatattgatgatgatatagatctttacatcttctgatggtttggattcattcatgacatgtcttttatgttagcgtctgaatatgatttccttttgcagaagcccgaaaatctggtggtctatgatgccgttcctattctacctaactattgtcatggggaatcaagtaacaatgttgaatcaggcaattactcagactctggaaattacattcaaccaggaaacaatgttgtcgactctggtgggtactttgaacaaccaattgaaacttttgaggaagatcggaagcctattatacgggagggtagcattcagccttgttctctgtttccagaggaacaaattggctgtggtgtgcaagacgaaaatgtggtgaatctggaatcttccaacaataatgtgtttgtagctgatacatgctacagtgacattcctattgatcataactatttacccgatgagccattcatggatcctaataacaatcttccactcaacgatggtctgtacctggaaacgaatgatctcagctgtgctcaacaagatgattttaacttcgaagattatctcagcttctttgatgatgagggtttgacttttgacgattctctattaatgggacctgaagattttcttcccaaccaagaagcccttgaccagaaagtaagacccgttcttccaacgtgcttagtttatatatatgtgaaaaacttctgtttaactcacctttacatcaacagcctgcccctaaagaattggagaaggaggtcgcaggaggcaaagaggcagtggaggaaaaggaaagtggcgaaggatcttcttcaaaacaagatacagatttcaaggactttgattcaggtaacactcagatgttcatggaattccttttaaaacaagtcatatgatgactgattctgactcttttgaatctaaatcatgtagctccgaagtacccatttctcaaaaagacgagccacatgcttggagccattcctactccatcttcatttgcttcacagttccaaacaaaggacgcaatgcgtctacacgcagcacaatcttctggttcagttcacgtgactgcaggtatgatgagaatatcaaacatgactctagcagcggacagcggtatgggctggtcatatgacaagaacggtaacctcaacgtagtcctttcattcggggtagtccaacaggatgatgcgatgactgcctcgggaagcaagacaggaattacggcgacaagagctatgttagtcttcatgtgtttatgggttctcctactctctgttagcttcaaaatagtaaccatggtgtctgctcggtaataggatcaaagttgaatcgtctcaaagactttttttggtgtttgtacctctccaatcatatagcctttaa

SEQ ID NO: 4119 - DNA, 1023 bp, Artificial Sequence
  P1361 (35S::G1425)
aatattctccgatcatcattttaatggagagtacagattcttccggtggtcctccgccgccgcaaccaaacctccctccaggattccggtttcatccaacagacgaagaacttgtaattcattacctcaaacgcaaagcagattctgttcctttaccagtcgcgatcatcgccgacgttgatctttacaaatttgatccatgggaacttcccgcgaaagcttcgtttggagaacaagaatggtattttttcagtccaagagatcggaaatatcccaacggagctagacctaaccgagctgcgacttccggttattggaaagcgactggtacagataaaccggtgatttcaaccggcggtggtggtagtaaaaaagtgggagttaaaaaggctctagtgttttacagtggtaaaccaccaaaaggagttaaatcagattggattatgcatgaatatcggttaactgataataaacctactcacatttgtgacttcggcaacaagaaaaactctctcaggcttgatgattgggtgttgtgtcgtatctacaagaaaaacaatagtacagcatctagacatcatcatcatcttcatcatattcatctagataatgatcatcatcgtcatgatatgatgattgatgatgatcgattccgtcatgttcctcctggtcttcacttcccggcgattttttctgacaataatgatccgacggctatatatgatggtggcggcggcggatacggaggtggaagttactcgatgaatcattgtttcgcatctggatcaaagcaggagcagttgtttccaccggtgatgatgatgactagtctaaatcaagattccggtattggatcgtcgtcgtcacctagcaagagatttaacggcggcggcgttggagattgttcgacttctatggcggcgacgccgttaatgcagaaccaaggtgggatttaccaattgcctggtttgaattggtattcttgaaaacaatttacgatgaagaatttttaaaatttgtgta

SEQ ID NO: 4120 - DNA, 1272 bp, Artificial Sequence
  P1364 (35S::G561)
cttttgtgggttcaattcgaattgttttccctgagactcaagttactgtgtcattactctgcattgagcaatgggtagcaacgaagaaggaaaccccactaacaactctgataagccatcgcaagctgctgctcctgagcagagtaatgttcatgtgtatcatcatgactgggctgctatgcaggcatattatgggcctagagttggtatacctcaatattacaactcaaatttggcgcctggtcatgctccaccgccttatatgtgggcgtctccatcgccaatgatggctccttatggagcaccatatccaccattttgccctcctggtggagtttatgctcatcctggtgttcaaatgggctcacaaccacaaggtcctgtttctcaatcagcatctggagttacaacccctttgaccattgatgcaccagctaattcagctggaaactcagatcatgggttcatgaaaaagctgaaagagttcgatggacttgcaatgtcaataagcaataacaaagttgggagtgctgaacatagcagcagtgaacataggagttctcagagctccgagaatgatggctctagcaatggtagtgatggtaatacaactgggggagaacaatctaggaggaaaagaaggcaacaaagatcaccaagcactggtgaaagaccctcatctcaaaacagtctgcctcttagaggtgaaaatgagaaacccgatgtgactatggggactcctgttatgcccacagcaatgagtttccaaaactctgctggcatgaacggtgtgccacagccatggaatgaaaaagaggttaaacgagagaagagaaaacagtcaaaccgagaatctgctaggaggtcaagactgaggaagcaggctgaaacagaacaactatctgtcaaagttgacgcattagtagctgagaacatgtctctgaggtctaaactaggccagctaaacaatgagtctgagaaactacggctggagaacgaagctatattggatcaactgaaagcgcaagcaacagggaaaacagagaacctgatctctcgagttgataagaacaactctgtatcaggtagcaaaactgtgcagcatcaactgttaaatgcaagtccgataaccgatcctgtcgcggctagctgaccgtggccgcaacaatgagaacccgatatttcttcctttgggttgtgattgtaacttaaaaggagactttttgtttttattcttagatttgtagctctctgcatagtgagcataaattg

SEQ ID NO: 4121 - DNA, 1272 bp, Artificial Sequence
  P1365 (35S::G565)
cgacagataacagagggcgcgaaacagagagaaaataagaagaagaaggacgatccagatatggaggatccttctaacccacgaccaaaccagagcaatctctcgcaatgcccgcctttagccacagctccgacacctgcgccagttcgtggtccgtaccaccggagagcacattcggaggtccaattccgtctccctgaagatctggatctctctgaaccattcggaggattcgatgagcttggatccgaagatgatctcttttgctcatacatggacattgagaaacttggatccggatccggatccgcatccgattcggctggtccttctgctcctaggtctgataacccgttttccgctgagaatggaggtgcggaggctgggaattcgggacctcgacacaggcatagcctctccgttgatggctcttcgactttggagtcaattgaggctaagaaagctatggctcctgataagctcgctgagctttgggtcgtcgaccctaaaagagctaaaaggataattgctaatcgacagtctgctgctcgttcgaaagagaggaaggctcggtatatcttggagctcgagaggaaagttcagaccttgcaaactgaagctactaccctttcagcacagttgtctttgttccagagagacacaactggtttgtcatctgagaatacagagctcaagcttcgtttacaggtcatggaacaacaagctaagttgcgagatgcactgaacgagcaactgaaaaaggaagttgagaggctgaaattcgccacgggagaagtctcacccgcggatgcttataacctcggaatggcacacatgcaatatcagcaacaaccacaacaatccttctttcaacatcatcatcagcaacaaaccgatgctcaaaacctgcaacaaatgactcatcagtttcatctcttccagcctaacaacaaccagaaccaatcttctcgcacaaaccctcccaccgctcatcagcttatgcatcacgctacttctaatgccccggctcaatctcattcctattcagaggcaatgcatgaagaccatcttggccggttacaggggcttgacattagcagctgtggcagaggctcaaactttggtaggtctgacaccgtcagtgaaagcagcagcactatgtgaggctgcctttcccagattcccctttgtcgataaacctattctttcgccctcccttgaaatctttagctaaaaagtaatatcttcgtgacagtcggattcagcggccgc

SEQ ID NO: 4122 - DNA, 1740 bp, Artificial Sequence
  P1369 (35S::G1050)
ttccccatttcagaaaatcaaaatgggtggtggtggtgatacaacagataccaatatgatgcagagagttaattcttcttctggtacatcgtcttcttcgatccctaaacacaatcttcacttgaatcctgctcttatccgctctcaccatcacttccgtcaccctttcaccggagctcctccaccgccgattccacccatttctccttactctcagatcccggcgactttacaacctagacattctcgctctatgtcgcaaccgtcttctttcttctcctttgattcattgccgccgttaaatccttctgctccgtcggtttcggtgtcggtggaggagaaaaccggtgccggatttagtccttcgttgcctccgtcaccgtttacgatgtgtcattcttctagctctaggaacgccggagatggagagaatctacctccgagaaagtcgcataggcgttcgaatagtgatgttacttttgggtttagttcaatgatgtctcagaatcaaaagtctcctcctttgagttctttggagagatcgatctctggtgaagatacatcagattggtctaatttggtgaagaaagaaccgagagaaggcttctacaagggaagaaaaccagaggttgaagcagctatggacgatgttttcacggcttatatgaatcttgataacattgatgtcttgaattcttttggaggtgaagatggcaagaatgggaatgagaatgtggaggagatggagagtagtagaggtagtggtacaaagaagacgaatggtggaagtagtagtgattctgaaggagatagcagtgcgagtgggaatgtgaaggttgcgttgagttcttcttcttcaggcgtgaagagaagagcaggtggagatattgctcctactggtagacattacaggagtgtttctatggacagttgtttcatggggaagttgaatttcggcgacgaatcatcgctaaagcttccgccttcttcatcagctaaagtttccccaaccaattcaggtgaagggaattcaagtgcttatagtgttgaatttggaaacagtgagtttactgcagctgaaatgaagaagattgcagctgatgagaaactcgctgagattgtaatggctgaccctaagcgtgttaaaagaatcttggcgaaccgcgtatctgctgcacgttcaaaggagcggaagacgcgatacatggcagagttggaacacaaggtgcagacacttcagactgaagctactacattatcggctcagctcacacatttgcagagagattctatggggttgacaaaccagaacagtgagctgaagtttcgtcttcaagctatggagcagcaagcacaactccgcgatgctctgtcagagaaactgaatgaagaagtccagcggttgaaactggtgataggggagccgaaccgcaggcaaagtgggagcagcagcagcgaatcaaagatgtcactaaacccggagatgtttcagcagcttagcataagtcagttacaacaccaacagatgcagcattccaatcagtgtagcacaatgaaagcaaagcacacttcaaacgactagggtaagtaaaactgcgatccgcagttgtctagttacatatatgataagaatcttttgtgcagagttctgtttttggaagttttaaagaaacatatataaagattatgtccgggaaatttgatcatatttcctgaaacatacacacatatatatagtgg

SEQ ID NO: 4123 - DNA, 1125 bp, Artificial Sequence
  P1370 (35S::G1052)
ctttcctttgtttttcatttgacctcttacaaaaaaatctggtgtgccattaaatctttattaatggcacaacttcctccgaaaatcccaaccatgacgacgccaaattggcctgacttctcctcccagaaactcccttccatagccgcaacggcggcagccgcagcaaccgctggacctcaacaacaaaacccttcatggatggatgagtttctcgacttctcagcgactcgccgtgggactcaccgtcgttctataagcgactccattgctttccttgaaccaccttcctccggcgtcggaaaccaccacttcgataggtttgacgacgagcaattcatgtccatgttcaacgacgacgtacacaacaataaccacaatcatcatcatcatcacagcatcaacggcaatgtgggtcccacgcgttcatcctccaacacctccacgccgtccgatcataatagccttagcgacgacgacaacaacaaagaagcaccaccgtccgatcatgatcatcacatggacaataatgtagccaatcaaaacaacgccgccggtaacaattacaacgaatcagacgaggtccaaagccagtgcaagacggagccacaagatggtccgtcggcgaatcaaaactccggtggaagctccggtaatcgtattcacgaccctaaaagggtaaaaagaattttagcaaataggcaatcagcacagagatcaagggtgaggaaattgcaatacatatcagagcttgaaaggagcgttacttcattgcagactgaagtgtcagtgttatcgccaagagttgcgtttttggatcatcagcgattgcttctcaacgtcgacaatagtgctatcaagcaacgaatcgcagctttagcacaagataagattttcaaagacgctcatcaagaagcattgaagagagaaatagagagacttcgacaagtatatcatcaacaaagcctcaagaagatggagaataatgtctccgatcaatctccggccgatatcaaaccgtccgttgagaaggaacagctcctcaatgtctaaagctgttcgttcactaagatctttcttttcatggcgaaaagattcttgactataaaacctctttgtgtcaag

SEQ ID NO: 4124 - DNA, 4715 bp, Artificial Sequence
  P1372 (35S::G1146)
tggagaaaaagagtttttgaaaatccaaacaacaaaaaatgccgattaggcaaatgaaagatagctctgagactcacttagttatcaaaacccaacctttaaagcaccacaatccaaaaaccgttcaaaacggtaaaatccctcctccttctccttctccggtgacggtgactactccggcgacggttactcagagtcaagcttcttcaccttcaccaccgtcaaagaatcgtagccggaggagaaaccgtggtggaagaaaatctgatcaaggagatgtttgtatgagacctagctctcgtcctcgtaaaccgccaccgccaagtcaaaccacttcctccgccgtctccgtcgccaccgccggtgagattgtcgctgtgaatcatcagatgcagatgggtgttcgtaaaaactcaaactttgctccaagacctggatttggaacacttggaactaaatgcattgttaaagctaaccactttctcgctgatttgcctaccaaggatttgaatcagtatgatgtaagtttttattagaaaaagttaagattttttttgccttttttttagtttttgctgtaatgagaaacaaagcttgaacctttagatggtttcctgaaaaaaggtttgaaatttaatgaaggagagagagttagattttaatgttgttcttattgcttatttgggtccattgacatttggttaatgttttgcaggttacaattactcctgaagtgtcatcaaagagtgttaacagagctataattgctgagttagttagactttacaaagagtctgatctcgggaggagacttccggcttacgatggccggaaaagtctttacactgctggagaacttccttttacttggaaggagttcagtgttaagattgttgatgaagatgacggtatcatcaatggccctaagtaagtgtctaaggttctttaggtgattgattttgttatgtgtagttttatattgaaattgacacattttgctttgtagaagggagagatcatataaggtggcaatcaagtttgttgcacgggcaaatatgcatcacttaggcgagtttctagctggtaaacgggcagattgtccgcaagaggcggtgcagattcttgatattgtactcagggagttgtcggttaagaggttttgtcccgttggaagatctttcttttcgcctgatattaaaacaccgcagcgactcggtgaagggttagagtcatggtgtgggttttaccagagtattagaccaactcaaatgggtttatcactaaatatcggtaaagatttgacttaagagattgttacagttttggttttattttataagtcagcccaatcttaatgttattctccttactttgtagatatggcttcagctgcattcatcgagcctcttccagtgatagagtttgtagcacagcttcttggaaaggatgtcttgtcgaagccattgtcggattctgatcgcgtcaaggtacacaagtctcttcatcttattatatcttgtctcaagtccttgattgtttcctcaagaatgttttttttcttgggaatttttaacagattaagaagggtcttagaggagtgaaagtagaggttactcacagagcgaatgtaagaaggaaataccgtgttgcgggtttaacaactcaaccaacaagagagctaatgtgagtattttctttttacttactctttgattactaaggcttgtttcattgagattaatttctggtttatattcttaggtttccagtagatgagaactgtactatgaagtcagttattgagtatttccaagagatgtatggattcacgatccagcacacgcatttgccatgtctccaagttggaaaccaaaagaaggcaagctatttgccgatggaggtaaaccgtaaactgctggtttgtttgtttcaagacttcacatttcagctcttggctattttcgctgattcaatttccaatgtaggcatgcaaaattgtcgagggacaacggtacacgaaaaggttgaatgagaagcagattactgctctcttgaaagttacatgccaaaggccgagggacagagaaaacgatattttgcgggtatttttttagtcatgtatcttatatggttctttgtgagttagaacttagaagtgaggattaatcttgttgtcaaaaatgttttatagactgtccaacacaacgcatatgatcaagatccatatgcaaaggagtttggcatgaacataagcgaaaagttagcttctgttgaagctcgtattcttccagctccatgggtaaaaaacctaaacagatctctgaatgctcatactatgagaatactgttatgttaattcgtctctctttgcttgctacagcttaagtatcacgagaacgggaaagaaaaagattgtctcccgcaagttggtcagtggaatatgatgaacaagaaaatgatcaacgggatgactgtgagcagatgggcctgtgttaacttctcacgcagcgttcaagaaaacgttgctcgtggattttgtaatgaacttggtcagatgtgtgaagtctcaggcatggtaataatattcatctttttttcttttcttgttgcattgtttgaattctcttttaactcgatgtgattcttatcagaaagctttgcttcgtttatcattgtaggagtttaatccagaacccgtgataccaatatatagtgcgaggcccgatcaagtcgagaaagctctaaagcatgtttatcacacttcaatgaacaaaaccaaaggcaaagagttagagcttctgctggcaatattacctgataacaacggttcactttatggtattatttcgacatccataaacttaacccttttgccttctttagtaatggttttgatgaaaacgaaatgtttcttgtaatctcaggtgatcttaagagaatctgtgaaaccgagcttggtttgatatctcaatgttgtctcacaaaacatgtgttcaagattagcaaacagtatctggcaaatgtatcccttaaaatcaacgtaaaggtgaatagtttttactgctgtatcgaagattttcgattgtttttagtattatgaatctcagatctttctatgtttggtttcagatgggaggaaggaacacagttctagtagacgccataagctgtagaataccactggttagcgatataccgacaatcatttttggcgcagacgtgactcacccagagaacggggaagagtcaagcccttcaatcgctgctgtaaggattatacacttttatcaagtagtggagcatcgaaattcattatactcagtttttttcttttgttttctttaggttgttgcttctcaagactggcctgaagtgacaaaatatgcgggtttagtttgtgctcaagctcacaggcaagaacttatacaagatttgtataaaacatggcaagatcctgttcgcggtactgttagtggcggtatgatcaggtaataactcgcaatatttcggtttttgtagtttgattttatcggtgtatctcaaggtttttttgcttgctttctacagggaccttcttatctcatttagaaaagcaacagggcaaaaaccgcttcgaattatcttttatcggtaagtctctctttgctcatttaagtaaaagaattatatctaaaacccacaattagttctcatggttgttttattcgcgcagtgatggagtaagcgaagggcaattctatcaagttttactctatgagttggatgcaattcgaaaggtaaaaacttttgtgcatagcatgaaatgaatccgccacaaagttagcaaaacattttacataatcggaaacgggtttgtgtttgtttaggcttgtgcatcgcttgaaccgaattatcagccaccggtgacattcatagttgtacagaagcgtcaccacactcgtttgtttgctaataatcaccgagacaaaaacagtactgaccgaagcggaaatatcttaccaggttagttattaaaaacggttgaaagaagatcataacagaaataattaactaactaactaactgcttctttgccaccttttgtttcaggtactgtagttgacactaaaatatgtcatccaactgaattcgacttctacctttgtagccatgcgggtattcaggtacgaaacaactatcgaaatatccgttaatatgaccttttccgtaactatacagataaaatgacactgtttgtgtttgttgtatgatctagggaacaagcaggcctgcacattaccatgttctttgggacgagaacaatttcacagcagatggtattcaatctctgactaacaatctctgttatacctatgcgcggtgcactcggtcggtctctataggtaaataacaacatttcttcttcttcttcgtgtacccgcaaatatgacgaaaatcagcaaactcatatgttcttttattttctgatgttgtacagttcctccagcgtattatgctcatcttgcagcatttcgagcacgtttctacctggaaccggagataatgcaagacaacggatcaccgggtaaaaagaacacgaaaacaacaactgtcggagacgtaggtgtgaagcctttaccagccttgaaggagaatgtgaagagagtaatgttctactgctaaaaatccaaacattccttaatcagttttaataagtagtttggttgtttgcttgt

SEQ ID NO: 4125 - DNA, 877 bp, Artificial Sequence
  P1374 (35S::G634)
cggagctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaacagcaactacaacaacaagaatcaatgataggtgagtatgaaaaag

SEQ ID NO: 4126 - DNA, 626 bp, Artificial Sequence
  P1376 (35S::G1839)
gtttccattcattggctataaaaaccatgctcactcccttttgttcttcacaccatttgcaggaaaaaatgaatagttgtcagtctaatcccaccaaaatggataattcagaaaatgttctatttaatgatcaaaacgaaaatttcacacttgttgcaccacacccttcttcttcgtacttgacaagagatcaagagcacgagatcatggtctctgctctgcgacaagtgatatctaactccggagctgacgacgcgtcatcatcaaacttgatcatcacaagcgttccgcctccagacgctggcccttgtcctctctgtggcgtcgccggttgctacggctgcacattacaacggccgcaccgagaggtaaagaaggagaagaaatacaaaggagtaaggaaaaaaccatcgggtaaatgggcggcggagatatgggatccgagatcgaaatcaaggaggtggcttggaacgtttcttacggcggagatggcggcacaatcttacaatgatgcggcggctgagtatcgagcaagacgtggtaaaacaaacggagaaggaattaaacggcggtggagatgactgagaaggacatggtcggtgatcatacacggcgaggtggaaatg

SEQ ID NO: 4127 - DNA, 1031 bp, Artificial Sequence; identical to SEQ ID NO: 1141
  P1377 (35S::G1756)

SEQ ID NO: 4128 - DNA, 827 bp, Artificial Sequence
  P1379 (35S::G32)
cataaaggtatagtatcattattagaaagatgaacacaacatcatcaaagagcaagaagaagcaagacgatcaggttggtacaaggtttcttggggtgagaagaaggccttggggaagatacgcagctgagattagagacccaactacgaaggagcgtcactggcttggcactttcgatacggcggaagaagctgccttggcctacgatagagctgctcggtccatgcgtggcacacgtgccagaaccaactttgtttactcagacatgcctccttcctcatccgtcacctccattgtttctcctgacgatcctcctcctcctccacctcctcctgctcctcctagcaatgatcctgtcgattacatgatgatgtttaaccaatactcatccactgactcgccaatgcttcagcctcattgtgatcaagtggacagttacatgtttggtggctctcaatcttcgaattcttattgctattctaatgacagtagtaatgagctgcctcctctcccgagcgacttgtcgaattcgtgttatagccaaccacagtggacctggaccggtgacgactactcgtctgagtacgtacatagtccaatgttcagcagaatgcctccggtttctgactctttccctcaaggtttcaactactttggctcctaattctttctcatcgtccatatttaataccttcctcatttgtaccttttccttcttcttcttttttgggtttatctatgtttcgccgtccttgatctctgcctatgtgatcaaagtgactgtttgtcattagtttttcaataacaagttatcatttgtatcttg

SEQ ID NO: 4129 - DNA, 2018 bp, Artificial Sequence
  P1383 (35S::G1202)
ccaaagaaagtttttgctttcaccggccagtcatgggaaactatcggtggccgtcaaagctatcaaagttatcactcagagcaaaacaaacgaatctgtaccgcgtcattctaatcgcgatcctctgcgtcaccttttacttcgtcggagtatggcaacactccggcagaggaatctcacgctcttccatttctaaccacgagctcacgtccgtgccctgcacgtttcctcaccaaaccacaccgattctcaacttcgcctcccgtcacacagcccctgaccttcctccgacgataacggacgcgcgtgttgttcaaatcccgtcgtgcggcgttgaattctcggagtacacgccctgcgagttcgtgaatcggtctttgaatttcccaagagagaggcttatatacagagagagacactgtccggaaaaacacgagatagtcaggtgtcggattccagcgccgtacggttacagtttaccttttcggtggccggagagccgtgacgtggcgtggtttgctaacgtgccgcatacggaactaacggtggagaagaagaatcagaactgggtaaggtatgagaaggataggtttttatttcctggtggtggtacgatgtttccacgtggagctgatgcttacatcgacgagatcggacggttgataaatctcaaagatggatcaattcggacagccattgatactggatgtggggtagcgagctttggggcgtatctaatgtcgaggaacatagtaacgatgtcgtttgcaccaagagacacacacgaagctcaggttcagttcgcacttgagagaggagtccctgccatcataggagtgttagcctctattaggctcccatttccggccagagccttcgacattgctcattgctctcgatgtctcattccttggggccaatacaacgggacgtatctcatagaagtggatagggtactgagaccgggggggtattggattttgtcgggaccgccgattaactggcagagacactggaagggttgggaaagaactagagacgatctcaactcggagcagtctcagatcgagagggtggctaggagcttgtgttggaggaaattggtgcagagagaggatcttgcggtttggcagaaacctaccaaccatgttcactgtaagcgcaatcggatagctttaggacgccctccgttctgccaccggacactacccaaccagggctggtacactaagcttgaaacctgtttgacgccgttgccggaagtaacaggatctgagatcaaagaagtagcgggtggacagttggcgagatggcctgagagattgaatgctcttcctccgaggatcaaaagtggaagcttggaagggatcactgaggatgaatttgtcagcaacacagagaaatggcagagaagagtgtcttactacaagaaatatgaccaacagctagcggagacgggaagatacagaaactttctcgacatgaacgctcatcttggaggtttcgcctcagccttagtcgatgatcctgtatgggtcatgaatgttgtccccgtggaggccagtgttaacacccttggagttatctatgagcgaggattgattggaacgtatcaaaactggtgtgaagcaatgtcaacttacccaaggacatacgatttcatccatgccgattcggtgttcagtctgtacaaagacagatgtgacatggaagatatcttgctagaaatggacaggattctaagaccaaagggaagcgtgatcatcagagacgacattgatgtgctaaccaaagtgaagaagattacagatgcgatgcaatgggaagggaggataggagatcatgaaaacggacctcttgaaagagagaagattttgtttcttgtgaaggagtactggaccgcacctgcgcctgatcagtcatcagatccttgatcaagcttggaataattcataaaatttgtagctccattcttttttcttcaaatgttttgtacacactaatcgactttgggggaa

SEQ ID NO: 4130 - DNA, 2711 bp, Artificial Sequence
  P1384 (35S::G1289)
tacctgaaacgcgtctcgtaacactgatctctaatgatcttcgtctccaatggcgatatcagtacaacacgtcgtcgttttactcctctccactctcctcatcgccatcaccttcttcctcttcacctccgataacgccagattccctttcccttctctctccaccaccgattactacacaccaatcccaaaatctccaattcctcaccgaatcgtcgacgtttcttcagatcaaactccacagaagatgaagctaaacacttccctcgaggtgggagagctgaaatgggatctatgtaaaggtgcagaatctgttgattacataccttgtcttgataattacgctgccatcaagcagctcaaatcaaggagacatatggagcatcgagaacgtcattgccctgaaccaagtcctaaatgtctccttcccttgcctgataattataagccgccggttccgtggcctaagagccgggatatggtgagagacagttcctgtttttgtttttggtaagatttggttgctgctcttgatcagcttgatctgaagatacatgatttagtttagtgacccattttagtatgtgaaagtaaaggagaaagatccgttctttagagtctgatagattcaaagtttacatttttagagtattataggtggtttactctataatgtgcagatttggtatgacaatgttcctcatcccaagcttgttgaatacaagaaggaacaaaattgggttaaaaaagagggtgaatttctagtttttcctggaggaggtactcaattcaaattcggggttactcattacgttgagttcatcgaaaaggtcagcactttcttagctctgtttcccctgtttttcttgaatagaaagcatctatctttgtgttgaaatcatttcatattcacaggcgttaccgagtatcaaatgggggaaaaacataagggttgtattagatgttggttgtggtgttgctagctttggcggatctttattagataaagatgtcattacaatgtcgtttgctcctaaagatgaacatgaagctcagattcaatttgcgttagaacgaggaatacctgcaacactttctgttattggaacacaacagctcacgtttccgagcaatgcatttgatcttatacattgtgcacggtgcagagtccattgggatgctgatggtatttcttttgttccattctttttcctcttagcccatttgcttcaaggttccaatgatcattatggtttaatttgttaggtgggaaaccgttgttggagctcaatagggtacttaggccaggaggtttcttcatatggtctgcaacaccagtctatcgagataatgacagagatagcagaatttggaatggttcgcaacaatcatgttttttttatttgatcattcaacactgatgttgatctctatggttttaactgttacaattctgttttgcagaaatggtttctcttactaaatccatttgctggaaggtcgtgacaaagacggttgattcctctggaatcggacttgtgatctatcaaaagccaacatcagaatcctgttataataaacgcagcacacaagatccaccactttgtgataaaaaggaagcaaatggttcatggtaaaaaaactattacacaaaatgatgctttacattcacatataagtaatgtccactattttttgtaacatttccttctgattaattttaggtatgttcctctcgctaaatgcctttccaagttacctagtggaaatgtccagagttggcctgaactatggcctaaacggcttgtgagtgttaaaccgcaaagcatttcagttaaagcggaaacattgaagaaagatacagagaaatggtcagcaagtgtttctgatgtttacctcaaacatctagctgtaaactggtcgactgtgcggaatgtgatggacatgaatgctggttttggcgggtacatttacaatctctgaaactttaaccagaatccggtttatcccaaactgaaacttgacacaagtttttcttcttttcttctttttggtatagttttgctgctgcacttataaatctaccactctgggtgatgaatgttgtccctgtggataaacctgacactctctccgtcgtttatgatcgaggcttgatcggagtttaccatgattggtgtgagtccgtcaacacttaccctagaacatacgatctgttacattccagtttcctcctaggtgatctcacacaaaggtaaacaacagatctgagtttgtatatctatagagtttcagttctttagcagtagccagtaggcattcactgttttggttcggttcacggttagcttaaccaaagtcggagttgtcataccaaactcggtttgatattgcgaatagtgtggttaacctttaatatgtgttttttgggtcaatttcaggtgtgagattgtacaagtggtagctgagatagatcggatagtgagaccaggtggatatcttgtggtacaagacaacatggaaacaataatgaagcttgaatccatacttggttcgcttcattggtcaaccaaaatatacgaggaccggtttttggttggtcggaagggattttggcgtcccgctaaaccggagctcagatagacagaacgagagacataaacatactagcaaagtaaatttgtacactactatcaatgacgcaaccagat

SEQ ID NO: 4131 - DNA, 952 bp, Artificial Sequence; identical to SEQ ID NO: 1239
  P1387 (35S::G1865)

SEQ ID NO: 4132 - DNA, 1774 bp, Artificial Sequence; identical to SEQ ID NO: 1241
  P1388 (35S::G1868)

SEQ ID NO: 4133 - DNA, 1055 bp, Artificial Sequence
  P1393 (35S::G1226)
cagaaaacagttccattagagagactcataaagcttctcatctaattatgagtggattgatgagttttggtgaattagaagaccaatttggtcagatttcagacactactatggaagagaagataccatttctgcaaatgcttcaatgcatagaacacccttttacaacaacagaaccaaatcagtttctccaatcacttctccagatccaaaccctagaatcaaagagctgtctcacccttgaaacaaacatcaaaagagatccgggtcaaacagatgacccggaaaaggatccaagaacagaaaacggagcagtaacggtcaaagaaaaaagaaaacggaaacgtacaagagctccaaagaacaaagacgaagttgaaaaccaaaggatgactcacattgccgtcgaacgtaatcgaagacgacaaatgaacgaacacttaaactctctccgatctctcatgcctccttcgtttcttcaacggggtgaccaagcttcgattgtaggaggggcaatagatttcatcaaggaactagagcaactcttgcaatctctagaagctgagaaacgaaaggatggaactgatgaaactcctaaaacggcgtcgtgttcttcatcttcgtctcttgcatgcactaactcttctatttctagcgtgtctacgacgtcggaaaatggatttacggcgagattcggcggtggagatacgacagaagtggaggctacggtgatacagaaccatgtgagcttaaaagttcggtgtaagagaggaaaacgacagatcttaaaagctattgtctcgattgaagaactaaagcttgcgattctacatctcactatctcttcttcctttgactttgtcatctactctttcaatctcaagatggaagatggttgtaaattaggatcagcagatgagatagcgacagccgttcatcagatcttcgagcaaatcaacggtgaagtcatgtggtcaaatcttagtcgaacttagttgacttttgactcctagtaacgtgtgtaaactttaggttacaaagaaaagggacgtgat

SEQ ID NO: 4134 - DNA, 896 bp, Artificial Sequence; identical to SEQ ID NO: 233
  P1397 (35S::G259)

SEQ ID NO: 4135 - DNA, 1349 bp, Artificial Sequence
  P1399 (35S::G1850)
ttgggtattgggattaaggaaagtttagatttttgatctataactcatgccgggggaacaaaccggagaaactccgacggtggccggagttggcggcggtggagctggttgtagcgccgggaatagtggtggaagtagtggatgtggtgctggtggtggcggtggtggtagtggtggaggtggtggcggaggaggagattcacagaggtcaattccgacgccgtttttgacgaaaacgtatcagcttgtggaagatccggtttacgacgaattgatctcgtggaacgaagatggaaccacttttattgtgtggcgaccagctgaattcgctagagatcttcttcccaaatacttcaaacataataacttctcgagttttgttcgtcagctcaatacttacgtgagtctcaatatacgtttgaatcgaaattttcagttattaggttttttagtagtgagctcttattttggtttattattggttttagggatttcgaaaagtagttccagatcgttgggagttttctaatgattgttttaagagaggtgagaagattctgcttcgggatattcaacggcggaaaatctctcagcctgctatggccgcggctgctgcagcggcggcggcagccgtagcggcttcggctgttacagtagcagctgttcctgttgtagctcatattgtttctccatcgaactctggagaagaacaggttatatcgtctaattcttcgcctgcggctgctgctgctgctataggaggagtggttggtggtggttctttgcagaggacaacgagctgcaccactgcaccagagctggttgaggagaatgagcgattgaggaaagataatgagcgattgaggaaagagatgacaaagcttaaaggattgtatgcgaatatctacacattaatggcgaatttcacaccgggtcaagaagattgtgcgcatttgttacctgaagggaaacctttagatcttttaccggagagacaagagatgagtgaagccattatggcttctgaaatagagacagggattggtctgaaacttggtgaggatttgactccaaggttgtttggggtttctattggggtcaagcgagctagaagagaagaagaattgggtgctgcagaggaagaagatgatgatagacgagaagctgctgcccaagagggagaacaaagttctgatgttaaggcagagccaatggaggagaataactccggtaaccataatgggtcgtggcttgaactcggaaaatgaaaaacacttgccgattcagaggcattgttgaatatgcaagaaactgttactgatccccattgcataggcaagccattgcgc

SEQ ID NO: 4136 - DNA, 1927 bp, Artificial Sequence; identical to SEQ ID NO: 1233
  P1401 (35S::G1852)

SEQ ID NO: 4137 - DNA, 1912 bp, Artificial Sequence
  P1405 (35S::G1290)
cggtcgttgtttcttgaaattccactgttattagactcttgactctgttttgtttcccgccgatctcgtgatgatggccaccaccaccaccaccaccaccgctagattctctgattcatacgagttcagcaacacaagcggcaatagcttcttcgccgccgagtcatctcttgattatccgacggaatttctcacgccaccggaggtatcagctcttaaacttctgtctaactgcctcgagtctgttttcgactcgccggagacgttctacagcgatgctaagctagttctcgccggcggccgggaagtttcttttcaccgttgtattctttccgcgagaattcctgtcttcaaaagcgctttagccaccgtgaaggaacaaaaatcctccaccaccgtgaagctccagctgaaagagatcgccagagattacgaagtcggctttgactcggttgtggcggttttggcgtatgtttacagcggcagagtgaggtccccgccgaagggagcttctgcttgcgtagacgacgattgttgccacgtggcttgccggtcaaaggtggatttcatggtggaggttctttatctgtctttcgttttccagattcaagaattagttactctgtatgagaggcagttcttggaaattgtagacaaagttgtagtcgaagacatcttggttatattcaagcttgatactctatgtggtacaacatacaagaagcttttggatagatgcatagaaattatcgtgaagtctgatatagaactagttagtcttgagaagtctttacctcaacacattttcaagcaaatcatagacatccgcgaagcgctctgtctagagccacctaaactagaaaggcatgtcaagaacatatacaaggcgctagactcagatgatgttgagcttgtcaagatgcttttgctagaaggacacaccaatctcgatgaggcgtatgctcttcattttgctatcgctcactgcgctgtgaagaccgcgtatgatctcctcgagcttgagcttgcggatgttaaccttagaaatccgaggggatacactgtgcttcatgttgctgcgatgcggaaggagccgaagttgataatatctttgttaatgaaaggggcaaatattttagacacaacattggatggtagaaccgctttagtgattgtaaaacgactcactaaagcggatgactacaaaactagtacggaggacggtacgccttctctgaaaggcggattatgcatagaggtacttgagcatgaacaaaaactagaatatttgtcgcctatagaggcttcactttctcttccagtaactccagaggagttgaggatgaggttgctctattatgaaaaccgagttgcacttgctcgacttctctttccagtggaaactgaaactgtacagggtattgccaaattggaggaaacatgcgagtttacagcttctagtctcgagcctgatcatcacattggtgaaaagcggacatcactagacctaaatatggcgccgttccaaatccatgagaagcatttgagtagactaagagcactttgtaaaaccgtggaactggggaaacgctacttcaaacgatgttcgcttgatcactttatggatactgaggacttgaatcatcttgctagcgtagaagaagatactcctgagaaacggctacaaaagaagcaaaggtacatggaactacaagagactctgatgaagacctttagtgaggacaaggaggaatgtggaaagtcttccacaccgaaaccaacctctgcggtgaggtctaatagaaaactctctcaccggcgcctaaaagtggacaaacgggattttttgaaacgaccttacgggaacggggattaaggaatgggaaatcatattccatttcactcccacaac

SEQ ID NO: 4138 - DNA, 883 bp, Artificial Sequence; identical to SEQ ID NO: 1293
  P1406 (35S::G1950)

SEQ ID NO: 4139 - DNA, 1322 bp, Artificial Sequence
  P1407 (35S::G1863)
gtcgacccattatccttaaagtaaccaacacttctctctctctttcttcaatggatttgcaactgaaacaatggagaagccagcagcagcaacaacatcagacagagtcagaagaacaaccttctgcagctaagataccaaaacatgtctttgaccagattcattctcacactgcaacttctactgctcttcctctctttacccctgagcctacttcttctaaactctcctctttgtctcctgattcttcctccaggttccccaagatggggagcttctttagctgggcacagtggcaagaacttgaactacaagctctgatctacaggtacatgttggctggtgctgctgttcctcaggagctccttttaccaatcaagaaaagccttctccatctatctccttcctactttcttcaccatcctcttcaacacctacctcattaccaacctgcttggtatttgggaagggcagcgatggatcctgagccaggcagatgcaggagaacggatggtaagaagtggagatgttcaagagacgtcttcgctggccacaagtattgcgagcgccacatgcaccgtggccgcaaccgttcaagaaagcctgtggaaactccaaccaccgtcaatgcaactgccacgtccatggcttcatcagtagcagccgcagccaccactacaacagcaacaacaacatctacgtttgcttttggtggtggtggtggtagtgaggaagtggttggtcaaggaggatctttcttcttctctggctcttctaactcttcatctgaacttctccaccttagtcaaagttgttcggagatgaagcaagaaagcaacaacatgaacaacaagaggccatacgagtcccacatcggattcagtaacaacagatcagatggaggacacatcctgaggcccttctttgacgattggcctcgttcttcgctccaagaagctgacaatagttcaagccccatgagctcagccacttgtctctccatctccatgcccgggaactcttcctcagacgtctctctgaagctgtccacaggcaacgaagagggagcccggagcaacaacaatgggagagatcagcaaaacatgagctggtggagcggtggaggttccaaccaccatcatcacaacatgggcggaccattggccgaagccctgagatcttcttcctcatcttccccaaccagtgttctccatcagcttggtgtctcgacacaagcctttcattgaccagtgtaaaaccaacacaacaatgcggtttttactgtgtttttggtttttatccaaatttcctgtataaagagg

SEQ ID NO: 4140 - DNA, 1956 bp, Artificial Sequence
  P1410 (35S::G303)
aacgtagccattaacttttatgcattaactccttcatttctttttgtgctcgtttggttgagagagagagaggctatatatgatgttccaacaagattaccctcatggcttttcactcgtggaaacatccttaagttacgaaatgttggattactttcaaaacatcgtcgtttcgaactctgaagacgtggcgtcacagcaaaattccatttcgtcctcttcttattcatcagcgacactctcctgctccataacagagcaaaaatctcacttaactgaaaagttatctcctctacgagaaagatatggttgcggtgactttctgtcgcggaagaggagaaggagaagtgaaaaaacgattgtagataaagagaatcaaaggatgaatcacattgccgtcgagcgtaaccggagaaaacagatgaatcattttctgtctatcctcaagtctatgatgcctctctcttattctcaacctgtgagtttctttctatctttaatttagcttataggatataagcaggctaagcaatgttgataatttgatatgttcggttaaaatttagtttagacaaagagtgttaaggttccttattaaaagtaagccgttaattaaataatagtaatttagtatatttgtttttgaatcaattactaaataaaattgcgaattgataaatttttgggtttttcctataatagaatgaccaagcatcaatcatagaagggaccattagctatctgaagaagctagaacaacgtctccaatctctcgaagcccaattaaaagctactaaactcaatcaatcaccaaatatattttccgacttcttcatgttccctcaatactccaccgccactgccactgccaccgccactgcctcctcatcctcctcgagccaccaccatcacaagcgactagaggtggttgctgacgtggaggttacaatggtagaaagacatgccaacattaaagtgttaacgaagacacagccaagattgctcttcaagattatcaatgagtttaactctttaggtttaagtactcttcatctcaacctcacaacttccaaagacatgtctctcttcacttttagcgtcaaggtaatctattctcttcctctcttgttttaggggaaaaagataatatatatgattatagaagttgttagttaacataaatttatatgaaataactaaaataaggcttcttgttttaaaagtcaactatatatgctcaaaatgattggtctctgtattaggtagaggcagattgtcaattgacgccttctggtaatgaggtcgcaaatacggtgcatgaagtcgttagaagagttcacaaggaacgttgaattttgtttacatactagctaactttgaaattctattttattgtataaacaatctcttatgtgtgtaatttacatatatacaattaattaacattaaagttgtttagttttttttttttttttgttggtttactgagttaataacattgtgttgacgtctattaaattgaggatataaaatacaagcatgatgaattgatgagtatatgtaatcagttgagttttaaaaaaatatttgtgtattcttttatacactagtaaaatttggttatattcaagaaacatcagatatttaatattatggaagagctaattttaagcgcaatataataagattcacacgatgggccttctcattacaagaaatgggcctttgaaacatatctcgtatttagatcagtaaaaccggacgcggatgcgattcaattttgcataaccggatcattgttcctcgagattactgaaagctcgtgtagattacgaaatacgaacgagcctcgtctacaattaaacgctagtatcggtgaccgaaacatctgaaaaagcatgccttcattgagcggcccaacttacaaaatttctctagtttacattattcggatgg

SEQ ID NO: 4141 - DNA, 1254 bp, Artificial Sequence; identical to SEQ ID NO: 561
  P1414 (35S::G728)

SEQ ID NO: 4142 - DNA, 1538 bp, Artificial Sequence; identical to SEQ ID NO: 475
  P1417 (35S::G597)

SEQ ID NO: 4143 - DNA, 982 bp, Artificial Sequence
  P1420 (35S::G1521)
accgaacaatctctatctccggtcatgcctccattaccgtcctccacggcgccttcgtcttcgagacatcttcgatcgccggaaagtatcgcgaaatttgcagggagagcaatatttcctgctttacaggggaaatcgtgtccgatatgcctcgaaaatctaaccgagcgaagatccgccgccgtgatcacggtgtgcaagcacggatactgccttgcttgtattcggaagtggagcagcttcaagaggaattgtcctctttgtaacactcgttttgattcctggtttatcgttagtgattttgcttctagaaaataccataaggagcaattaccaattcttcgtgatcgtgagactttaacttatcatcggaataatccttccgatcgccggaggataattcaaaggtcgagggatgttttggaaaactctagctcaagatcaaggccattgccatggcggagatcatttggacgaccaggttcagttcctgattctgttatcttccagcgaaagcttcagtggcgagctagcatatacactaagcaattacgagctgttcgattacattcaaggcgcttggaactaagtttggcggtgaatgattacaccaaagcaaagataactgaaagaattgagccatggattagaagagagcttcaggcagtccttggagatcctgatccctcagttattgttcattttgcgtcagctcttttcatcaaaaggcttgagagagagaataatcgacaaaccgggcagaccgggatgttggtggaagatgaagtctcctctcttcgaaaattcttgtctgataaggtggatatattttggcatgaactaagatgttttgcggagagtatactcacgatggagacttatgatgcagtggttgaatacaatgaggtggagtaatagcagtaaaaaaaacagataaccgagcactatgctctcgtcaaatgaagtaaatagacagacttac

SEQ ID NO: 4144 - DNA, 2896 bp, Artificial Sequence
  Artificial sequence
  P1423 (35S::G1089)
aagagagcttcttaaggaagaagaagatgggttgtgctcaatcaaagatcgagaacgaagaagcagttactcgttgcaaagaacgaaaacaattgatgaaagacgccgtcactgctcgtaacgctttcgccgccgctcactcagcttacgctatggctcttaaaaacaccggagctgctctttccgattactctcacggcgagtttttagtctctaatcactcgtcttcctccgcagctgcagcaatcgcttctacttcttctcttcccactgctatatctcctcctcttccttcttccaccgctccggtttctaattcaaccgcttcttcttcctccgctgcggttcctcagccgattcctgatactcttcctcctcctcctcctccaccaccgcttcctcttcaacgtgctgctactatgccggagatgaacggtagatccggtggtggtcatgctggtagtggactcaacggaattgaagaagatggagccctagataacgatgatgatgacgatgatgatgatgatgactctgaaatggagaatcgtgatcgtttgattaggaaatcgagaagccgtggaggtagtactagaggaaataggacgacgattgaagatcatcatcttcaggaggagaaagctccgccacctccccctttggcgaattcacggccaattccgccgccacgtcagcatcagcatcaacatcagcaacagcaacaacaacctttctacgattacttcttccctaatgttgagaatatgcctggaactactttagaagatactcctccacaaccacaaccacaaccaacaaggcctgtgcctcctcaaccacattcaccagtcgttactgaggatgacgaagatgaggaggaggaagaggaggaagaggaggaggaagaggagacggtgattgaacggaaaccactggtggaggaaagaccgaagagagtagaggaagtgacgattgaattggaaaaagttactaatttgagagggatgaagaagagtaaagggatagggattcccggagagaggagaggaatgcgaatgccggtgactgcgacgcatttggcgaatgtattcattgagcttgatgataatttcttgaaagcttctgaaagtgctcatgatgtttctaagatgcttgaagctactaggctccattaccattctaattttgcagataaccgaggtaattttgattcgataaatgtctgagagaaacaaaatgattggtttagctaagattgatgtgttgttgttgtaacaggacatattgatcactctgctagagtgatgcgtgtaattacatggaatagatcatttagaggaataccaaatgctgatgatgggaaagatgatgttgatttggaagagaatgaaactcatgctactgttcttgacaaattgctagcatgggaaaagaagctctatgacgaagtcaaggtaactatatcaaaacttgtctcttttttatgcttgtgcttgtttagtgaagctgaaagattttaactttttgaggaaagattcttgcaaccatgtttagtctttttgggtaatcttctctcctgagaaaagcccctttgattgttttgggtagttttatgagcaaaaatgatatatttttctcttgagagtctaattttgggatacacttcttgttggatataggctggcgaactcatgaaaatcgagtaccagaaaaaggttgctcatttaaatcgggtgaagaaacgaggtggccactcggattcattagagagagctaaagcagcagtaagtcatttgcatacaagatatatagttgatatgcaatccatggactccacagtttcagaaatcaatcgtcttagggatgaacaactatacctaaagctcgttcaccttgttgaggcgtaagtttcgcttcttggtagatattttttcctatgatgttttagacaaattgattttgagttcttatgcaaatttttttgcaggatggggaagatgtgggaaatgatgcaaatacatcatcaaagacaagctgagatctcaaaggtgttgagatctctagatgtttcacaagcggtgaaagaaacaaatgatcatcatcacgaacgcaccatccagctcttggcagtggttcaagaatggcacacgcagttttgcaggatgatagatcatcagaaagaatacataaaagcacttggcggatggctaaagctaaatctcatccctatcgaaagcacactcaaggagaaagtatcttcgcctcctcgagttcccaatcccgcaatccaaaaactcctccacgcttggtatgaccgtttagacaaaatccccgacgaaatggctaaaagtgccataatcaatttcgcagcggttgtaagcacgataatgcagcagcaagaagacgagataagtctcagaaacaaatgcgaagagacaagaaaagaattgggaagaaaaattagacagtttgaggattggtaccacaaatacatccagaagagaggaccggaggggatgaatccggatgaagcggataacgatcataatgatgaggtcgctgtgaggcaattcaatgtagaacaaattaagaagaggttggaagaagaagaagaagcttaccatagacaaagccatcaagttagagagaagtcactggctagtcttcgaactcgcctccccgagctttttcaggcaatgtccgaggttgcgtattcatgttcggatatgtatagagctataacgtatgcgagtaagcggcaaagccaaagcgaacggcatcagaaacctagccagggacagagttcgtaagaactaatgtaagatcagagtaatgtcttcttcttctttgatcttgaatatttaagcacacacatacatacaacgtatagctaaat

SEQ ID NO: 4145 - DNA, 682 bp, Artificial Sequence
  P1441 (35S::G485)
tcctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaaca

SEQ ID NO: 4146 - DNA, 626 bp, Artificial Sequence
  P1446 (35S::G1248)
catcattcgttgttgtgaatcatactgaaacgaacccctcaccaaacaagatttatagatcctctgctttaattataagattctgatggcggggaattatcattcgttccaaaatccaatccctcgataccagaattacaacttcgggagcagctcatctaatcatcaacatgaacatgatgggttagtggtggtggtggaggatcaacagcaagaagaaagcatgatggtaaaagaacaagacaggctacttccgatagcaaacgtaggaaggatcatgaagaacatcctcccagcaaacgcaaaggtctctaaagaagccaaagagactatgcaagaatgtgtgtccgagttcattagcttcgtcacgggagaagcatccgataaatgccacaaggagaagcgaaagaccgttaatggagacgatatctgttgggctatggctaatctagggtttgatgattacgccgcccagctcaagaagtacttacatcgttaccgagttctcgaaggtgagaaacctaatcatcacggcaaaggaggacctaaatcctcgccagataattaaaattcttccatcgctttttgattttccttgattaatctccatgtcatcatcttcctct

SEQ ID NO: 4147 - DNA, 998 bp, Artificial Sequence; identical to SEQ ID NO: 231
  P1447 (35S::G258)

SEQ ID NO: 4148 - DNA, 963 bp, Artificial Sequence
  P1450 (35S::G1641)
atccgttgacttgtcggcatgatttgttcttacttaccgtaaaaaaaacagagctaggttttagttttcggacatggaggttatgagaccgtcgacgtcacacgtgtcaggtgggaactggctcatggaggaaactaagagcggcgtcgcagcttctggtgaaggtgccacgtggacggcggcagagaacaaggcattcgagaatgctttggcggtttacgacgacaacactcctgatcggtggcagaaggtggctgcggtgattccggggaagacagtgagtgacgtaattagacagtataacgatttggaagctgatgtcagcagcatcgaggccggtttaatcccggtccccggttacatcacctcgccgcctttcactctagattgggccggcggcggtggcggatgtaacgggtttaaaccgggtcatcaggtttgtaataaacggtcgcaggccggtagatcgccggagctggagcggaagaaaggcgttccttggacggaggaagaacacaagctatttctaatgggtttgaagaaatatgggaaaggagattggagaaacatatctcggaactttgtgataacgcgaacgccaacacaagtagctagccacgcccaaaagtacttcatccggcaactttccggcggcaaggacaagagacgagcaagcattcacgacataaccaccgtaaatctcgaagaggaggcttctttggagaccaataagagctccattgttgttggagatcagcgttcaaggctaaccgcgtttccttggaaccaaacggacaacaatggaacacaggcagacgctttcaatataacgattggaaacgctattagtggcgttcattcatacggccaggttatgattggagggtataacaatgcagattcttgctatgacgcccaaaacacaatgtttcaactatagctaatgaagatccatctctctaa

SEQ ID NO: 4149 - DNA, 1072 bp, Artificial Sequence; identical to SEQ ID NO: 885
  misc_feature (46)..(46): n is a, c, g, or t
  misc_feature (61)..(61): n is a, c, g, or t
  misc_feature (63)..(63): n is a, c, g, or t
  P1453 (35S::G1267)

SEQ ID NO: 4150 - DNA, 754 bp, Artificial Sequence
  P1457 (35S::G1749)
caacacttctcagtgaccgtgagcaacgaattattttcagttcaacgactccgcggaaatggaaaattcagaaaatgttccctcttacgatcaaaacatcaatttcactcctaatttgacgagagatcaagaacatgtgatcatggtctctgctttgcaacaagtaatatccaacgtcggaggtgacacgaactcgaatgcatgggaagctgatcttccacctttgaacgctggcccttgtcctctttgtagtgtcaccggctgctacggttgcgtcttcccacgacacgaggcgataattaagaaggagaagaagcacaaaggagtgaggaaaaaaccatcaggtaaatgggcggcggagatatgggatccgagtttgaaagtaaggagatggcttggaacgtttccaacagcggagatggcggctaaggcttacaacgatgcggcggctgagtttgtcggaagaagatcagcaagacgtggcacaaagaacggagaggaagcatctaccaagaagacgactgagaaaaattaacggagaaggagcacgtatagaaaggcaggaagaggcatcttacttgcttcacaagtaaatcagaatttttttgaaaagtaaaaacgttattttgtttggtaataaaataaagtaaaacaaaatattgctaacgcaagacttatcaagttcagtcgtgactgtgagtgtgtttttatgtatcttacttcattttttgtctttcaattgtgtgtgtgtgtg

SEQ ID NO: 4151 - DNA, 1930 bp, Artificial Sequence
  P1459 (35S::G186)
ctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatgtctagaattgacgaagaagatgatcagaagacgagaatatcaaccaacggtagtgaatttaggtttccggtgagtctctcaggtattcgtgatcgtgaagatgaagatttttcatctggcgttgctggagataatgaccgtgaagttcccggcgaagtggatttcttctccgacaagaaatctagggtttgtcgtgaagacgacgaaggatttcgtgtgaagaaggaagaacaagatgatcgaacggacgtaaataccggtttgaatcttcgaacaactggtaatacaaagagtgatgagtcaatgatcgatgatggagaatcttccgaaatggaagataagcgtgcgaaaaatgagttggtgaaattacaagatgagttgaagaaaatgacaatggataatcaaaagcttagagaattgcttacacaagttagcaacagttacacttcacttcagatgcatcttgtttcactaatgcagcaacagcaacaacagaacaataaggtaatagaagctgctgagaagcctgaggagacgatagtaccaaggcaatttattgatttaggccctacgagagcagtaggtgaggccgaggatgtgtcaaattcttcatccgaagatagaactcgttcggggggttcttctgcagccgagaggcgtagtaacgggaagagacttgggcgtgaagaaagccccgaaactgagtccaacaaaattcagaaggtgaattctactaccccgacgacatttgatcaaaccgctgaagctacgatgaggaaagcccgtgtctccgttcgtgcccgatcggaagctccgatgataagcgatggatgtcaatggagaaaatatggccagaagatggccaaagggaatccttgtccgcgggcatattaccgctgcacgatggccacgggctgtcccgttcgcaaacaagttcaacgttgcgcggaagacagatcaattctgattacaacctacgagggaaaccataaccatccgttgccgccagccgcggtagccatggcttctaccaccacggcggcggctaacatgttgctatccgggtcaatgtctagtcacgacgggatgatgaaccctacaaatttactagctagggctgttcttccttgctccacaagcatggcaacaatctcagcctccgcgccgtttccaaccgtcacattagacctcacccactcacctccgcctcctaatggttccaatccttcctcttccgcggctaccaacaacaaccacaactcactgatgcagcggccgcaacaacaacaacagcaaatgacgaacttacctccgggaatgctacctcatgtaataggccaggcattgtataaccaatccaagttctcggggctgcagttctctggtggctctccctcgacggcagcgttttctcagtcacacgcggtggctgatacaataacggcactcacagctgacccgaatttcacggcggctcttgcagccgttatttcttctatgatcaatggtacgaaccaccacgacggcgaaggaaacaacaaaaatcaatagaaaaatattacattttttttttgggtatctacattttttttccaactgggttataggaaacagagagtttatttcattgattcacatttgttctgtttcgtaccaaaatcccagtaaatatacaaaagcaaactatactcaagttcatattcgtaaacactataaatag

SEQ ID NO: 4152 - DNA, 1012 bp, Artificial Sequence
  P1461 (35S::G1760)
ccctaaaaaagagaagaaccagaggagattcaattagaggataaaattgatgggaagagggaagattgtgatccaaaggatcgatgattcaacgagtagacaagtcactttctccaaacgaagaaagggccttatcaagaaagccaaagagctagctattctctgtgatgccgaggtcggtctcatcatcttctctagcaccggaaagctctatgactttgcaagctccagcatgaagtcggttattgatagatacaacaagagcaagatcgagcaacaacaactattgaaccccgcatcagaagtcaagttttggcagagagaagctgctgttctaagacaagaactgcatgctttgcaagaaaatcatcggcaaatgatgggagaacagctaaatggtttaagtgttaacgagctaaacagtcttgagaatcaaattgagataagtttgcgtggaattcgtatgagaaaggaacaactgttgactcaagaaatccaagaactaagccaaaagaggaatcttattcatcaggaaaacctcgatttatctaggaaagtacaacggattcatcaagaaaatgtggagctctacaagaaggcttatatggcaaacacaaacgggtttacacaccgtgaagtagctgttgcggatgatgaatcacacactcagattcggctgcaactaagccagcctgaacattccgattatgacactccaccaagagcaaacgaataacagagagattgaagttggaagataccatgatgttgaagaacactccaaaggccttggtttgaataaggttcttgaactggaaacctctatacaccaagccacgtacgataagcagcatggttcttctaacatagtcatattttcaatcctaaatataattaaagcatatataattaaaatccggtgttgttatactcatcttgagtattaatattgtacttgtttataaccatagattcgtcaattaatagagaaaaatcatatgaattattatcc

SEQ ID NO: 4153 - DNA, 913 bp, Artificial Sequence
  P1465 (35S::G344)
tcaaatatggattcgcttcgctcctcctttatttaaaatacttgtagtgctttcatacggctagagacaaaaatggagtgtgtagaagcatttctcggtgatttttccgtcgacgatcttctcgacctctctaacgccgacacttctttagagtcgtcttcgtcacaaagaaaagaagacgaacaagaacgtgagaaatttaagagcttttctgaccaaagtacccgtctttcaccgccagaggatctcttatcttttcccggcgacgctccggttggtgatttggaggacttagagtggttatccaacttcgtggaggattctttctcagaatcgtatatttcgagtgatttcccggtgaatccagtcgcgtcggtggaggttcggagacagtgcgttcctgttaaacctagaagcaaacgccgccgcaccaacggccgtatctggtctatggagtctccatctcctctgctatccaccgctgttgccagaaggaagaagagagggagacagaaggtggatgcatcgtacggtggcgtagtccagcagcagcagctgaggcggtgctgcagccattgtggagtccagaagacgcctcaatggagaatgggtccattaggtgcgaagacactgtgtaatgcttgtggggtccggtttaagtcgggtcgacttttacccgaatatagacccgcttgtagcccaacattcaccaacgagattcactctaactctcaccggaaagtgttggagctacggctcatgaaagtggcggatccggctcgggtttaagccatttttttctatcttgaaattttatcaatgccatgtgcattgtgtaatcttgtaaacagagaatcagagagagatccgtagactgttttcacattcatgaagttaagctataattagagac

SEQ ID NO: 4154 - DNA, 965 bp, Artificial Sequence
  P1468 (35S::G1512)
tttaaacatcttccaatctctgaaagcccctctcttttctccatttcgtgcttcatcatattcgtcgtcgcttcgggtcttacctctcatggaagggaacttcttcatcaggtctgatgctcaacgagcacatgacaatggcttcatagccaaacaaaaacctaatctcaccacggctccaacagcaggtcaagctaatgaaagtggctgttttgactgcaacatctgtttagacacagcccatgatccggtggtcactctctgcgggcaccttttctgctggccttgcatttacaagtggttacatgttcagttatcttctgtctccgttgatcagcaccagaacaattgccctgtttgtaaatccaacattactatcacctctttggttcctctctatggaagaggcatgtcttcgccttcttccacgtttggctccaagaaacaagacgcactgtccactgacataccccgcagacctgctccatcagccttacgcaatccgattacctcagcatcatctctgaacccaagcttgcaacatcaaactctgtctccttcatttcataatcatcagtattcccctcgtggcttcaccacaaccgaatcaaccgaccttgccaatgctgtaatgatgagtttcctctaccctgtgattggaatgtttggagacctggtctacaccaggatattcgggaccttcacaaacacaatagctcagccttaccaaagccagaggatgatgcagcgtgagaagtctcttaatcgggtatcgatattcttcctttgttgcatcatcctttgcctccttctcttctagctctctctctctctctctctctctctctctctctctctctctctctctctctctctctctctctctcttcgtgtatagtacgtgatgtacataggctgtaaaactcgaatttactgtggtataaccactactgcagacaccgttc

SEQ ID NO: 4155 - DNA, 1472 bp, Artificial Sequence
  P1475 (35S::G988)
gaaaaagactcatttgatcgagagagaaaaagaatcatttgaaccaaaagcatctttttctatcttttcaaatgcttacttccttcaaatcctctagctcctcctccgaagatgccaccgctaccaccaccgagaatcctcctcctttgtgcatcgcctcctcctcggccgcaacctccgcctcacatcacctccgtcgtcttcttttcaccgctgcgaatttcgtctcccagtcaaacttcaccgccgctcaaaacttactctcaatcctctcccttaactcttctcctcacggcgactccaccgagcgacttgtacacctcttcactaaagccttgtccgtacgaatcaaccgtcagcaacaagatcagacggctgaaacggttgccacgtggacgacgaacgaaatgacgatgagtaactccacggtgttcacgagcagtgtatgcaaagaacagttcttgtttcgaaccaagaacaacaattctgacttcgagtcttgttactatctttggctaaaccaactaacgccgtttattcggttcggtcatttaacggcgaaccaagctatcctcgacgcgacggagacaaacgataacggagctctacatatacttgatttagatatatcacaaggacttcaatggcctccattgatgcaagccctagcagagaggtcatcaaaccctagcagtccacctccatctctccgcataaccggatgcggtcgagatgtaaccggattaaaccgaactggagaccggttaacccggttcgctgactctttaggtctccaattccagtttcacacgctagtgatcgtagaagaagatctcgccggacttttgctacagatccgattgttagctctctcagccgtacaaggagagaccattgccgtcaattgtgttcacttcctccacaaaatatttaacgacgatggagatatgatcggtcacttcttgtcagcgatcaagagcttaaactctagaatcgttacaatggcagagagagaagctaatcatggagatcactcgttcttgaatagattctctgaggcagtggatcattacatggcgatctttgattcgttggaagcgacgttgccgccaaatagccgagagagactaaccctagagcaacggtggttcggtaaggagattttggatgttgtggcggcggaagagacggagagaaagcaaagacatcggaggtttgagatttgggaagagatgatgaagaggtttggtttcgttaacgttcctattggaagctttgctttgtctcaagctaagcttcttcttagacttcattatccttcagaaggttataatcttcagttccttaacaattctttgtttcttggctggcaaaatcgtcccctcttctccgtttcgtcgtggaaatgatccaaagagaaggacaaaaaaacctatatatctaggtatatagtagacaaaaaaaaagatcga

SEQ ID NO: 4156 - DNA, 1719 bp, Artificial Sequence
  P1476 (35S::G1767)
caaagtattaaatcttagatattgtgggtctccctttcttctattcattttcttattcattaaaaaaaaaaaatggatactctctttagactagtcagtctccaacaacaacaacaatccgatagtatcattacaaatcaatcttcgttaagcagaacttccaccaccactactggctctccacaaactgcttatcactacaactttccacaaaacgacgtcgtcgaagaatgcttcaactttttcatggatgaagaagacctttcctcttcttcttctcaccacaaccatcacaaccacaacaatcctaatacttactactctcctttcactactcccacccaataccatcccgccacatcatcaaccccttcctccaccgccgcagccgcagctttagcctcgccttactcctcctccggccaccataatgacccttccgcgttctccatacctcaaactcctccgtccttcgacttctcagccaatgccaagtgggcagactcggtccttcttgaagcggcacgtgccttctccgacaaagacactgcacgtgcgcaacaaatcctatggacgctcaacgagctctcttctccgtacggagacaccgagcaaaaactggcttcttacttcctccaagctctcttcaaccgcatgaccggttcaggcgaacgatgctaccgaaccatggtaacagctgcagccacagagaagacttgctccttcgagtcaacgcgaaaaactgtactaaagttccaagaagttagcccctgggccacgtttggacacgtggcggcaaacggagcaatcttggaagcagtagacggagaggcaaagatccacatcgttgacataagctccacgttttgcactcaatggccgactcttctagaagctttagccacaagatcagacgacacgcctcacctaaggctaaccacagttgtcgtggccaacaagtttgtcaacgatcaaacggcgtcgcatcggatgatgaaagagatcggaaaccgaatggagaaattcgctaggcttatgggagttcctttcaaatttaacattattcatcacgttggagatttatctgagtttgatctcaacgaactcgacgttaaaccagacgaagtcttggccattaactgcgtaggcgcgatgcatgggatcgcttcacgtggaagccctagagacgctgtgatatcgagtttccgacggttaagaccgaggattgtgacggtcgtagaagaagaagctgatcttgtcggagaagaagaaggtggctttgatgatgagttcttgagagggtttggagaatgtttacgatggtttagggtttgcttcgagtcatgggaagagagttttccaaggacgagcaacgagaggttgatgctagagcgtgcagcgggacgtgcgatcgttgatcttgtggcttgtgagccgtcggattccacggagaggcgagagacagcgaggaagtggtcgaggaggatgaggaatagtgggtttggagcggtggggtatagtgatgaggtggcggatgatgtcagagctttgttgaggagatataaagaaggtgtttggtcgatggtacagtgtcctgatgccgccggaatattcctttgttggagagatcagccggtggtttgggctagtgcgtggcggccaacgtaaagggttgtttttattttttcataaggaattcgcaagttcgatttttacttg

SEQ ID NO: 4157 - DNA, 867 bp, Artificial Sequence
  P1477 (35S::G1841)
tctacatttttgaagacgaccctgtggttgataggttcaataggtttggcacggagatgtctgccatggtctcggccttgacacaggtggtttctgctcgctctcagactgaggctgaaggtgctcactctcagactgaggctgaaggtgctcactcttcttcctcttcggctggacataaaagaggatggcttggaatcgattctgctcctattccctcatcatttgctcgtgtagactcttcacataatccgatcgaagaatccatgagcaaggcatttccagaggaagcaagggagaaaaaaaggaggtacagaggagtaaggcagagaccatggggcaaatgggcagctgagatacgtgatccacatagagccgctagggtttggctcgggacgtttgatacagcggaggccgcggctagagcctacgacgaggctgcactccggttccgtggaaataaagcaaagctaaatttcccagaggatgtaaggattcttcctcctccccctcctcttcttcgttcaccagctgacacggtggcgaataaagcagaagaggatctgataaattattggagttatacaaagttgttgcaaagttcaggccaacggtcatttctcgagcgaggacaagaagagagtagtaacatatttgaacattcaccaatggaacaacctctgcctccttcaagttctggtccaagttcctctaattttcctgcaccttctctacctaatacatagtttcacttttattaaagctctacaaatacaattaaatacatagctaaatgaaaatgattttcttgtctgtataccttcttaagtgctaaacaatatattgtactctttgttttccttaact

SEQ ID NO: 4158 - DNA, 2321 bp, Artificial Sequence
  P1479 (35S::G158)
gaagaagaagagattttgattttggtttaatatatagttggggattaacaggatgggaagggtaaaattgaagataaagaagttagagaacacaaatggacgccaatctacatttgctaaaaggaaaaatgggatcttgaaaaaggctaatgagctatctattctttgtgacattgatattgttcttcttatgttctctcctactggcaaggctgcaatatgttgcggtacacgaaggtaatctatctaatgtgtcttcctttgttttgtttgttgtcaacataatcattgtctctcttggattgtgttatctgaatgtattatgattgttcttcagtagcatggaagaggtgattgctaagttttctcaagtaacaccgcaggaaagaacgaaaaggtttggtgttttcttatcgatatgtttttgtttgtttctccggcaatggttggtcttgttttactcattggtttcatcttttttgaatacaggaagttcgagagtcttgaagtaagtttattttcacataatcaaatgaagtttttggttaattttgatccttgagaatctctgattttagatgtttctctttcgaaagctcagaacttgaagaaaactttccaaaagttggatcacgatgtaaatatacgcgaatttatagcctcaaggtatgtccggaaacagttttatatcaaaatctcttgcaagaaactctatatgaatattaacttcttttcttctctcttgtttgcttttggttctttggtttcagtaattcaacagtagaggtattggttttaagactctctttccatttctaacgtctatgacatttgccaaagcctaaatttatacaaaacaaccttttttcaggacttgagtactcaagcaaggattctgcaggctcggatttctgagatacatggaagattaaggtaaagatcttgctgaggatgatagttctttgttctcttgatgtctgtgctcttttttatacttgttagtgtcatgttctgcagttattggacggaaccagataagattaacaatgttgaacacttgggacagctcgaaatttcgattaggcaatcccttgatcaattgcgtgcacacaaggtatcttttgtttaaaacttttccatttcacttcatccgcgaaacaaaaaactaaaaactcttctgttgataggaacattttgggcagcagcaacaggcaatgcaaatagaaaacgcaaactttgttaaggattggtcaacatgctcggtaatttactcgaatgactcttctttagttctcatttgtaacaaaacaaattgtaaacccggctgtacaactttcagatgcaagatgggattcagattcctttagaacaacagcttcaatctatgtcatggattcttaatagcaacaccaccaacattgtcaccgaggaacacaattcaatcccgcagaggttagtgaaaactctcaccgagagaacttttctttcttttaatattgaatcatatcttaaaaccaaatctttgtctatcctcaaaagggaagtcgagtgctcagcgagttcttcattcgggagctatccaggctactttggaacagggaaatctcctgaaatgacaattccgggtcaagaaacaagctttcttgatgaactaaacaccggacagctgaaacaggacacaagctcgcagcagcagttcactaataataataatatcacagcatacaatcccaatcttcacaatgatatgaatcatcaccaaacgttgcctcctcctcctcttcctcttactcttccgcatgctcaggtgtatattccaatgaatcagagagagtatcatatgaatggattctttgaagcaccaccacctgattcttctgcttacaacgacaacaccaaccaaaccaggtttggttctagcagcagctccttgccttgctcaatctcaatgttcgacgaatacttgttttcccaggtaaccaaaacaaaactttctcagagattctaaatgggtttttgttttgtagactgatttgacaatttgttcttctttcttatagatgcagcagccgaactgagagagatttgatgaatgatgataaaacatctcactgaagaaactcaaaccaatattttttttcagaaacagcaagaaagctaaaactctgccgatttctgaattggttccaagaagaaaaaaaccagtggtaatccctggtagattgtgcaaccaaaccacacacaatacgtgttcatttattttttctatatcttcaatagatgtcacttaattcttttctatacataatttctcagtcaga

SEQ ID NO: 4159 - DNA, 1270 bp, Artificial Sequence; identical to SEQ ID NO: 1339
  P1482 (35S::G2059)

SEQ ID NO: 4160 - DNA, 3131 bp, Artificial Sequence
  P1489 (35S::G585)
gttctacaactcaagacaaggttctctaggtttttcttgattccattgattttttcttataaactcatataaggtttcttgatcttctttaaaagttcaattttttttctcttcttcttgaagttcttgattagttcaagaaaatgttttgtttgttttctttattcgatttgatatttgtttttgtttttctatatataaaaagagttttagaatggggagatggatactataatggagatatcaaaacgaggaagacgattcaagcttcggagatcaaagctgatcagcttggtctacggaggagcgagcagcttagcgagctttacgagtctctctccgtcgctgaatcttcttcttcaggcgttgctgccggatctcaagtcaccagacgagcttccgccgccgcactttcaccggaagatctcgccgacaccgagtggtactatttggtttgtatgtctttcgtcttcaacattggtgaagggtaattccgtcttttcctctatcagcattgacatttattatgtgtcatgatcgtgttgatctttgccagttttaaacaacgtgccaaaatatacttttaatactagtaggtccaaggatttcgacttttatggttcagtttaggtttgttagatttcagggttctgcaggaaaaaagtatgagctagaaccaattttttagtttcagtttggtttcaaaatttaatgtccggatttggtcggtttcagattacaaaagaaaaagttaaaacataattaattttaaataataatgtgtatatatatgcattagtatgtttaactctattctacatctaataaattttattaattcggtttggttgcagtatatttgtgttcgattcgagtttagttcggtttatttatcatcacaaaagtttgtttctgtccggattaattaaaaaattcgtttcattttggtctttatgaacacggctaattaactttcaataattatgaatatgttaggaagaaaaaatgtggaaaaattaagcttagaatgcattgctgctttctaaatgaacctgtctttttgcagaatgcctggacggacgtttgcaaacggtgaaccgatatggttgtgcaacgctcatacggcggatagtaaagtgtttagccgttctcttctagcaaaagtaagttgtagtattgatgtagttgctatgtaacacttttttgcgatttgaaaacactaaaatcgttcgtttttgtttgcgttttgtggtggtttagagtgctgcggttaagacagtggtttgcttcccgttccttggaggagtcgttgagattggtaccacagaacatgtaagccaatatttgtgttttctgcttccaatgttttagaataattattatgaaaatcctttattaagaaaaaaagaataattataaaattaccacaatgtattctaacatttcaatttgacccttcaatctgtcgaataacggtatagacaccaagaacacacaaactaatattttagtagtctcgatttttaaagatttccacggtttggttatgacaaaacgcgaaaatacggcttttgtactttttactagctcgttggtatagttataattgaaaactttttcaaggctttttcttggtgtgtttcgtctcgtagattacggaagacatgaatgtaatacaatgcgtgaagacatcattcctcgaagcccctgatccgtacgctacaatattaccagcaagatccgattatcacatcgacaacgttcttgatccgcaacagattctaggcgacgagatttacgcgcctatgttcagtacggagccttttccaacagcttctccgagcagaactaccaacggtttcgatcaagaacatgaacaagtagcagatgatcatgattctttcatgaccgaaagaatcactggaggagcttctcaggtgcaaagctggcagctcatggacgacgagcttagtaactgcgttcaccagtcgctaaattccagcgattgcgtctctcaaacgtttgttgaaggggcggctggacgggttgcttacggtgcaagaaagagtagagttcaaagactagggcaaattcaagagcaacagagaaatgtgaagacattgtcatttgatccaagaaacgacgacgttcattaccaaagtgtgatctcaacgatttttaagaccaaccatcagttaattctcggaccgcagtttcgaaactgcgataaacagtcaagcttcactaggtggaagaaatcatcgtcatcatcatcaggaaccgccacggtcacggcaccatcacaaggaatgttaaagaaaattattttcgatgttccgcgagtgcaccagaaagagaagttaatgttggactcaccagaagccagagatgaaactgggaaccatgcggttttagagaagaagcgccgcgagaaattgaacgaacggttcatgaccttgagaaaaatcattccgtcaatcaacaaggtatatttatataatcgattcttcaaaatttcaaatccatatatatcgcgaggtaactaatcttatgtttaacattttcgatagatcgataaagtatcgattcttgacgatacgatagagtatcttcaagaactcgagagacgggttcaagaactagaatcttgcagagaatcaaccgatacagagactcgtgggacgatgacgatgaagaggaagaaaccatgcgacgcaggagaaagaacatcagctaattgcgcaaataatgaaacaggaaatgggaagaaggtgtcggttaacaatgttggtgaagccgagccagcagataccggttttactggtttaaccgataatttaaggatcggttcgtttggtaatgaggtggttattgagcttagatgtgcttggagagaaggagtattgcttgagataatggatgtgattagtgatctccatttggattctcattcggttcaatcctcgaccggagacggtttgctctgcttaaccgtcaattgcaaggtatactctctaacctacttttggcttaaccaggatttggttaacctagattgacatgaaatgtgttggtttcagcacaaggggtcaaaaatagcgacaccaggaatgatcaaagaagcacttcaa

SEQ ID NO: 4161 - DNA, 1243 bp, Artificial Sequence; identical to SEQ ID NO: 1283
  P1492 (35S::G1938)

SEQ ID NO: 4162 - DNA, 809 bp, Artificial Sequence
  P1496 (35S::G1888)
gaaaatagaaagatgaagatttggtgtgctgtttgtgataaagaagaagcttcggtgttttgttgtgcggatgaagcagctctttgtaatggttgcgatcgccatgttcatttcgccaataaactagccgggaaacatctccggttctctctcacttctcctactttcaaagatgctcctctttgtgatatttgcggggagaggcgtgcattattattttgccaagaagacagagcaatactatgcagagaatgtgacattccaatacatcaagctaatgagcacactaagaaacacaatagattcctccttaccggcgttaagatctctgcctccccgtcagcctacccaagagcctccaattccaactctgctgctgcatttggtcgagccaaaacccgaccaaaatcagtatcgagcgaggtcccgagctcggcctccaatgaggtatttacgagctcttcttcgacgaccacgagcaattgctattatgggatagaagaaaactaccatcacgtgagcgattcggggtcgggatcgggttgtacaggtagtatatccgagtatttgatggagacattaccgggttggagagtggaggatttgcttgaacacccttcttgtgtctcctatgaggataacattattactaataacaataacagtgagtcttatagggtttatgatggttcttcacaattccatcatcaagggttttgggatcacaaacccttctcttgaacttatttctgtcgaattatagtcttttttttataagttggggtttgtaatcatgaatccaaaccaac

SEQ ID NO: 4163 - DNA, 977 bp, Artificial Sequence
  P1497 (35S::G325)
agaagtatggaggctcgatgtgacttttgtggaaccgaaaaagcattaatctactgcaaatctgattcggctaaactttgtttaaactgtgacgttaatgtacactcagcgaatcctctgtctcaaagacacacgcgatctctactctgcgagaaatgttccttacaacccacggcagtacactgtatgaacgaaaatgtttctctttgccaaggatgtcagtggaccgctagtaactgcactggtttaggacacagacttcagagtctgaacccttactctgattgtccttctccatcagatttcggcaagatctggtcttcaactttagaaccttctgtcacaagtttggtctctccattttctgataccctgctccaggaattagacgattggaatggttcatcaacttccgtggttacacaaactcagaaccttaaagactattcttctttctttcctatggaatctaatcttccaaaagtgatagaagaggtgacgtgttgtttaagtaatatatcaaaatgtttcatttatgataaagaagaatgtttttcatttatattccgttctatatgcaggaatgttctggtttggatctatgcgaagggataaacttagatgatgcgccgttgaatttcaacgcaagcaatgatataatcggatgttcatcacttgacaataccaaatgttacgagtacgaggattcttttaaggaagagaataacattggccttccttcattactgcttcctactttatccgggaacgttgtaccgaacatgtcactttcgatgtctaacctcacaggagaaagcaatgcgactgattaccaagattgcggaatttcaccagggtttctcataggagattcgccatgggaatcgaatgttgaagttagttttaatccaaaattaagggatgaggctaaaaagagatacaaacaaaagaaatcaaagcgcatgtaagtttttgag

SEQ ID NO: 4164 - DNA, 673 bp, Artificial Sequence
  P1498 (35S::G362)
acccatcgataaacacatacgttcacacatatatgtctataaatccgacaatgtctcgtactggcgaaagttcttcaggttcgtcctccgacaagacgataaagctattcggcttcgaactcatcagcggcagtcgtacgccggaaatcacgacggcggaaagcgtgagctcgtccacaaacacgacgtcgttaacagtgatgaaaagacacgagtgccaatactgcggtaaagagtttgcaaattctcaagccttaggaggtcaccaaaacgctcacaagaaggagaggttgaagaagaagaggcttcagcttcaagctcggcgagccagcatcggctattatctcaccaaccaccaacaacccataacgacgtcatttcagagacaatacaaaacgccgtcgtattgtgcattctcctccatgcacgtgaataatgatcagatgggtgtgtacaacgaagattggtcgtcgaggtcgtcgcagattaacttcggtaataatgacacgtgccaagatcttaatgaacaaagcggtgagatgggtaagctgtacggtgttcgaccgaacatgattcagttccagagagatctgagttctcgttctgatcagatgagaagtattaactcgctggatcttcatctaggttttgccggagatgcggcataacaaat

SEQ ID NO: 4165 - DNA, 1285 bp, Artificial Sequence
  P1499 (35S::G375)
aaaaactctcactctccctcaaactaaacaaacatacagaacacaaaatgggtctcacttctcttcaagtttgcatggattctgattggctccaggaatccgagtcatcaggaggaagcatgttagactcttcaacgaattctccgtcagcagccgacatactagcagcttgcagcactagaccacaagcctcggccgtggctgtagccgctgcagctctgatggacggtggaaggaggctgcgtccacctcacgaccatcctcaaaagtgtcctcgttgcgagtcaacacatactaagttctgttactacaataactacagcctctctcagcctcgttacttctgcaagacttgtcgccgttactggacaaaaggcggaactctaaggaatattccggttggtggtggatgccgtaaaaacaagaaaccatcttcctctaattcctcctcctccacttcttccggcaaaaaaccatccaacatcgttaccgccaatacctctgatcttatggctttagcacattctcatcaaaattaccaacattctcctctagggttttcacattttggtgggatgatggggtcttactcaactccggagcatggtaacgttggtttcttggagagcaagtatggcggtttgctttcgcagagccctagacctattgatttcttggacagtaagtttgatctcatgggagtgaacaatgacaacctggtcatggttaatcatggaagtaacggagatcatcatcatcatcataatcatcacatgggtctgaatcacggtgtaggtcttaacaacaacaacaacaatggtggatttaatgggatttctacgggaggcaatggaaatggtggtggtctcatggatatatcgacatgccaaagacttatgctatctaattatgatcatcaccattacaatcatcaagaagatcatcaaagggtagcaacaataatggatgtgaagccaaatccgaagttgttatcgcttgattggcagcaagatcaatgctactccaatggtggtggtagcggaggcgcaggaaaatccgacggtggtggatacggcaatggtggttatatcaacggtttaggttcgtcgtggaatggtttgatgaatggctatggaacgtccactaaaacaaactccttggtttgataagttaatcagaacttcttttttcttgtcgtcatcaactagtagtagtagtaatagtagttggagactagagaagcacttcaaattatttatgggtttgtttgctaagccagttttac

SEQ ID NO: 4166 - DNA, 1381 bp, Artificial Sequence
  P1500 (35S::G1255)
tgttggttgtgtagactttgtatacaatgatgaaaagtttggcgaatgctgttggagcgaagacggcgagggcttgcgacagctgcgtgaagagacgtgcacggtggtactgcgcggccgacgatgcttttctttgccagtcttgcgacagtttggtccattcagcaaaccctcttgctcgccgccacgagagagtccgtttgaagacggctagcccggcggtcgtaaagcatagcaaccactcatcagcttctcctccacatgaggtcgccacgtggcatcacgggtttactcgtaaagctcgaacgccacgtggctctggtaagaaaaacaattcgtcgatatttcatgacttggttcctgatattagtattgaggatcagacagacaactatgagcttgaagagcagctgatctgtcaagtgccggttctagatccgttggtgtctgagcagttcttgaacgatgtcgttgagcccaagatcgagtttcctatgatcagaagtggtttgatgatcgaggaggaggaagacaacgctgaaagttgtcttaatggatttttcccgaccgacatggagcttgaggagtttgctgctgacgtggagactctgctcggtcgcgggttagacacggagtcgtatgccatggaggagctagggttatctaattcagagatgttcaaaatcgaaaaagatgagattgaagaagaagtagaagagataaaagccatgagcatggatatatttgatgatgatcgaaaagacgtggatggaacagtaccgtttgagctaagctttgattacgagtcgtcacacaagacgtccgaagaagaggtaatgaagaacgttgaaagtagtggtgaatgtgttgttaaggtgaaagaggaagaacataagaatgttctgatgctaagattaaactatgactcggtgatatccacttggggaggtcaaggtccaccgtggagttcaggagagccaccggaacgagacatggacatcagcggttggccagccttttccatggtggagaatggaggagaaagtactcatcagaagcaatacgttggtggatgtttaccatcaagtgggtttggagatggaggtagagaagctagagtttcgagatacagagagaagaggaggacaaggttgttttctaagaagatacggtacgaggtacgtaaattgaatgcagagaaaagaccacgaatgaaaggaagattcgtgaagagagcctcgctcgctgctgctgcttcaccattaggtgttaattactgaatagttaatatctattcatgttatatctcactttacaaatttcggtgaatcttttttcttctgaaacaacagaagttattttggcacttaattgtgctttg

SEQ ID NO: 4167 - DNA, 476 bp, Artificial Sequence; identical to SEQ ID NO: 757
  P1505 (35S::G1012)

SEQ ID NO: 4168 - DNA, 1818 bp, Artificial Sequence; identical to SEQ ID NO: 1173
  P1506 (35S::G1793)

SEQ ID NO: 4169 - DNA, 765 bp, Artificial Sequence; identical to SEQ ID NO: 1377
  P1507 (35S::G2115)

SEQ ID NO: 4170 - DNA, 1019 bp, Artificial Sequence; identical to SEQ ID NO: 1389
  P1508 (35S::G2130)

SEQ ID NO: 4171 - DNA, 947 bp, Artificial Sequence
  P1510 (35S::G974)
ttaattccctcctctcagaaatctacacagaggttttttattttataaacctctttttcgattttcttgaaaacaaaaaatcctgttctttactttttttacaagaacaagggaaaaaaatttctttttattagaaatgacaacttctatggatttttacagtaacaaaacgtttcaacaatctgatccattcggtggtgaattaatggaagcgcttttaccttttatcaaaagcccttccaacgattcatccgcgtttgcgttctctctacccgctccaatttcatacgggtcggatctccactcattttctcaccatcttagtcctaaaccggtctcaatgaaacaaaccggtacttccgcggctaaaccgacgaagctatacagaggagtgagacaacgtcactggggaaaatgggtggctgagattcgtttaccgaggaatcgaactcgactttggctcggaacattcgacacggcggaggaagctgctttagcttatgacaaggcggcgtataagctccgaggagattttgcgcggcttaatttccctgatctccgtcataacgacgagtatcaacctcttcaatcatcagtcgacgctaagcttgaagctatttgtcaaaacttagctgagacgacgcagaaacaggtgagatcaacgaagaagtcttcttctcggaaacgttcatcaaccgtcgcagtgaaactaccggaggaggactactctagcgccggatcttcgccgctgttaacggagagttatggatctggtggatcttcttcgccgttgtcggagctgacgtttggtgatacggaggaggagattcagccgccgtggaacgagaacgcgttggagaagtatccgtcgtacgagatcgattgggattcgattcttcagtgttcgagtcttgtaaattagatgttgccataggggtattttaggg

SEQ ID NO: 4172 - DNA, 1124 bp, Artificial Sequence
  P1511 (35S::G504)
cgtcgacctcttgacgatcatgagactgatttcgtgaaaatatcgtcattatatcaaattagaagttgatggaaaacatgggggattcgagcatagggccgggccatccgcatctccctcccgggtttcggtttcacccgactgatgaggaactagtagttcattacctcaagaagaaagcagattctgttccacttccagtctcaatcatcgcagagattgatctttacaagtttgatccttgggagcttccaagcaaggcgagttttggagagcacgagtggtacttctttagtcctcgggatcggaagtatccaaatggggttaggccaaaccgggcagcaacttccggttattggaaagcaacgggaaccgataaaccgatatttacgtgcaatagtcacaaggttggtgtcaagaaagcgcttgttttttacggtggaaagcctcctaaagggataaaaacagattggatcatgcatgaatatcgcctcactgatggtaaccttagcactgcggctaagccgcctgacttaaccacgacaaggaaaaactcactacggctagacgattgggttctatgtaggatctataagaagaatagttcacaaagaccaacaatggagagagtattacttagagaggatctaatggaaggcatgctctcaaaatcatctgctaattcttcttctacatcagtactagacaacaacgacaacaataataacaataacgaagaacactttttcgacggtatggtcgtttcttcagacaaacgttccttgtgtggtcaataccgaatgggccacgaggcctcaggatcatcttcattcggatctttcttatcgagcaagaggtttcatcatacaggtgatctcaacaatgataactacaatgtctcttttgtttcgatgcttagtgagattcctcagagttcggggtttcatgcaaatggtgttatggatacgacgtcgtctctagctgatcatggggttttaagacaggcgtttcagcttcctaacatgaactggcactcataatctatatagatatatatgtgtgtatcatatatgtatctatgcaggcctaatatagtttacacataaatcatctggggcggccgc

SEQ ID NO: 4173 - DNA, 2022 bp, Artificial Sequence; identical to SEQ ID NO: 713
  P1517 (35S::G958)

SEQ ID NO: 4174 - DNA, 1382 bp, Artificial Sequence
  P1520 (35S::G963)
tcccatatcatatcttcttcagagtctcatctttttaattatatatagtcaccttcatatgtcgtacgaacatcctaatcactttaattaatctctctcatctctttctctctcgttttctaacgcatacactttgaatggcgcccatgagtttgcctccaggattcaggtttcatcccactgatgaagaactggtggcttactatcttgataggaaggtcaacggccaagccattgagctcgagatcatcccagaagttgatctttataaatgcgagccatgggacttgcctggtacgatccaactctttatatctctctctatatatggttcagcttgtttatgtcaatctgacgttatagattacatatattggtcatgatgcattcatacatatgatattggaggttttatgagttatttatttggataatacgcggaacagaaaagtcatttttgccgggaaacgacatggaatggtacttttacagcacaagggataagaagtatccaaatggctctaggacgaaccgtgcgacccgagcgggttactggaaggccacggggaaagatcgtacagtagaatcaaagaagatgaagatgggaatgaagaagacactggtttattatagaggaagggctcctcatggccttcgtactaattgggtcatgcatgaatatcgtctcacgcacgctccttcctcctccttgaaggtaaattatttcccatgcacaaacttctattaacatatatatctatattcatttctgatctaatttttttttttttgataaaccatatcgactaatattaatgttgatctaaaacaggagtcgtatgcattgtgccgagtgtttaagaagaacatacaaattccaaagagaaaaggggaagaagaagaagcagaagaagagagcactagtgtaggaaaagaagaggaagaagaaaaggagaagaagtggagaaaatgtgatggtaattatattgaagacgagagcttgaaaagagcatccgcggagacatcttcatcagagctaactcaaggggtccttttagacgaagcaaacagctcatccatatttgctcttcatttctcatcttctcttctggacgatcatgatcatcttttctcaaactattctcatcagcttccatatcatcctcctcttcaactccaagatttccctcaactttctatgaacgaagcagagattatgtcaatccaacaagactttcaatgcagagactctatgaacgggacacttgacgaaatcttctcttcttccgccactttccccgcttccctttgataaatccatatctcatactatcatctagtacttcttttctcaacttatttaaatatactcgggtacttca

SEQ ID NO: 4175 - DNA, 982 bp, Artificial Sequence
  P1523 (35S::G1453)
cgtcgacgcgaaataaatcctagaaaataactatcaatatgatgaaggttgatcaagattattcgtgtagtataccgcctggatttaggtttcatccgacagatgaagaacttgtcggatattatctcaagaagaaaatcgcctcccagaggattgatctcgacgttatcagagaaattgatctttacaagatcgaaccatgggatctacaagagagatgtaggatagggtacgaggagcaaacggagtggtatttcttcagccatagagacaagaagtatccgactgggactaggacaaaccgagccaccgtggccggtttctggaaagcaacgggccgggacaaggcggtttacctcaactccaaacttatcggtatgagaaaaacgcttgtcttttaccgaggtcgagcgcctaatggccaaaagtccgattggatcattcacgaatactacagcctcgagtcacaccagaactctcctccacaggaagaaggatgggtagtgtgtagagcatttaagaaacgaacgaccatcccaacaaaaaggaggcaactttgggatccgaactgcttattctacgacgacgccactctcttggaacctctcgacaagcgagccagacataatcctgattttaccgccacaccgttcaagcaagaactactctccgaggccagtcacgtccaggatggagatttcggatctatgtaccttcaatgcatcgatgatgatcaattctcccagcttcctcagctcgagagcccctctcttccgtcggaaataactccccatagtactactttttctgagaacagtagccggaaagatgacatgagctccgagaagaggatcactgactggagatatctagataagttcgtggcgtctcaatttttgatgagtggagaagactaaaaaaggctttcctatgcatgcatgcactagaaacgtcgtcgcattttggatttacatgcggccgc

SEQ ID NO: 4176 - DNA, 1142 bp, Artificial Sequence; identical to SEQ ID NO: 997
  P1528 (35S::G1463)

SEQ ID NO: 4177 - DNA, 1066 bp, Artificial Sequence; identical to SEQ ID NO: 999
  P1530 (35S::G1465)

SEQ ID NO: 4178 - DNA, 1633 bp, Artificial Sequence
  P1533 (35S::G2505)
tatataatcaagaacttgtagctgcttagaaagaaaggcagtggttaaatgttttaagctgtctttagttggagacaagagaaggaaaacgtaaatcgaaatgggttcttcgtcgaacggaggagtgccacctggtttccggtttcatccgacggacgaagagcttctccattactacttgaagaagaaaatttcttaccaaaagtttgagatggaagtcatcagagaggttgacttaaacaagcttgagccttgggatttgcaaggtactcttttacttaaacatatcacaattcattcattgcttattaattggtatcattttttgagactttgataggtcttcttgacttcttaattattggatatatatatacatgaacagttcattgttatacaattctctaatttgtatgttatctttttattttttggaagagagatgcaagataggatcaacaccacaaaacgaatggtacttcttcagccacaaggacaggaaatatccgacggggtcaaggaccaaccgtgctactcatgcagggttctggaaggcgacgggacgtgacaagtgcataaggaactcttacaaaaagataggaatgaggaagacacttgtgttctacaaaggtagagctcctcatggccaaaagactgattggatcatgcatgagtaccgtcttgaagacgctgatgatcctcaagccaaccctagtgtatgtcttttatttgagcaatatttaaattataatatagatcattatcattattcaaacagtgaaatttcacagaatctctgatttccatactaggttttctaatattgttgttaaatatgaatataataaatgtcttttaataagtatctacaacaattttccgaagctttaaaaatagtttgagagtgcactgtatattatgctgcgttaaattcaatttattggttaggaaggtggtctattaaatttaatccatttgcaacatattttatacgatcatgtaggaagatggatgggtggtatgtagagtgttcatgaagaaaaatttgttcaaggtagtaaatgaaggtggctcaagcattaactcattggaccaacacaaccatgatgcatctaacaacaaccatacacttcaagctcgtagctttatgcaccgagacagtccataccagctagtacgtaaccacggagccacgacattcgaactcaacaagcctgaccttgctcttcatcaatacccaccaatcttccacaagccagcttcacttggatttgactactcttcaggacttgcaagagacagtgagagtgcggctagtgaagggttacaataccagcaagcgtgtgagccgggtttagacgttggtacatgtgagacagtggctagtcataatcatcaacaaggtctaggtgaatgggcaatgatggatagacttgtgacttgtcacatgggaaatgaagattcctctagagggattacgtatgaggatggtaacaacaattcttcctctgttgttcagccagttcccgcgacgaaccagcttacattgcgtagtgagatggatttctggggttattctaaatagatgtttatatgtctttcttatgagtctacgacaatataagtgttggtt

SEQ ID NO: 4179 - DNA, 929 bp, Artificial Sequence
  P1534 (35S::G1765)
cgtcgacaagaatgacttgattggtgttctaaagagatcgatgtagtgaagatgagtggcgaaggtaacttaggtaaggatcatgaagaagaaaacgaagcaccacttcctgggttcaggtttcatccgacggatgaagagcttttaggatactatcttcgaagaaaagtagagaacaaaaccatcaaactcgaacttatcaaacagatcgatatctataagtacgatccttgggatcttccaagagtgagcagcgtcggagaaaaggagtggtacttcttctgcatgagaggtaggaaatacaggaatagcgttcgaccaaaccgagtgaccggttcaggtttctggaaagccactggtattgataaaccggtttactccaatcttgactgtgttggtctcaagaaatctctggtttactatcttggttcagccggtaaaggcaccaaaaccgattggatgatgcatgaattccgcctcccctccaccacgaaaaccgactctccagctcaacaagcagaggtatggacactttgcagaatcttcaaacgagtcacatctcaaagaaacccaaccatcttaccaccaaaccgaaaaccggttatcactttaaccgacacttgttctaagaccagcagcttagattccgaccacacgagccaccgtacagtagattccatgtcccacgagccgccgcttccacagccacagaatccttattggaaccaacatatagttggttttaatcaaccgacatatactggtaatgataataacctcctgatgagtttctggaacggcaacggtggagatttcataggagactcagcaagttgggatgaacttagatctgttatagatggcaacactaaaccctagtaataaagtttccttttttcagctttgtacaaaaagataaaacaaacggc

SEQ ID NO: 4180 - DNA, 1822 bp, Artificial Sequence
  P1537 (35S::G1452)
gttctgtccaataatacataaccacgttatcatttttgtcctttactatctcattacactcttctgttattcgcccaattcttacagtcattgtccacgtcatcctttttccctctgaagccgccaaatatcaaaaaacacaaaacctttacccgaagcaaagtagctgcacacttgccatttataaggcatgtttcttcatctaaagcaaagtattttcgagttcctgagccaaaaagatcaaacaatgtctaaagaagctgagatgtcgatcgcggtgtcggctttgttccctggttttagattctctcctactgatgttgaacttatctcgtactatcttcgtcgtaaaatcgatggtgatgagaactctgttgctgtgattgctgaggtcgagatttacaagttcgagccgtgggacttgccaggttttacttcggttttctttctctttatgtttactttggttcactaatttgaatgtttgtgcctataaaacagaggaatcgaaactgaaatcggagaacgagtggttttacttctgcgcgagggggaggaagtacccgcacgggtcacaaagccggcgagccacacagctaggatattggaaagcgaccggtaaagagcggagtgttaaatccgggaaccaagttgttggaaccaagagaacgcttgtatttcatatcggtcgggctcctcgtggcgagagaacggagtggattatgcatgaatactgcatccatggagccccacaggttcttaaaactttcattttgaataggttgagttttaatgttttgagatatattgaaatttggatttcacaggatgcattagtggtgtgccggttaagaaaaaatgctgattttcgggctagttcgacccaaaaaatggaggatggtgttgtgcaagacgatggctacgttggccaaagaggtggtttggagaaggaggacaaatcctactatgaatctgagcatcagataccaaatggtgacatcgcagaatcatcaaatgttgttgaggtcagcttgcttttgaggaatgtgtcttttaacgatgtttaatactggtaaaattatccgctccaatcttaatcgaaaccacattaaattcaatatagttccgaaaacagaaccgattaagaaactaaaaccaaaccaacaccatagtaccatactataacggattcatagtacattagatttcactaaagttgttattttactaaagcagattctaaacttaaaacgtaacaaaccaatatatccaatgtttggtttttattttggctactaatattataactcaatagactaaaccaacacttgggctgaacatccttagttttcttgtactggtagagtttagagtttgtaactgaagttgatctctttctattgcgatgcaggatcaggccgataccgatgatgattgttacgccgagattctgaacgatgatataataaagctcgacgaagaagcgttgaaagctagccaagcgtttcgaccaactaatccaactcatcaagaaacaatatcaagcgagtcatcgagtaagaggtcaaaatgtggtataaaaaaagaatcaacggaaacaatgaattgttacgctttgttcaggatcaagaacgttgccggaaccgactccagctggagattcccgaacccgttcaaaatcaagaaagatgatagccagagattgatgaagaatgttctggccactactgttttcttggctatcttattttctttcttttggactgtattaatagctaggaactaaagctagttacgacatacatattatttatacataaat

SEQ ID NO: 4181 - DNA, 736 bp, Artificial Sequence
  P1540 (35S::G898)
cggctcaaggtgattatagcgatcatcgaatcaaattgattgaagaggtacaaaggttagttactttgagctgaaagatgaacacgtcagaggtgagagtacctcgaggaaatcgacggaggaaagctgtgattgatctgaatgcggtacctgttgatcaagaagggacctctgcttctgttagaactcttacggtgcctattacaccgtctcagcctgctcctacgatgattgatgtcgatgctattgaggatgatgttattgaatcatccgctagtgcttttgctgaagctaaaagcaaatcaagaaatgcacgtcggagacctttgatggttgatgtagagtcaggaggtacgactagattccctgccaacataagcaacaaacgcagaaggattccttctagtgaatctgtcatcgactgtgagcatgcctctgtaaatgatgaagtcaacatgtcttcgagagtgtctagatcaaaggctccagctcctccaccagaagagccaaagtttacatgtccaatctgcatgtgtccctttacggaggagatgtcaaccaagtgcggtcacatcttctgcaagggatgtataaagatggcaatatctcgccagggcaaatgccctacttgtaggaaaaaggttactgcaaaagagctgattcgagttttccttccaaccactagatgagtggtccggcaacatcaccagcaaccctgtctaatggtttatcagac

SEQ ID NO: 4182 - DNA, 1431 bp, Artificial Sequence
  P1541 (35S::G1531)
cctctaaacgtcttcagccaaggtatatatatttctccatttcgttaatcttaattatggttgtgtgtttttttttcttcttctgatttctcatattgatatctcactgatctgttgaaatttgggggataatattgttaacgggtgaccaatacagtactacagttacatgaaccaatatagttttgtaacggacccaaattcttgcaattttgttgaatacccttttgttctcatatattaaataaaaaatttgatttattttcgttcattctaaggtttgagaggtttaggccttggcgatgattgggccgtcatgtttatcgtatagagagtaggcctgttcagaaatctttgccatcaattacttactttatgtactcgtcgttggtctggaatttgagtctaagctcattaataagaggattgacaaataaacaaacgttttgatacgtatagttcaattttgattttctaatcatccaagtatccaactattttctatttggttttcttatgaatttgtttattgcataatttcttgatgaatgttgttttttggttaatgttgaaataatttagcttgagagaagcctaaagaaaatctaaaatgtgtgagtcaagcaacaaagtcagagtatcgccatacccgcttcggtcttcgaggaccgacaaacacaaggcgtcagagtcgcctattgagacaggttgggaggatgtgcggtgtgtaatctgcatggaaccacctcacaatgctgttcttttgacatgctcttcttcttctagtggatgtcatccttacatgtgcgatacgagtgttcgtcactccaattgtttcaagcagttccgcagaaaaaccataaaaaagcgcctataccccaagaccttacattgtcctctctgtagaggtgaagtatccgagacgacaaaggtgacgagcactgcaagaagatttatgaatgctaaaccgaggtcttgctccgtagaggattgcaaattctctgggacgttttctcagcttactaagcacttgaaaactgagcatcgcggtattgtgccaccaaaggtcgatccactgagacaacagagatgggaaatgatggagagacattctgaatacgttgaactcatgactgcagctgggatttcgcgtatggctgaggtgatgcaacaacagcttccccaggatcagaatcatcctcatgtgtttcaagtgaccgttaatggaaccatatggaatctaattgatccgagtcagggaaggaatggattaggcatcaccaactatagcgcaatgcagtttgtaccattaagcataaatcacagtagaactctgtgaagaattctaacttgtttagtgaaaacccaagtttaaagttttgatgatctcaatatcttactttcattagttgggatccataatgtttagaa

SEQ ID NO: 4183 - DNA, 1081 bp, Artificial Sequence
  P1549 (35S::G1835)
ctgcacaccactactaagaacaacagagctagagagacttgcaataattgtaaaacatgattggaacaagcttccccgaggatcttgattgtggcaacttctttgacaacatggatgatctcatggactttcccggtggagatatcgatgtcggtttcggcataggtgactccgactctttccctaccatctggaccactcatcacgacacgtggcctgccgcttctgatcctctcttctcttccaacaccaactctgattcatcacctgagctctatgttccgtttgaggacattgttaaggtggaaagacctccaagctttgtagaggaaacattggttgagaagaaggaagattcgttttcgacaaacactgattcatcatcttctcatagccaattcaggagctcaagtccagtgtcggttctcgagagcagctcctcctcgtctcaaaccaccaacacaacctcccttgttctccctggaaagcacggtcgtccacgcacaaaacgccctcgtccacctgtccaggataaagatagagtcaaagacaatgtgtgcggtggtgactcgcgcctcatcattagaataccgaaacagtttctctctgatcacaacaagatgatcaacaagaagaagaagaagaaggccaagattacttcttcctcttcttcgtccgggattgatcttgaagtcaatggaaacaacgtcgattcgtattcttcagagcaatatccgcttaggaaatgtatgcactgtgaggtcaccaagactccacagtggaggcttggtccaatgggtccaaagacactttgcaatgcgtgcggtgtacgttacaaatcagggaggcttttcccggagtaccgtccagctgctagtccaacatttactccagctcttcactcaaactcacacaagaaagtggctgaaatgagaaacaagagatgcagtgatggtagctacataaccgaagagaatgatctgcaagggctgattccgaacaatgcctacattggcgtagactaaaacatagagaagatgattcgatttccatgcgttgaagtgattagatatgccaggag

SEQ ID NO: 4184 - DNA, 2004 bp, Artificial Sequence
  P1554 (35S::G1777)
gtactttatcacctccgtcgttctataatactctcttccgtcaatcatatcatttgtcgacaatttcattctgatcagtttaaaaattgatccatggatgataatttaagcggcgaggaagaagattactattactcctccgatcaggaatctctcaacgggattgataatgatgaatccgtttcgatacctgtttcttcccgatcaaatactgtcaaggttattacgaaggaatcacttttggctgcacagagggaggatttgcggagagtgatggaattgttatcggttaaggagcaccatgctcggactcttcttatacattaccgatgggatgtggagaagttgtttgctgttcttgttgagaaagggaaagatagcttgttttctggtgctggtgttacacttcttgaaaaccaaagttgtgattcttccgtttctggttcttcttcgatgatgagttgtgatatctgcgtagaggatgtaccgggttatcagctgacaaggatggactgtggccatagcttttgcaataactgttggactgggcattttactgtaaagataaatgaaggtcagagcaaaaggattatatgcatggctcataagtgtaatgctatttgtgatgaagatgttgtcagggctctagttagtaaaagccaaccagatttagctgagaagtttgatcgttttcttcttgagtcgtatatcgaagataacaaaatggtgaagtggtgtccgagtactcctcattgtgggaatgccatacgtgttgaggatgacgagctctgtgaggttgaatgctcttgtggtttgcagttctgtttcagttgttcatctcaagctcactccccttgctcttgtgtgatgtgggaactatggagaaagaagtgctttgatgagtccgagactgttaattggataactgttcacacaaagccgtgtcccaaatgtcacaagcctgttgaaaagaatggtggatgcaatctcgtgacttgtctttgtcgacaatctttttgttggttgtgtggtgaagctactggaagggaccacacttgggctagaatctcgggtcatagttgtggtcggttccaagaagataaagagaaacaaatggagagagcgaaaagggatctcaagcggtatatgcattatcataaccgatacaaagcacatatcgactcctccaagctagaggctaagcttagtaataatattagtaaaaaggtgtctatttcagaaaagagggagttacaacttaaagacttcagctgggctaccaatggactccatcggttatttagatcaagacgagttctttcatattcataccctttcgcattttacatgtttggagatgagctgtttaaagatgagatgagctctgaggaaagagaaataaaacaaaatctgtttgaggatcagcagcagcagcttgaggctaatgttgagaaactttctaagttcttggaggaaccttttgatcaatttgctgatgataaggtcatgcagataaggattcaagtcatcaatttgtcagttgcggtcgatacactctgcgaaaatatgtatgaatgcattgagaatgacttgttgggttctctgcaacttggcatccacaacattactccatacagatcaaacggcatagaacgagcatctgatttttatagttcccagaattccaaggaagctgttggtcagtcttcggattgtggatggacgtccaggctcgatcaagctttggagtcagggaagtcggaagacacaagttgctcttccgggaagcgtgctagaatagacgaaagttacagaaacagccaaaccaccttactagatttaaacttgccagcggaagccattgagcggaaatgaacacttatccttcttcacctcccaataacaccctttttgtccaaataaagtgtgttacccggatatttatagctctaaacccaatcccctctgcttaatttgtcagtgaccttacctaaccctcttcag

SEQ ID NO: 4185 - DNA, 917 bp, Artificial Sequence
  P1556 (35S::G580)
ctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatc

SEQ ID NO: 4186 - DNA, 1449 bp, Artificial Sequence
  P1557 (35S::G571)
caaacatcatcctatatatagacttctcttcatcatcatcaaatgcaaggtcatcaccagaatcatcatcaacacttatcatcatcctccgccacgtcttcccatggaaacttcatgaacaaagatgggtatgatattggagagatagacccatcactcttcctctatcttgatggacaaggacatcatgatcctccatcaactgctccttctcctttacatcatcatcacacaactcagaatttggcgatgagacctccaacatcgacgctcaacatctttccatctcagcctatgcacatagagccacctccttcttctacacacaataccgataatacaagattagttccggctgctcaacctagtggttccactcgaccagcttctgacccgtccatggacttgaccaatcattctcagtttcatcaacctcctcaaggttctaaatccatcaagaaggaagggaaccgcaagggtcttgcctcatcggaccatgacatacctaaatcgtcagaccctaaaacattgagaagactagcacaaaacagagaagcagcaagaaaaagcagattacgtaaaaaggcttatgttcagcaactcgagtcatgtaggatcaaactgacccaactagaacaagagattcaacgggccagatcccaaggcgtattctttggagggtctcttataggaggagatcaacagcaaggtggactacccattggccctggcaacatcagctctgaagcagcggtgttcgatatggaatatgcgaggtggctggaggagcagcagaggctattaaacgaactaagggtggcaacacaagaacacttgtccgagaacgagcttaggatgtttgtggacacatgtttagctcattatgaccatttgattaacctcaaggctatggtcgctaagaccgatgtcttccacctcatttctggagcatggaaaactccagctgaacgttgcttcttgtggatgggtggtttccgtccatcggagatcattaaggtgattgtgaaccagatagaaccattgacggagcaacagatagttgggatatgtgggctgcaacagtccacacaagaggccgaggaggctctctcgcaaggcctcgaggcgttgaatcaatcactttccgatagcattgtctctgactccctcccgcctgcctccgcaccacttcctcctcatctatccaatttcatgtcacacatgtccttagctctcaacaagctctctgctctcgagggcttcgttctccaggcggataatttgaggcaccaaacgatccataggctgaaccaattgttgacgacccgtcaagaagcacggtgtcttctagccgttgcggagtacttccaccgtcttcaagctctaagttctctctggctagcccgtcctcggcaagatggataatactaaaacaactgatgaaggaaa

SEQ ID NO: 4187 - DNA, 1431 bp, Artificial Sequence
  P1559 (35S::G1806)
ccatcatcttcttcttctaagaatcaacaacaatgcagagcagcttcaaaaccgttcctttcactcctgatttctactctcagtcttcttacttcttcagaggagatagttgtcttgaggagtttcatcaaccagtcaatggttttcaccatgaagaagctatcgatttaagtccaaatgtcactattgcttcagctaacttacactacacgacgtttgatacggttatggattgtggtggtggtggtggtggtggcttgagggagagacttgaaggaggagaagaggagtgtttggacacagggcaactagtgtaccagaaagggacaagattagtaggaggaggagtaggagaagtgaacagcagttggtgtgattcggtttcagctatggctgataacagtcaacatactgacacttccacagatattgatactgatgacaagactcagttgaatggaggtcatcaagggatgctattggctacaaattgttcagatcaatccaatgtgaaatctagtgatcaaaggacacttcgtcgacttgctcagaaccgggaggctgctaggaaaagtcggttgaggaaaaaggcatatgttcagcaacttgagaatagtcgaatcaggcttgcacagctagaggaagagctcaaaagagctcgccaacagggatctttggttgaaagaggagtttcagcggatcacacgcatttggcagccggaaatggtgtcttttcatttgaattggaatatacacgttggaaggaagaacatcaaagaatgatcaacgacttaagatcgggtgtgaattcgcagttaggtgacaacgatctacgcgttctagtggatgctgtgatgagtcactatgatgaaatattcaggctaaagggaattggtactaaagttgacgtctttcatatgctctcaggcatgtggaagacacctgccgagagatttttcatgtggttaggtggatttagatcatcagagttacttaagatattggggaaccatgtggatccattgacggaccagcagttgataggcatttgcaaccttcagcaatcgtctcaacaagcagaggatgcattgtcacaaggcatggaagctctacaacaatcacttctcgagacgctttcttctgcttcaatgggtccaaactcttcagcaaatgttgcagattatatgggtcatatggctatggctatgggcaaacttggcactcttgaaaacttccttcgccaggctgatttattgaggcaacaaactctgcaacagcttcacagaattctcaccacacgacaagctgctcgcgcctttttggtcatccacgattatatttctcggcttagagcacttagctctctatggttagccagacctagagactaaataaaaagcctgcatgagtcatgatgaccaaaggaaaagg

SEQ ID NO: 4188 - DNA, 1073 bp, Artificial Sequence
  P1560 (35S::G1322)
acattcgtcgatcatcttcccgcctcgagtatctctctctctctctctcttctctgttttctttattgattgcatagacaaaaatacacacatacacaacagaaagaaagatggagacgacgatgaagaagaaagggagagtgaaagcgacaataacgtcacagaaagaagaagaaggaacagtgagaaaaggaccttggactatggaagaagatttcatcctctttaattacatccttaatcatggtgaaggtctttggaactctgtcgccaaagcctctggtatgcttttttgcacgtattcaaatcatgttttgatgatgttttctatgtatataactaaattttgtttttattttgttaataaggtctaaaacgtactggaaaaagttgtcggctccggtggctgaactatctccgaccagatgtgcggcgagggaacataaccgaagaagaacagcttttgatcattcagcttcatgctaagcttggaaacaggtcttatatagtttcactaattagtacatgcatacgtaaatcaaatcttaaacctaattttatgttgctaagtaatattataatatgcattaggtggtcgaagattgcgaagcatcttccgggaagaacggacaacgagataaagaacttctggaggacaaagattcagagacacatgaaagtgtcatcggaaaatatgatgaatcatcaacatcattgttcgggaaactcacagagctcggggatgacgacgcaaggcagctccggcaaagccatagacacggctgagagcttctctcaggcgaagacgacgacgtttaatgtggtggaacaacagtcaaacgagaattactggaacgttgaagatctgtggcccgtccacttgcttaatggtgaccaccatgtgatttaagatatatatatagacctcctatacatttatatgccccagctgggtttttttgtatggtacgttatttggtttttctattgctgaaatgtcgttgcatttaatttacatacgaaaagtgcattaaatcattaaatcttcaatacatatggaggtggtgtttgag

SEQ ID NO: 4189 - DNA, 943 bp, Artificial Sequence
  P1562 (35S::G1789)
aaggactctgcgacatctgtgcaacatatcatttcctcagaatctctttcttttctaggtttattactacacaaaaccaaacatcatcaactttagttactaaacaatggcatcaggctcaatgtcttcttatggctctggctcatggactgttaagcagaacaaagcctttgagcgtgctctagcagtctatgaccaagacactccggaccgttggcacaatgttgctagagctgttggtggtaaaacaccagaagaagctaagagacagtatgaccttctagttcgtgacatcgaaagcatcgagaatggtcacgtgccattccctgactacaagactactacaggaaacagcaacagaggcaggctgcgtgatgaggaaaagaggtatatttgttgcaatctaataagacacaatttatgctaataacaagtaatcaactttgtttatccataatagcccactataagatacttctatagacaagttctattccaataccatgacaagaaaacataaagggcatgtctgtttcagcataaagcttgttactttacagagattctcttgactttctatcatattgagttataagaggctctaaatcagccaagtgttctcttctcagtgttcttcaggctttatcagaaccaaaactaaaagctcccacaacaaaaaatatgcctagaaatagaatcattccttgtcaatatggtatctaatattaatcgattcccaaatctttcccctaagaaacttccagaaacaaaaataaacccactcatcatcatgaaactcgaaccaacaacattttaacctgtttaacattttttttttttattgcaggatgagaagcatgaagctgcagtgagacaagaagcaacaaaacctaactacgtatgatcgtcaaaataaaagagaatcacttcagagagatgtgtt

SEQ ID NO: 4190 - DNA, 892 bp, Artificial Sequence
  P1564 (35S::G211)
actcatagagatcacgaaaccctagtggaaagagagaaagctttgttgaagacggcggagatgatgtcatgtggtgggaagaagccagtgtctaagaaaacaacgccgtgttgcacgaagatggggatgaagagaggaccatggacggtggaggaagacgagattcttgtgagcttcattaagaaagaaggtgaaggacggtggcgatcgcttcctaagagagctggtttactcagatgtggaaagagctgtcgtctacggtggatgaactatctccgaccctcggttaaacgtggaggaattacgtcggacgaggaagatctcatcctccgtcttcaccgcctcctcggcaacaggtggtcattgatcgcgggaaggataccgggaaggactgataatgaaattaagaactattggaacactcatcttcgtaagaaacttttaaggcaaggaattgatcctcaaacccacaagcctcttgatgcaaacaacatccataaaccagaagaagaagtttccggtggacaaaagtaccctctagagcctatttctagttctcatactgatgataccactgttaatggcggggatggagatagcaagaacagtatcaatgtctttggtggtgaacacggctacgaagactttggtttctgctacgacgacaagttctcatcgtttcttaattcgctcatcaacgatgttggtgatccttttggtaatattatcccaatatctcaacctttgcagatggatgattgtaaggatgggattgttggagcgtcgtcttctagcttaggacatgactagatacaggaagatatatagttgatcgaatcttgatgtcttctatatctaccatgcttcaagaaggggtcacagatgcgatgcg

SEQ ID NO: 4191 - DNA, 1818 bp, Artificial Sequence
  P1567 (35S::G1246)
ttgaatcggcaagggaagaagctatgatcatgtacggaggaggaggagcagggaaggacggtggatccaccaatcacttatcagacggaggagtgatattgaagaaaggtccatggacggcggcggaagatgagatacttgctgcgtacgttagagagaacggtgaagggaattggaacgccgttcagaaaaacacaggtttggctcgttgcggcaaaagctgccgtcttcgatgggccaatcacctccgaccaaatctgaaaaaaggctctttcaccggtgacgaagaacgtctcatcattcagcttcatgctcagcttggtaacaaatgggctcgcatggctgctcagttaccgggaagaacagacaacgagattaagaactattggaacacgagattgaaacgacttcttcgccaaggacttcctctttatcctccagatattatccctaaccatcaactccatccacatccacatcatcaacaacaacagcaacataaccatcatcatcatcatcatcaacaacaacaacaacatcaacaaatgtattttcaaccacaatcttcacaacgaaacacaccatcatcttcccctcttccatctccaacaccagcaaacgcaaagtcctcatcatccttcacttttcataccacgactgctaacctcctccatccacttagccctcacactccaaacacaccatctcaactctcttccacaccgcctccaccaccactttcctctcctttatgttcccctcgcaacaaccaatacccgacccttcccctctttgccctcccgcgttcccaaatcaacaacaacaacaacggaaatttcactttccctagacctccacctctccttcaaccgccttcatcactcttcgcaaaacgttacaacaatgctaacactcctcttaattgcatcaaccgcgtctcaaccgcaccattttcccctgtttcaagagactcctacacttcctttcttacattgccttacccttccccaaccgctcaaaccgctacttaccacaatactaataacccttactcttcctctccttccttctctttaaacccttcttcttcttcttaccctacatcaacttcttccccaagctttcttcactcccattacactccttcttccacctcatttcataccaacccagtttactccatgaaacaagagcagctcccttcaaaccaaattccccaaatagatggcttcaataacgtcaacaacttcacagacaacgagagacagaatcataaccttaacagttccggtgctcatagaagaagtagtagctgcagcctcttagaggatgtcttcgaagaggccgaagctttagcctctggaggcagaggccgacctccaaaacgaagacaactcacagcttctcttccgaaccacaacaacaacaccaacaacaacgacaacttcttctcggttagtttcggacattatgattcttctgacaacttatgttccttgcaagatttgaaatcaaaggaagaagagtctcttcaaatgaacacaatgcaggaggacatagctaagcttcttgattggggaagtgatagtggagagatctctaatggacaatcatctgttgtcactgacgacaatcttgttcttgatgttcatcaattagcttcactattcccggctgattctacagccgtcgtagccgcaacaaacgaccaacacaacaagaataataacaataattgttcctgggatgacatgcagggaataaggtagaaactatgtctgaaaagaatctacggccaagatcaagaactaacaaagc

SEQ ID NO: 4192 - DNA, 485 bp, Artificial Sequence; identical to SEQ ID NO: 7
  P1572 (35S::G2133)

SEQ ID NO: 4193 - DNA, 941 bp, Artificial Sequence
  P1576 (35S::G21)
ctctctaaagcttcttctctcataacaatggcaagacaaatcaacatagagagtagtgtttctcaagttacctttatctcctccgccatccccgccgtatcttcctcctcctccatcaccgcttccgcctcattgtcctcttcacctactacatcttcctcttcttcgtcatcaacaaattctaacttcattgaggaagacaactctaaaagaaaagcatctcgaagatcattgtcatcgttagtctccgttgaagacgatgatgatcaaaacggtggaggtgggaaacggcgaaagaccaacggtggagataaacatccgacgtatagaggagtgaggatgaggagttggggaaaatgggtgtcggagattagagagccgagaaagaaatcaagaatctggctcgggacttatccaacggctgagatggcagctcgagctcatgacgtagcggctttagccattaaaggtacaacggcttacctcaattttcccaagttagccggcgagcttcctcgtccagtcacaaattctcctaaagacattcaagccgccgcctctttagcggccgttaactggcaagattcggtcaacgatgtgagtaattctgaagtggctgaaatagttgaagccgagccgagtcgagccgtggtggctcagttgttttcttcggacacaagcacgacgacgacgactcagagtcaagagtattcggaagcttcgtgtgcttcgacttcggcgtgtacggacaaagacagtgaggaagagaagctgtttgatttgccggatttgtttaccgatgagaatgagatgatgatacgaaacgatgcgttttgctactactcgtccacgtggcagctttgtggagccgatgctgggtttcggcttgaagagccgttttttctatctgaatgactaaagtacccctctcgagagagctc

SEQ ID NO: 4194 - DNA, 539 bp, Artificial Sequence; identical to SEQ ID NO: 1399
  P1577 (35S::G2138)

SEQ ID NO: 4195 - DNA, 1561 bp, Artificial Sequence
  P1578 (35S::G1838)
cagattttcaactaggaaaaaagttacaatcttttttgatggctcctccaatgacgaattgcttaacgttttctctgtcaccaatggagatgttgaaatcaactgatcagtctcacttctcttcttcttacgacgattcttctactccttatctcatcgataacttctatgctttcaaagaagaagctgagatagaagctgctgctgcttcaatggcggattcaacaaccttatctacttttttcgatcattctcagactcagattccaaagctggaagatttcctcggtgattcctttgtccgttactctgataaccaaacagagacccaagactcttcttctctcactccattctacgatccacgtcaccgcaccgttgccgaaggagttacagggttcttctctgatcatcatcagccagatttcaagacgataaactcgggaccagaaatcttcgatgactcaacaacttccaacatcggtggtactcatctctccagtcacgtggtggagtcatcaacgacggcgaagttagggtttaacggtgattgcaccaccaccggaggagttttgtctctaggggttaacaacacatcagatcaacctttgagctgtaacaatggcgagagaggtggaaacagtaacaagaagaaaacagtttctaagaaggaaacatcagatgattcaaagaagaagattgtcgaaacattgggacaaagaacttcaatttatcgtggagtcacccgacatagatggactggaagatacgaagcgcatctatgggataacagctgtaggagggaaggtcaagccagaaaaggacgtcaagtgtacttaggtggatatgacaaggaagatagagcagctagagcctatgacttggcagctttaaaatactggggttctactgctactacaaattttccggtctcgagttattcaaaagaacttgaggaaatgaatcacatgaccaagcaagagtttattgcatctcttaggaggaaaagtagcggtttttcgagaggagcttcaatatatagaggtgtcacaaggcatcatcaacaaggtcgctggcaagcaagaatcggccgtgtcgcaggaaacaaagatctttacctcggaacctttgcaaccgaagaggaagcagcagaggcttatgacattgcagccataaagttcagaggaatcaacgcagtaactaactttgagatgaacaggtatgacattgaagctgtcatgaatagttctttacctgtaggaggagcagctgcgaaacgccacaaactcaaactcgctcttgaatctccttcttcatcatcctctgaccataacctccaacaacaacagttgcttccgtcctcttctccctcggatcaaaaccctaactcaatcccatgtggcattccatttgagccttcagttctctattaccaccagaacttctttcagcattatcctttggtctctgactctacaattcaagctcctatgaaccaagctgagtttttcttgtggcctaaccagtcttactaaatcatttggttcgttcttgcttagac

SEQ ID NO: 4196 - DNA, 1749 bp, Artificial Sequence
  P1581 (35S::G1919)
tctctagctctttactaatttatcgatttgtctttctgatttttgttttgtcattttcaagaaaacaatggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggtttcaccctaattttgacaattacatagaattggatttctctgtttaagtcttgatccttactcttttgtgttatcttgctttaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaaaaacacgagggaggcatgaaactttcaacttgtatattttacaattgttttgctctgcaatataataatcgagac

SEQ ID NO: 4197 - DNA, 1011 bp, Artificial Sequence
  P1582 (35S::G2084)
gcgcatccatcttcaccgtttcatacgaaactctttacgaggagtctctctttacttttctctctctctcaaagaaagaaagaaaagcctcttttaattttctccggccagagtgtgtgggatgcacaaggaaagagggaaaatgccggtttctagcaacagaaatagagtatcgccatacccgcttcgctcttgcaggaacaagaaacaaaaagaagtcgaggcgtcgtcgtcacctgttgagttagagagtgttagtgaatgggaggatgtgaggtgtgtgatttgtatggagcctcctcacaatgctgtcctcttgcaatgctcttctttctccaaaggatgtcgtgcttacatgtgtgatacaagcgctcgtcactccaattgtttcaagcagtaccgcagaagcaacagctcaagccgttgtagtggcaagactctacattgtccctactgcagaggagaggttcaggggactatgaagtcgacttgtgctcggagattcatgaatgctagaccgaggtgttgtactgttgacaagtgcgatttctcagggacctatgcgcagctgaaaaatcacttgaaaactgagcatcctggttttacaccgccaaagttagacccttgggagcaacacatgtgggagcagttggagagagaggcggagtacattgaaatgctcaacgctcgtcagagatgggatgcagaacagagattgttggcgacttctctccatcagcttccatatcgtcatcccatgattgatctcaactttgatgcgttggtgcataatctgtttcttggtgcgtccatggagagccgtgcaagcaccgacaattacccggctcacataccccgtctggagttccatgcccccatgtatcccagatggacgccatgaagattctgagtgccagagtctatgaggaattcttccaaaagttttgatgtctcttgatttttatcataatgtaatgttcttgtagcgacatcagttcttgttctaggcat

SEQ ID NO: 4198 - DNA, 1148 bp, Artificial Sequence
  P1584 (35S::G1917)
cttcactccaacgtgaaacctgcaaactgaacttatctcttcatattttctttagcttctcttaattttacacttagggttttcaaaccagtagagagagagagaagtgtgtaagagcgatgatgcagactccgtacactacttcaacgcaggggcaatattgtcattcttgtggaatgttccaccaccatagccaaagctgctgctacaacaacaacaacaactccaacgccggttcttactcgatggtcttctccatgcaaaacggtggcgttttcgagcagaacggtgaggactatcatcactcttcctccctcgttgactgcactctctctcttggaactccttctacgaggctttgtgaggaagatgagaaacgtagacgctctacttcatctggtgcttcttcttgcatctccaacttttgggacttgattcacaccaaaaacaacaactccaaaacggcaccgtacaataacgttccttctttctccgctaacaagccaagtcgcggttgttccggtggtggtggtggcggaggaggcggtggcggaggtgactctcttctcgctagacgctgtgccaactgtgacactacttctactccactatggaggaatggtcctagaggccctaagtccctatgcaacgcatgcggcattcgtttcaagaaggaagagagaagaactactgcggctacaggaaacaccgtcgtcggagctgcaccggttcaaaccgaccagtacgggcatcacaactctggctacaataattaccatgctgccactaataacaacaataataatggtactccgtgggctcatcaccactcgacgcagagggttccgtgtaattatccggcaaatgagatcaggttcatggatgattacggcagtggagtagcaaacaacgttgaatccgacggtgctcacggcggtgttccgttcctttcttggaggcttaatgtagcggatagggcaagtcttgtccatgactttaccagatgaaaggagaatagaaaacgacgttagattctcttaaaatttccatgtggtttaattatgtctaattaaaaaaaaaccaagaaaatatttctgaaaaaaatagaagtgtatatcgagagacgatgttgatgtttattgatagtg

SEQ ID NO: 4199 - DNA, 778 bp, Artificial Sequence
  P1600 (35S::G1471)
ttttacaaaacaaattgtaatggagaaccaatctatgtcttcatcaagctcctccacacacaaacatgatcaaaaactcaaaagttccgttgtggccatggaggtcctggaggagaaggagacagtgaacaatccgccccagtattataataagatctacatctgttacttgtgcaagagagcgttcccaacccctcatgcccttggcggtcacggaaccacccacaaggaggaccgagaattggagaggcaacagatcgagtcaaggctttctaacaaagacaagtctaacttgctctttggtgggtcttcacaagatgttttatcaaatgataatcaccttggactctctcttggtccattgaagtccatagaaggtagcagcagcagcaacaacgttaacccattgcttaatgttggagtccctagaggaaccacagatatgaacatgaacaactatagctcacatgctttatcaactgatgatattaatcttgatcttactcttggtccatctaagtccataggagatagcaacaatatcattaataacaacactaactcatccttcgatgggaatctgatcattcccgttcgtcctcgtgtgtctagataccattttgttgctgggaacccccttgattcaatctctagaaacattcctccttctattacttttcctcatctaaacatcaatctttctcatgattcgttttctttacaagagaatggttcgggctctagtcactcataaagtctcatctcaaatgggaaagaa

SEQ ID NO: 4200 - DNA, 948 bp, Artificial Sequence
  P1602 (35S::G1474)
caatattgtcatatacaatggagaaacctggtggcttctggatccccaagaaaagcaacaaagagtcatcttgggaagagctggcctttgcagaagacgatgccgccggatctttgtggccgccaagatcttatacgtgtagcttctgccggagagaatttaaatcggctcaagccctcggtggccatatgaacgttcaccgaagagacagagcacggcttaagcaagccgacgaccaatacttattccccaaatcttcttcgtctccagagtatccatctcataaagatagcgataatattcatgaaacctcttgctatactttggtttttaacaccaaacctaattattttaagactcaacactcttgtgttattgatctttcttcgtcttcttctttaccatatttgactccttctagggtttcttctggtttgcctggaaagcaacatacttcttcttctcctccttctttcgttgtagaaccttccaagaactctaaatatattccctcttcttccccatggtcgtgcccaagtactgttgtggagcaaaagagttgtgatctatatgaaattccggctatggaaggagaaaagaagagaaagactgagagtgatgtgccaaaaatcgggcataaagcaaaacttagtcttggaaacaccactgatctctcggtgagtatgaatctggtcatccaccaaagttttccgattactgctcacggtagcgatgaagagattggtagggtggatatccgtaaaagaagacgaagacatgagagtccgtcgcagcagtcgattttcatttcaagtttatcttgtaagagtgacataattacaagaaacgaggaaagcaaacacaaaggtgatcgctttgaggatttagatcttgagcttaggctagggactgatccaccaaaaggaatttgattgatggaccgatgaa

SEQ ID NO: 4201 - DNA, 480 bp, Artificial Sequence
  P1603 (35S::G1476)
tccctcgatcgatcgaggcaacacacacatatatatatatatatatggagtgtgagagatcatcgtcgtccacgtcatcagaaaccggagcagtcaggcaccgtcgtacgtcgtcgtcgtcagtctccaccgtgacgagacgaatgtacgagtgcactttctgcaaaagaggtttcacaaacgcacaagctttaggtggtcatatgaacatccatcgacgtgaccgtctcaacaaggccaaggtgcaaaacgatgctgacgtggcactctcgcaaactcatagatgtttccacgtggcgtctgaccttggaggctacgagcaagtagactccgtcgtgttgaggacgacgacctcgaactacatccaacacttacgaatcggctcgatggctacaaggagagaaaacgtcgtcgttgaaggaaatgaaatcgatttggagctgcgtcttggcttatgatcatcaacttcttaccctctat

SEQ ID NO: 4202 - DNA, 390 bp, Artificial Sequence
  P1605 (35S::G1478)
aaagatgtgtagagggtttgagaaagaagaagagagaagaagcgacaatggaggatgccaaagactatgcacggagagtcacaaagctccggtaagctgtgagctttgcggcgagaacgccaccgtgtattgtgaggcagacgcagctttcctttgtaggaaatgcgatcgatgggtccattctgctaattttctagctcggagacatctccggcgcgtgatctgcacgacctgtcggaagctaactcgtcgatgtcttgtcggtgataattttaatgttgttttaccggagataaggatgatagcaaggattgaagaacatagtagtgatcacaaaattccctttgtgtttctctgattttatgttttgtttttcgcgtaattaagatt

SEQ ID NO: 4203 - DNA, 1293 bp, Artificial Sequence
  P1606 (35S::G1480)
acgtgtcaacttttcattcgatctagatggatacccatggaccccacatggatagactcattgacacgctcatgtgaagccaatagtaacaccaaccacaaaagaaagagagagagagagacactgaaacatagagagaagaaaaagaagaggtttagagagagaaaaatggcgtcaaagctctgcgattcgtgcaaatcagcgacggcggcgttatactgccgaccagacgcagcgtttctatgcttaagctgcgattcaaaagtccacgcggcgaacaaactcgcgtcacgacacgcgcgcgtgtggatgtgtgaagtgtgcgagcaagcaccggcacacgtcacgtgcaaagcagacgcggccgcgttatgcgtcacgtgcgaccgtgatatccactcggctaatccgttagctcgccgtcacgaacgcgttcccgttactccgttttacgattccgtctctagtgacggttccgttaaacacaccgccgttaatttccttgacgactgttacttctccgatatagatggtaacggaagccgtgaagaagaggaggaagaagctgcttcgtggctgttacttcccaatccaaagactacaacgacggcgacggcggggatcgttgctgttacttcagctgaggaagttccgggagatagtccggagatgaacactggtcaacagtatttgttctcggatccggatccgtatctggatctggattatggaaatgttgatccgaaggtggaatcgttagagcagaatagctccggtactgatggtgttgttccggtggagaatcggacggttaggattccgacggtgaacgagaattgctttgaaatggattttaccggaggatctaaaggctttacttatggtggtggttacaattgcatcagtcacagcgtgtcatcatcgtcgatggaagtgggagtggtgccagatggtggttcggtggctgatgtatcgtatccttacggtggtcctgcaaccagtggagctgatccggggacacagcgggctgttccgctgacttcagctgagagagaagcgagggtaatgaggtacagagagaagaggaagaacaggaagtttgagaagactataaggtatgcttcaaggaaagcgtatgcggaaatgagaccgagaatcaagggacggtttgcgaagcggacggatacaaatgagagcaatgatgtggttggtcatggtggtatctttagtgggttcggacttgtacctacattttagatattgagagagggagagactctaaaatggaagaga

SEQ ID NO: 4204 - DNA, 1138 bp, Artificial Sequence
  P1608 (35S::G931)
tgacagacacatgtatcatcaatcttctctgttgaagcagagagagagagagctaattgttgcctctgagtcacatggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatctgagccggtggaatctggtaatgtgtacgttcctacaaaaaaagggaagtcatccttggctgctacttcgcttattagct

SEQ ID NO: 4205 - DNA, 1177 bp, Artificial Sequence
  P1610 (35S::G2343)
taagttactatgaggagctactaatcatgggtcatcactcatgctgcaaccagcaaaaggtgaagagagggctttggtcaccggaagaagatgagaagcttattagatatatcacaactcatggctatggatgttggagtgaagtccctgaaaaagcagggcttcaaagatgtggaaaaagttgtagattgcgatggataaactatcttcgacctgatatcaggagaggaaggttctctccagaagaagagaaattgatcataagccttcatggagttgtgggaaacaggtgggctcatatagctagtcatttaccgggaagaacagataacgagattaaaaactattggaattcatggattaagaaaaagatacgaaaaccgcaccatcattacagtcgtcatcaaccgtcagtaactactgtgacattgaatgcggacactacatcgattgccactaccatcgaggcctctaccaccacaacatcgactatcgataacttacattttgacggtttcactgattctcctaaccaattaaatttcaccaatgatcaagaaactaatataaagattcaagaaacttttttctcccataaacctcctctcttcatggtagacacaacacttcctatcctagaaggaatgttctctgaaaacatcatcacaaacaataacaagaacaatgatcatgatgacacgcaaagaggaggaagagaaaatgtttgtgaacaagcatttctaacaactaacacggaagaatgggatatgaatcttcgtcagcaagagccgtttcaagttcctacactggcgtcacatgtgttcaacaactcttccaattcaaatattgacacggttataagttataatctaccggcgctaatagagggaaatgtcgataacatcgtccataatgaaaacagcaatgtccaagatggagaaatggcgtccacattcgaatgtttaaagaggcaagaactaagctatgatcaatgggacgattcacaacaatgctctaactttttcttttgggacaaccttaatataaacgtggaaggttcatctcttgttggaaaccaagacccatcaatgaatttgggatcatctgccttatcttcttctttcccttcttcgttttaaattaatgtttaaatcacagcaaataaactccgctaatt

SEQ ID NO: 4206 - DNA, 920 bp, Artificial Sequence
  P1613 (35S::G674)
tgtcaaagattgtcatcaccaatctacatatttttattcatcagtaccatacacgtatatataatatatctatttcaaatataaaaaaaaactttggaaaaataaaaatggtgtttaaatcagaaaaatcaaaccgggaaatgaaatcaaaggagaagcaaaggaagggattatggtcacccgaggaagatgagaagcttaggagtcatgtcctcaaatatggccatggatgctggagtactattcctcttcaagctggattgcagaggaatgggaagagttgtagattaaggtgggttaattatttaagacctggacttaagaagtctttattcactaaacaagaggaaactatacttctttcacttcattccatgttgggtaacaaatggtctcagatatcgaaattcttaccaggaagaaccgacaacgagatcaaaaactattggcattctaatctaaagaagggtgtaactttgaaacaacatgaaaccacaaaaaaacatcaaacacctttaatcacaaactcacttgaggccttgcagagttcaactgaaagatcttcttcatctatcaatgtcggagaaacgtctaatgctcaaacctcaagcttttcgccaaatctcgtgttctcggaatggttagatcatagtttgcttatggatcagtcacctcaaaagtctagctatgttcaaaatcttgttttaccggaagagagaggattcattggaccatgtggccctcgttatttgggaaacgactctttgcctgatttcgtgccaaattcagaatttttgttggatgatgagatatcatctgagatcgagttctgtacttcattttcagacaactttttgttcgatggtctcatcaacgagctacgaccaatgtaaatgttcggagagaggtccaagtaaata

SEQ ID NO: 4207 - DNA, 2461 bp, Artificial Sequence
  P1617 (35S::G2348)
cagaaattgaagactctcagatgtcttctctgtcgcaatcgccaccaccgccggagatggatatccaacccccggcattggttaacgatgatccttccacttattcctccgctttatgggattggggagatctccttgacttcgccgcagacgaacgccttctcgtcgatcaaattcatttccctcccgttctctctcctcctctaccgcctctgattccgacgcaaactccggcggaatctgaattagatccttctccggaagaatcgggttctggttcggatcgggttaggaagcgagacccgaggttgatttgttccaatttcattgaaggtatgcttccttgttcgtgtcctgagcttgatcagaaattggaagacgccgagcttccgaagaagaaacgggttcgcggcgggtcgggcgtggctcgatgtcaggttccggattgtgaagcggatattagcgagctcaaagggtaccataagaggcatagggtttgtctccgttgcgctaccgccagctttgttgtgcttgatggagagaataagagatactgtcaacagtgtggaaagtttcatttgctcccggactttgatgaaggaaaacgcagctgtcggagaaagctagagcgtcacaacaacagacggaaaaggaaacctgtagataaaggaggtgttgctgcagaacaacagcaagtgctttcacagaatgataacagcgtcattgatgttgaggatggaaaagatatcacatgctctagtgaccagagagctgaagaagagccttcattgatttttgaagatcggcatattaccactcagggttctgtaccttttacccgaagcatcaacgcagacaactttgtctctgttacaggttcgggtgaagctcaaccagatgaaggaatgaatgacacaaaatttgaacgttcaccttctaatggcgacaacaaaagtgcttactcaactgtgtgtccaactggtcggatctcttttaagctctacgattggaatccagcggagttcccacggagactacgtcatcaaatatttcaatggttggccaacatgcctgttgagctggagggctatatccgcccaggatgtacaattttgactgtctttatagcaatgccagagattatgtgggcgaagttatctaaagatcctgtggcatatctggatgaatttattcttaaacctggaaagatgctgtttggaagaggctcgatgactgtctatttgaacaacatgattttccgtcttattaaaggtggaacaactttaaagagagtcgatgtaaaattagagtcgccgaaacttcagtttgtgtatcctacatgttttgaagctggaaaaccaattgaactcgttgtatgtggacaaaaccttctgcaacctaaatgccggtttctcgtgtctttttctgggaagtacttgccacataactattctgttgtacctgcaccggaccaggatgggaagcgttcttgtaataacaagttctacaagatcaatattgtgaattctgaccctagtctctttggccctgcctttgtcgaggttgaaaatgaatctggcctatcaaatttcatacctctaattattggagatgcagctgtttgttccgaaatgaaactaatagagcagaagttcaatgctacactctttccagagggacaagaagttactgcttgctcttctttgacttgctgttgcagggattttggggagagacagagcacctttagtggcctcttgttagatattgcatggtcggtgaaggtaccctctgcagaacgcactgagcaacctgtgaaccgatgtcagataaaaagatacaacagagtgttgaattatctgatacagaataactcagcgtcgatcttaggaaacgtactgcacaatttggaaactttggtgaagaaaatggagccagacagtcttgttcactgtacctgtgactgcgacgtgaggcttctacatgaaaatatggatttggcgagtgatattcacagaaagcatcaaagccctatagagtcaaaggtgaatcctccttcgtcaggttgctgttgtgtgagtagtcagaaggacataccatcaagaatattaaacttcaataaggatcctgaagcaggattagattgtaaagagagaatacaggcagactgttcaccagatagcggcggaaaagagactgatcctctgttaaacaaagaggttgtcatgaacgtaaatgacataggagactggccaaggaagtcgtgtataaaaacgcactcagctttagcattcaggtcccgtcaaactatgttcttaatcgctacgttcgctgtctgttttgctgtctgtgcggttctctaccatccaaacaaggtcacacagcttgcagtggcaatccgaatgagattggtacacaaaatttgaatataagttcaacggcagagactctcattaacgtg

SEQ ID NO: 4208 - DNA, 761 bp, Artificial Sequence
  P1618 (35S::G2347)
atccaccatcatcttcccacgaatacaacttaaagctttaccagaaaatggagggtcagagaacacaacgccggggttacttgaaagacaaggctacagtctccaaccttgttgaagaagaaatggagaatggcatggatggagaagaggaggatggaggagacgaagacaaaaggaagaaggtgatggaaagagttagaggtcctagcactgaccgtgttccatcgcgactgtgccaggtcgataggtgcactgttaatttgactgaggccaagcagtattaccgcagacacagagtatgtgaagtacatgcaaaggcatctgctgcgactgttgcaggggtcaggcaacgcttttgtcaacaatgcagcaggtttcatgagctaccagagtttgatgaagctaaaagaagctgcaggaggcgcttagctggacacaatgagaggaggaggaagatctctggtgacagttttggagaagggtcaggccggagagggtttagcggtcaactgatccagactcaagaaagaaacagggtagacaggaaacttcctatgaccaactcatcattcaagcgaccacagatcagataaaccctcccgctctctctcttctgtcatctacatatgctctatctacactcttattagacaaataatggcatctaacaatgtcaagaaaagttggtcatggtattaaatcctacacggatatataactataaacctctagtcccctctatgctgtcctgtaatgaatat

SEQ ID NO: 4209 - DNA, 1143 bp, Artificial Sequence
  P1619 (35S::G1645)
gtcgacctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtggc

SEQ ID NO: 4210 - DNA, 1159 bp, Artificial Sequence
  P1620 (35S::G2340)
ctacatctctttctctatctctagcttctatttttaatacattcaagaatcaagaatggtacggacgccgtgttgtagagcagaagggttgaagaaaggagcatggactcaagaagaagaccaaaagcttatcgcctatgttcaacgacatggtgaaggcggttggcgaacccttccggacaaagctggactcaaaagatgtggcaaaagctgcagattgagatgggcgaattacttaagacctgacattaaacgtggagagtttagccaagacgaggaagattccatcatcaacctccacgccattcatggcaacaaatggtcggccatagctcgtaaaataccaagaagaacagacaatgagatcaagaaccattggaacactcacatcaagaaatgtctggtcaagaaaggtattgatccgttgacccacaaatcccttctcgatggagccggtaaatcatctgaccattccgcgcatcccgagaaaagcagcgttcatgacgacaaagatgatcagaattcaaataacaaaaagttgtcaggatcatcatcagctcggtttttgaacagagtagcaaacagattcggtcatagaatcaaccacaatgttctgtctgatattattggaagtaatggcctacttactagtcacactactccaactacaagtgtttcagaaggtgagaggtcaacgagttcttcctccacacatacctcttcgaatctccccatcaaccgtagcataaccgttgatgcaacatctctatcctcatccacgttctctgactcccccgacccgtgtttatacgaggaaatagtcggtgacattgaagatatgacgagattttcatcaagatgtttgagtcatgttttatctcatgaagatttattgatgtccgttgagtcttgtttggagaatacttcattcatgagggaaattacaatgatctttcaagaggataaaatcgagacgacgtcgtttaatgatagctacgtgacgccgatcaatgaagttgatgactcctgtgaagggattgacaattattttggatgagttatattgatgatgatgaaaatttgcatttggcatgtaaatcaattagagtttgatttgctatggtgtttttagtttgtgtgtgtagtgtgtttcgaccgt

SEQ ID NO: 4211 - DNA, 1120 bp, Artificial Sequence; identical to SEQ ID NO: 1385
  P1625 (35S::G2124)

SEQ ID NO: 4212 - DNA, 812 bp, Artificial Sequence
  P1627 (35S::G2344)
ttattctaagtagcttgacttgtttagtttaaatatgaggttaatgattttgtggggatttgatagttctggttcttgagtttatttaaaataggtttaccaggatcatgtactgactctgttctttggaacttttcagaattctgcttcggacattaagctcatgagtcatgacttcttcaatccatgagctttctgataacattggaagtcatgagaagcaagaacagagagattctcatttccaaccaccaatcccttctgcaagaaattatgaatcaattgttacaagtttagtctactcagacccggggactacaaattccatggcacctggacaatatccatatccagatccttactacagaagcatatttgcaccgcctccacaaccgtataccggggtacatctacagttgatgggagtgcagcaacaaggcgttcctttaccatctgatgcagtcgaggaacctgtttttgttaacgcaaagcaataccacggtatactaaggcgcagacaatcaagagcaagacttgagtctcagaataaagtcatcaagtcacgtaagccgtatttgcatgaatctcggcatttgcatgcgataagacgaccaagaggatgtggcgggcggtttctaaatgccaagaaggaggatgagcatcacgaagacagtagtcatgaagaaaaatccaaccttagcgctggtaaatccgccatggctgcttctagtggtacatcttgagaaggtcctacaagtagctttgttgtattttggctctgtttggtctcagatcatctatgtcttttagtg

SEQ ID NO: 4213 - DNA, 794 bp, Artificial Sequence
  P1636 (35S::G1752)
aaaaaaaacttatggaatattcccaatcttccatgtattcatctccaagttcttggagctcatcacaagaatcactcttatggaacgagagctgtttcttggatcaatcatctgaacctcaagccttcttttgccctaattatgattactccgatgactttttctcatttgagtcaccggagatgatgattaaggaagaaattcaaaacggcgacgtttctaactccgaagaagaagaaaaggttggaattgatgaagaaagatcatacagaggagtgaggaaaaggccgtgggggaaatttgcagcggagataagagattcaacgaggaatggaattagggtttggctcgggacatttgacaaagccgaggaagccgctcttgcttatgatcaagcggctttcgccacaaaaggatctcttgcaacacttaatttcccggtggaagtggttagagagtcgctaaagaaaatggagaatgtgaatcttcatgatggaggatctccggttatggccttgaagagaaaacattctcttcgaaaccggcctagagggaaaaagcgatcctcttcttcttcttcttcttcttctaattcttcttcttgctcttcttcttcgtctacttcttcaacatcaagaagtagtagtaagcagagtgttgtgaagcaagaaagtggtacacttgtggtttttgaagatttaggtgctgagtatttagaacaacttcttatgagctcatgttgatcttgtaattgatttcagcaaaagccactattaaactttaattttgtgata

SEQ ID NO: 4214 - DNA, 851 bp, Artificial Sequence
  P1637 (35S::G917)
ttagggttttagaaagatagatcgattgaagatgaggaaaggtaagagagtgataaaaaagatagaggagaaaataaagagacaagtgacattcgcaaagagaaagaagagtctaatcaagaaggcatatgaactctctgttctctgcgatgtccaccttggtctcatcatcttctctcactccaacaggctctacgatttctgctccaactctaccagcatggagaatctcatcatgagataccaaaaggaaaaagaaggtcaaaccactgcagaacacagtttccactcggatcagtgttcagattgcgtgaagacgaaggaatcaatgatgagagagatagagaatcttaagctgaatcttcaattgtacgacggacatggcttgaatctcttgacctacgacgagctcctttcttttgagctccatctcgaatcttctctacaacatgctcgagctcgcaagtctgagttcatgcatcagcagcagcagcaacaaacagatcaaaagcttaagggaaaagaaaagggtcaaggaagctcttgggagcagctgatgtggcaagcagagagacagatgatgacgtgtcaaagacaaaaagatcctgcgccggcgaatgaaggaggagttccttttttacggtggggaacaacccaccgacgttcttcacctccttaagctaccacaaccaggcccaaatacaggcccataacttctctctatctataaaaaacaactgatagtaaaaagtattgacccggtttggttcggttatgttgataccagactattaattaacttcggttagacgtatttacgacttgatgctatctagacctttttgcccttc

SEQ ID NO: 4215 - DNA, 1913 bp, Artificial Sequence; identical to SEQ ID NO: 601
  P1650 (35S::G789)

SEQ ID NO: 4216 - DNA, 1817 bp, Artificial Sequence
  P1654 (35S::G807)
gtctctgtctctgtaaaagatatttgagcttgagaagaacagaagaaacttccaggatcaatcaatcgatcaactttagtgaactaactcttgatttttcattcgaagttatggaatcggttcccgaatccgtaccatcgccgaactcgaatacaccgtcaataccaccgccggtgaactccgtaccgcctttcttgagtaaaacctacgacatggttgatgatccgttgaccaatgaggtcgtttcgtggagcagcgggaacaacagcttcgtcgtctggagtgccccggagttctcgaaggtgctcttgcccaagtatttcaagcacaacaacttctccagcttcgtcagacaagttaaatacttatggtttcagaaaagttgatcctgaccgatgggaatttgcaaatgaaggatttcttagaggccgaaaacaactactgaagagtattgtcaggagaaaaccttcgcatgtgcagcagaatcagcaacaaactcaagttcagagctcatctgttggtgcttgtgtcgaggtggggaagtttggaatagaagaagaagtggaaagacttaagcgggataagaatgttcttatgcaagaactcgtcaggttaaggcagcaacagcaagctactgaaaaccaactgcagaatgtgggacagaaagttcaggtgatggagcaaaggcaacaacaaatgatgtcgtttttagcaaaggctgttcaaagtccaggcttcttaaaccagttagtacaacagaataataatgatggcaacagacaaattccaggaagcaacaaaaagaggagacttcctgtagatgagcaggagaatcgtggtgacaatgtggctaatggtcttaaccgccagattgttagatatcagccgtcgataaacgaagcagcacaaaatatgcttcgacagttcttaaatactagtacctcacctcggtatgaatcagtttcaaacaatcctgacagtttcctattgggtgatgttcccagttctacctctgtagacaatgggaacccttcaagtagagtttctggagtaacattggccgagttttcacccaacacagttcagtcagcaacgaatcaagtacccgaagcaagtttggctcatcatcctcaagctggtctggttcagccaaatataggtcaaagtccggctcaaggagcagcacctgcagactcttggagccctgaatttgatttagttggatgcgagacagatagtggagagtgttttgatccaataatggctgttttagatgagtcagaaggcgatgcaatttctcctgaaggtgagggcaagatgaatgagttactggagggagtccctaagctgcccggaatccaagatccattctgggaacagttcttttctgttgaactcccagcgattgcagatacagacgatattctatcaggatcagtggagaataatgacttggtattggaacaagaaccaaacgagtggacccgtaatgaacaacaaatgaagtatcttactgaacaaatgggactgctttcctcagaagcacagaggaaataaagattttcaggggaggttgcaaaaggagatatgaaggaacgaggaatatatcagatggtgtgtataccctttacatttttacttaaatgaaaaaaaaccagagagaagaaacataaaagatttaccaccaagcttgtgaatagttagtagagatcggtttttgtgttgtttatattatacttttgtgtgaaaacgttcatcttgttcaattatcatctcactagtacggtaatctgttggtcactgaccggttaataacc

SEQ ID NO: 4217 - DNA, 1320 bp, Artificial Sequence; identical to SEQ ID NO: 1291
  P1657 (35S::G1948)

SEQ ID NO: 4218 - DNA, 898 bp, Artificial Sequence
  P1671 (35S::G681)
gaggtggtgaaacgtggcaatattagattggttttttagtttggttggctggagaaaatggggaggacgacatggttcgacgtcgacgggatgaagaaaggagagtggacggcagaggaagaccagaagctcggcgcttacatcaacgagcatggcgtttgtgattggcgttccctccccaaaagagctggtttgcagagatgtggaaagagctgcagattaaggtggcttaactatctaaagcctgggattagaagaggcaaattcactcctcaagaagaagaagaaatcatccaacttcatgctgttctcggaaacaggtgggcagccatggcgaagaagatgcagaatcgaacagacaatgatatcaagaaccattggaactcttgtctcaagaaaagactttcgagaaagggaatcgaccctatgacccacgagcccatcatcaaacacctcaccgtcaataccactaacgcagattgtggtaactcttccaccacgacgtccccgtcgacgacggaaagctctccttcctccggctcgtctcgtcttcttaacaaactcgccgcaggtatctcatctagacaacatagtctcgataggatcaagtacatcttgtcgaattcaataatcgaaagcagtgatcaagcaaaagaggaagaagaaaaagaagaagaagaagaagaaagagattcaatgatgggtcagaagattgacggtagtgaaggagaagatattcagatttggggcgaggaggaagttaggcgtttaatggagattgatgcaatggatatgtacgagatgacttcgtacgacgctgtcatgtacgagagtagtcacatacttgatcatctcttttgacttaatatagtgtgactgtgtgagtgcatgcatgttg

SEQ ID NO: 4219 - DNA, 736 bp, Artificial Sequence
  P1677 (35S::G1818)
taggttgagattcatatatgtaaagagatcacttcttaatcttatcctaccatatcttatatacgcttaattttcctttatatatgcaaacctccacataaaaatatctcaaacccaaacacttcaaacaaaaaaaaaatggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaattaatatttggattgggttttgtaaccgctgttgtgagaac

SEQ ID NO: 4220 - DNA, 1039 bp, Artificial Sequence
  P1678 (35S::G2007)
ggtgagcttaggtgcttataggcttttgacagaaatcttctaatttgtcaaatataaattaatgggaaggcagccatgttgtgacaagctcatggtgaagaaggggccgtggacggcggaggaagacaagaaactgataaactttatcttgaccaacggccactgttgctggagggctttgccgaagctggccggtctccgtcgctgtgggaagagctgccgtctacggtggaccaattatctccgacctgacttgaagagaggtcttctctccgacgccgaggaacagcttgtcatcgaccttcatgctcttctcggcaacagatggtccaagatcgctgcaagattaccaggaagaacagacaacgaaataaaaaatcattggaatactcatatcaagaagaagctccttaagatggaaatcgatccttcgacccatcaacctttaaacaaagtatttaccgatacaaacttagtcgataaatctgaaacttcatcgaaagccgacaatgtaaatgataataaaatcgtagagatcgatgggacaacgacaaatacaatagatgatagcattatcactcatcaaaatagttcaaatgatgattatgaattacttggtgatataattcataattatggagatttatttaatattctatggaccaacgatgaacctcctctagtcgatgatgcatcatggagcaatcataacgttggtattggaggaacagctgcagttgcagcctcagacaagaacaacactgctgccgaggaagatttcccggaaagatcatttgaaaaacagaacggcgaaagttggatgttcttggattattgccaagaatttggtgttgaagattttgggttcgagtgttaccatggttttggtcaaagctccatgaagacgggtcacaaggactagcatttgcaagaatacataacatatataccgatatactacataatatgtgtatataatttatacgtacgcataataaaagtaatgtaagaaaaatcatgtaaagcagtaaagaagcac

SEQ ID NO: 4221 - DNA, 915 bp, Artificial Sequence
  P1685 (35S::G1842)
agaaaaaaagcaaacacattttgggtccccggtggttaggatcaaattagggcacaaaccttatcggagaaagaagccatgggaagaagaaaagtcgagatcaagcgaatcgagaacaaaagcagtcgacaagtcactttctccaaacgacgcaaaggtctcatcgaaaaagctcgacaactttcaattctctgtgaatcttccatcgctgttgtcgccgtctccggttccggaaaactctacgactctgcctccggtgacaacatgtcaaagatcattgatcgttatgaaatacatcatgctgatgaacttaaagccttagatcttgcagaaaaaattcggaattatcttccacacaaggagttactagaaatagtccaaagcaagcttgaagaatcaaatgtcgataatgtaagtgtagattctctaatatctatggaggaacagctcgagactgctctgtcagtaattagagctaagaagacagaactaatgatggaggatatgaagtcacttcaagaaagggagaagttgctgatagaagagaaccagattctggctagccaggtggggaagaagacgtttctggttatagaaggtgacagaggaatgtcacgggaaaatggctccggcaacaaagtaccggagactctttcgctgctcaagtaatcaccatcatcaacggctgagctttcaccataaacttactcacagcctgattcagaagcttttacaaaattgtaaattataaaaagctgcataataatctcaacctttttatcttcctcgcgccaatgtggaaataaaggtaaaacaaaacgaagctcttttcttttatgcgaaagaattgtaaaactaagataaagctaccgatctttgttgtaccttagtagacaaatatcagagttcttgtgc

SEQ ID NO: 4222 - DNA, 2798 bp, Artificial Sequence
  P1687 (35S::G438)
cggggtacccaagccacgaccgtagaatcttcttttgtctgaaaagaattacaatttacgtttctcttacgatacgacggactttccgaagaaattaatttaaagagaaaagaagaagaagccaaagaagaagaagaagctagaagaaacagtaaagtttgagactttttttgagggtcgagctaaaatggagatggcggtggctaaccaccgtgagagaagcagtgacagtatgaatagacatttagatagtagcggtaagtacgttaggtacacagctgagcaagtcgaggctcttgagcgtgtctacgctgagtgtcctaagcctagctctctccgtcgacaacaattgatccgtgaatgttccattttggccaatattgagcctaagcagatcaaagtctggtttcagaaccgcaggtgtcgagataagcagaggaaagaggcgtcgaggctccagagcgtaaaccggaagctctctgcgatgaataaactgttgatggaggagaatgataggttgcagaagcaggtttctcagcttgtctgcgaaaatggatatatgaaacagcagctaactactgttgttaacgatccaagctgtgaatctgtggtcacaactcctcagcattcgcttagagatgcgaatagtcctgctggattgctctcaatcgcagaggagactttggcagagttcctatccaaggctacaggaactgctgttgattgggttcagatgcctgggatgaagcctggtccggattcggttggcatctttgccatttcgcaaagatgcaatggagtggcagctcgagcctgtggtcttgttagcttagaacctatgaagattgcagagatcctcaaagatcggccatcttggttccgtgactgtaggagccttgaagttttcactatgttcccggctggtaatggtggcacaatcgagcttgtttatatgcagacgtatgcaccaacgactctggctcctgcccgcgatttctggaccctgagatacacaacgagcctcgacaatgggagttttgtggtttgtgagaggtcgctatctggctctggagctgggcctaatgctgcttcagcttctcagtttgtgagagcagaaatgctttctagtgggtatttaataaggccttgtgatggtggtggttctattattcacattgtcgatcaccttaatcttgaggcttggagtgttccggatgtgcttcgacccctttatgagtcatccaaagtcgttgcacaaaaaatgaccatttccgcgttgcggtatatcaggcaattagcccaagagtctaatggtgaagtagtgtatggattaggaaggcagcctgctgttcttagaacctttagccaaagattaagcaggggcttcaatgatgcggttaatgggtttggtgacgacgggtggtctacgatgcattgtgatggagcggaagatattatcgttgctattaactctacaaagcatttgaataatatttctaattctctttcgttccttggaggcgtgctctgtgccaaggcttcaatgcttctccaaaatgttcctcctgcggttttgatccggttccttagagagcatcgatctgagtgggctgatttcaatgttgatgcatattccgctgctacacttaaagctggtagctttgcttatccgggaatgagaccaacaagattcactgggagtcagatcataatgccactaggacatacaattgaacacgaagaaatgctagaagttgttagactggaaggtcattctcttgctcaagaagatgcatttatgtcacgggatgtccatctccttcagatttgtaccgggattgacgagaatgccgttggagcttgttctgaactgatatttgctccgattaatgagatgttcccggatgatgctccacttgttccctctggattccgagtcatacccgttgatgctaaaacgggagatgtacaagatctgttaaccgctaatcaccgtacactagacttaacttctagccttgaagtcggtccatcacctgagaatgcttctggaaactctttttctagctcaagctcgagatgtattctcactatcgcgtttcaattcccttttgaaaacaacttgcaagaaaatgttgctggtatggcttgtcagtatgtgaggagcgtgatctcatcagttcaacgtgttgcaatggcgatctcaccgtctgggataagcccgagtctgggctccaaattgtccccaggatctcctgaagctgttactcttgctcagtggatctctcaaagttacagtcatcacttaggctcggagttgctgacgattgattcacttggaagcgacgactcggtactaaaacttctatgggatcaccaagatgccatcctgtgttgctcattaaagccacagccagtgttcatgtttgcgaaccaagctggtctagacatgctagagacaacacttgtagccttacaagatataacactcgaaaagatattcgatgaatcgggtcgtaaggctatctgttcggacttcgccaagctaatgcaacagggatttgcttgcttgccttcaggaatctgtgtgtcaacgatgggaagacatgtgagttatgaacaagctgttgcttggaaagtgtttgctgcatctgaagaaaacaacaacaatctgcattgtcttgccttctcctttgtaaactggtcttttgtgtgattcgattgacagaaaaagactaatttaaatttacgttagagaactcaaatttttggttgttgtttaggtgtctctgttttgt

SEQ ID NO: 4223 - DNA, 702 bp, Artificial Sequence
  P1688 (35S::G859)
acattgtgggtctccggtgattaggatcaaattagggcaccagccttatcggaggaagaagccatgggtagaaaaaaagtcgagatcaagcgaatcgagaacaaaagtagtcgacaagtcactttctccaaacgacgcaatggtctcatcgagaaagctcgacaactttcaattctctgtgaatcttccatcgctgttctcgtcgtctccggctccggaaaactctacaagtctgcctccggtgacaacatgtcaaagatcattgatcgttacgaaatacatcatgctgatgaacttgaagccttagatcttgcagaaaaaactcggaattatctgccactcaaagagttactagaaatagtccaaagcaagcttgaagaatcaaatgtcgataatgcaagtgtggatactttaatttctctggaggaacagctcgagactgctctgtccgtaactagagctaggaagacagaactaatgatgggggaagtgaagtcccttcaaaaaacggagaacttgctgagagaagagaaccagactttggctagccaggtggggaagaagacgtttctggttatagaaggtgacagaggaatgtcatgggaaaatggctccggcaacaaagtacgggagactcttccgctgctcaagtaatcaccatcatcaacggctgagctttcaccttaaacttacagcctgatt

SEQ ID NO: 4224 - DNA, 772 bp, Artificial Sequence
  P1689 (35S::G1843)
caaattaggtcagaagaattagtcggagaaaacagccatgggaagaagaaaagtagagatcaaacgaattgagaacaaaagctctcgacaagttactttctgtaaacgacgaaatggtctcatggagaaagctcgtcaactctcaattctttgtgaatcctccgtcgctcttatcatcatctctgccaccggaagactctacagcttctcctcaggtgatagcatggccaagatcctcagtcgttatgaattagaacaggctgatgatcttaaaaccttggatctagaagaaaaaactcttaattatctttcgcacaaggagttgctagaaacaatccaatgcaagattgaagaagcgaaaagcgataatgtaagtatagattgtctaaagtccctggaagagcagctcaagactgctctgtctgtaactagagctaggaagacagaactaatgatggagcttgtgaagacccatcaagagaaggagaagctgctgagagaggagaaccagagtttgactaaccagcttataaagatggggaagatgaagaagtctgtggaagcagaggatgcaagagcaatgtcaccggaaagtagctctgacaacaagccaccggagactctcctgcttctcaagtaaccaccatcaccaacgactgattcgaaaaataaaaattgtaaaaattatgatttgtagttcataaggaaagctacatactgtatgttaaaaatcctcttcttccccctgctacggaaaagtcatccaaggaga

SEQ ID NO: 4225 - DNA, 825 bp, Artificial Sequence
  P1690 (35S::G1844)
ggggattagatgtgtcggaagagtgaagccatgggaagaagaagagtagagatcaaacgaattgagaacaaaagcagtagacaagtcactttctgtaagagacgaaatggtctcatggagaaagctcgtcaactctcaattctctgtggatcctccgtcgctcttttcatcgtctcttccaccggcaaactctacaactcctcctccggcgacagcatggccaagatcatcagtcgttttaaaatacaacaagctgatgatcctgaaaccttggatcttgaagacaaaactcaggattatctttcacacaaggagttactagaaatagttcaaagaaagattgaagaagcaaaaggggataatgtaagtatagaatctctaatttccatggaagagcagctcaagagtgctctgtctgtaattagagctaggaagacagagttattgatggagcttgtgaagaaccttcaggataaggagaagttgctgaaagaaaagaacaaggttctagctagcgaggtggggaagctgaagaaaattttggaaacaggggatgaaagagcagtaatgtcaccggaaaatagctctggccacagcccaccggagactctcccgcttctcaagtaaccaccaatcatcaacggctgatttttcatcatcctgattcaaaaaaggtaaaaaaaattcatgtgtaaaaatcataaagaagctacatgttttaaaatcctcttctccccctgcatacggataaatttatagaccaaaaatataatgttttccctcaaataagatatcgacctttgtgttaccttggaagacaggatc

SEQ ID NO: 4226 - DNA, 827 bp, Artificial Sequence; identical to SEQ ID NO: 1449
  P1692 (35S::G2291)

SEQ ID NO: 4227 - DNA, 673 bp, Artificial Sequence
  P1695 (35S::G1792)
aatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4228 - DNA, 1500 bp, Artificial Sequence; identical to SEQ ID NO: 1375
  P1697 (35S::G2114)

SEQ ID NO: 4229 - DNA, 626 bp, Artificial Sequence
  P1699 (35S::G2113)
aacaaactcatcaaacttcctcagcgtttctttttcttacataaacaatttttcttacataaacaaatcttgttgtttgttgttgtcatggcaccgacagttaaaacggcggccgtcaaaaccaacgaaggtaacggagtccgttacagaggagtgaggaagagaccatggggacgttacgcagccgagatcagagatcctttcaagaagtcacgtgtctggctcggtactttcgacactcctgaagaagccgctcgtgcctacgacaaacgtgctattgagtttcgtggagctaaagccaaaaccaacttcccttgttacaacatcaacgcccactgcttgagtttgacacagagcctgagccagagcagcaccgtggaatcatcgtttcctaatctcaacctcggatctgactctgttagttcgagattcccttttcctaagattcaggttaaggctgggatgatggtgttcgatgaaaggagtgaatcggattcttcgtcggtggtgatggatgtcgttagatatgaaggacgacgtgtggttttggacttggatcttaatttccctcctccacctgagaactgattaagatttaattatgattattagatataattaaatgt

SEQ ID NO: 4230 - DNA, 840 bp, Artificial Sequence
  Artificial sequence
  P1701 (35S::G280)
aatccctcctcacacagattccttccttcatcacctcacacactctctacgcttgacatggccttcgatctccaccatggctcagcttcagatacgcattcatcagaacttccgtcgttttctctcccaccttatcctcagatgataatggaagcgattgagtccttgaacgataagaacggctgcaacaaaacgacgattgctaagcacatcgagtcgactcaacaaactctaccgccgtcacacatgacgctgctcagctaccatctcaaccagatgaagaaaaccggtcagctaatcatggtgaagaacaattatatgaaaccagatccagatgctcctcctaagcgtggtcgtggccgtcctccgaagcagaagactcaggccgaatctgacgccgctgctgctgctgttgttgctgccaccgtcgtctctacagatccgcctagatctcgtggccgtccaccgaagccgaaagatccatcggagcctccccaggagaaggtcattaccggatctggaaggccacgaggacgaccaccgaagagaccgagaacagattcggagacggttgctgcgccggaaccggcagctcaggcgacaggtgagcgtaggggacgtgggagacctccgaaggtgaagccgacggtggttgctccggttgggtgctgaattaatcggtacttatgcaatttcggaatctttagttactgaaaaatggaatctcttagagagtaagagagtgctttaatttagcttaattagatttatttggatttctttcagtatttggattgtaaactttagaatttgtgtgtgtgttgttgcttagtcctgaga

SEQ ID NO: 4231 - DNA, 1149 bp, Artificial Sequence
  P1702 (35S::G1063)
gttaaagaagatggatgggccacaagttgctatataaatccttccacttcttgttgtatactattgcttgagttctgattgggcacagtagtaccattgccatttctctcacacataccgtctctttctctcatcatcaatcatcaatcatccaaaagaaaaaaccctaaaatttcacttgtaagcttttcaccagtttctctccatacccattttatcagcttctccatatctttctctatggattctgacataatgaacatgatgatgcatcagatggagaagcttcctgagttttgtaaccctaattcctctttcttctctcccgaccacaacaacacttacccttttctctttaactccactcattaccagtccgatcactcaatgaccaacgaaccaggtttccgctacggttccggtttactcactaacccttcttctatctctcccaacacagcttactcttccgtttttcttgacaaaagaaacaacagtaacaacaacaataatggcacgaacatggcagctatgcgagagatgatcttccgtatcgccgtgatgcaaccgatccatatcgatcccgaggcggttaagccaccgaagaggaggaacgtcaggatctctaaagatcctcaaagcgtggcggctaggcatagaagggagagaataagcgagaggattcggattttgcaacggcttgttcctggtgggacgaagatggatacagcttcgatgctcgatgaagcaattcattatgtgaagtttttaaagaaacaggtgcagtctctggaggagcaggcggtggttactggcggagggggaggaggaggaggaagggttttgatcggtggaggtggaatgacggcggcgagtggtggtggtggcggcgggggagtggttatgaaagggtgtggaacagtggggactcatcagatggtgggcaatgcacagattcttagatgatgatgatttttaattttattattattatattaatgttggagaaaaagagaaaaatgattctggagagggaagccaagtaatttatgtgagagtctttaatttaactttattttcttgtttagataatgtgtaatgatggtttttaaagccaaagactctccatggttgttggagcgagtttgt

SEQ ID NO: 4232 - DNA, 1711 bp, Artificial Sequence
  P1703 (35S::G1064)
tccattgtctctctctttcttatcctctctttctcaatcaattccttcagacttatacactttattttttttcccctcttgtcgaaaacatcacatataaataaaaaaccaaaaaccctaatttataaaatatatataaaatagttatagctccccacttatatatgcaaaagccaacatcaagtatcttaaatgtcataatggacggtggagacagcgtcggaggaggaggaggagatgatcaccaccgtcacctccaccatcaccaccgccctactttcccttttcaactactcggaaaacacgaccccgacgacaaccatcaacaacaaccttccccttcctcctcctcctctctattttctctccatcaacaccaacaattatctcaatcgcaacctcaatcgcaatcgcaaaagtcacaaccgcagacaacgcaaaaagagttattacaaacgcaagaggaatctgcggtggtggcagctaaaaagccaccgttgaaacgagcgtcgacgaaagaccgacacacgaaagtagacggaagagggaggagaataaggatgccggcgttatgtgcagctagggtttttcagctaacgcgagagctaggtcataaatccgacggtgagacaatagagtggcttcttcaacaagctgaaccatctgtaatcgccgccaccggaaccggaacaatcccggcgaatttcacttctttaaacatctctctccgttcttcaggctcttccatgtctcttccttctcatttccgctccgccgcttccacttttagccctaataacatattttctccggcgatgcttcaacaacaacaacaacaacaacgtggtggtggtgttgggtttcatcatccccatctacagggacgtgcacctacgtcgtctttgtttcctggtattgataacttcacaccaacgacgtcgtttttgaactttcataatccaacaaagcaagaaggagatcaagattctgaagagttaaactcggagaagaaaagaagaatccaaacgacgtcggatttgcatcaacaacaacaacaacaccaacatgatcaaatcggaggatatacacttcaatctagcaacagtggatctacggccaccgcagccgccgcgcaacaaataccgggaaatttctggatggttgcggcggctgcggctgcaggtggtggtggtggtaataacaaccaaacaggtggtcttatgacagcttctattggtactggtggcggcggtggagagcctgtttggacgtttccttccattaacacggcagcggcagcgttatatagaagtggcgtttcgggcgttccaagcggcgcggtttctagcggtttacattttatgaatttcgcagcgccaatggcatttcttactggacaacaacagctagcaacaactagtaatcatgagattaatgaagatagtaataataatgaaggaggaagaagtgacggtggtggtgatcatcataatacacagagacatcatcatcatcaacaacaacatcatcataatattctctccggcttgaaccagtacggacggcaagtttccggcgactctcaagctagtggatcacttggaggtggtgatgaggaggatcagcaagattagacacacacaaaaacattttaatggtgggattttctgccgacggcggtagcggtgacggcgttcggcggctgtgtaaa

SEQ ID NO: 4233 - DNA, 1613 bp, Artificial Sequence
  P1704 (35S::G1128)
tgtctgaagaagcttgaatctgtcgtgatcatcaagattcaagttctgtctttttgagtctttttcttctacttctattgagtttctcttccttaattgtcggaatcagaatcttttcagatggaggagagagaaggaactaacatcaacaacatcccaaccagttttggtctgaaacaacatgaaactcctcttcctcctcctggttacccaccacggtctgaaaaccctaatctttttccggtgggtcaatccagcacttcctccgccgccgccgcggtgaaaccttctgagaatgttgctcctccttttagcttaacaatgccggtggagaattcttcttctgagttgaagaagaagagagggagaccaagaaagtataaccctgacggctcactcgctgtgactctctctcctatgcctatctcatcctccgttccgttgacgtcggagtttggttctcggaaacgaggaagaggtcgaggaagaggcagaggaagaggacgaggacgtggacaaggacaaggaagcagagagcccaataacaacaacaacgacaacaattggctcaagaatcctcagatgttcgaatttaacaacaacactcctacttctggtggaggaggacctgctgaaattgtcagtccaagttttacacctcatgtgctcacagtaaatgccggtgaggatgtgacaatgaagataatgacattctctcaacaaggctcgcgtgctatttgtattctttcagcgaacggtcccatatccaatgttacacttcgtcaatctatgacatctggtggtactctcacttatgagggtcattttgagattctttctttgacgggttcgtttataccaagcgagagtggaggaacccgaagcagagctggtgggatgagtgtctctcttgcaggacaagatggtcgtgtctttggtggtggacttgctggtctctttattgccgctggtcctgttcaggtaatggtagggagttttatagcgggtcaggaggaatcgcagcagcagcagcagcagataaagaagcaaagaagggaaagactcgggatcccgacaacaacacaagcttctaatatctcattcggtggctcagcggaagatcctaaggctagatacgggctcaacaagcctgttgttattcagccaccaccggtgtctgcaccacctgtgtccttttcgcatgaaccaagtactaacaccgtccatggttactatgcaaataacacagctaaccatatcaaggatctcttctcttccctccctggagaagatagggaagaagatgaggatgatttagaaggtgaagatgatgaagaattcggaggccatagcgaatctgacaccgaggttccaagctgatgatcgatggaaagaatccgacatatatgtgttatgaatcttgagttgttttatttcggtgtcttcagatttttttagagcgtaatggtattttttttctttcagattgttagttgttaaagtcttaaacagagatatttcactaaaagttagggtttactagaggatgtaatctttagggttctttgacttgtgtctttcttttaatcctcagatggttgttgtaggcttgt

SEQ ID NO: 4234 - DNA, 2688 bp, Artificial Sequence
  P1709 (35S::G275)
tctcgcctgtatcaggcgtacacgcgttgttatcatctgttgcttatatttgaaccatggcgcaaccaaggtacactaggatagataacaggaggccctcatcaaattattgctctacagtgacagtagttgtgtttgtggccctatgcttagtcgggatctggatgatgacatcatcttctgttggaccggctcagaatgttgatgaggtttctctggacaacaaagatgggataaagaaacagatgaccccacctgcagaggagggtaatggtcagaagtttgaagacgcacctgttgaaacaccgaacgaggataaaaaaggagatggtgatgcaagcttgcccaaagaggatgagagctcaagcaaacaagataaccaggaagagaagaaagaagagaaaactaaagaagagtttactccatccagtgagacgaaaagtgagaccgaaggtggggaagatcaaaaagatgactccaagtcagaaaatggtggtggaggtgatttagatgagaaaaaagatttgaaagacaactcagatgaagaaaatcctgacacaaatgaaaagcaaactaaaccagaaacagaggacaatgagttgggtgaggatggtgaaaaccaaaagcaatttgagtctgataacggtgagaaaaaatccattgatgatgataaaaaatccagtgatgatgataaagaaaacaagacaggcaacgaagatactgaaaccaagactgagaaggaaaacactgagacaaatgtggatgttcaagtagagcaagagggtcaatccaaaaacgagacctcaggtgatctttcacctcctggggcacaattagagctactgaatgaaactaccgcacagaatggttcattttcaacccaggcaacagagtccaaaaatgagaaagaagctcagaagggttctggtgataaacttgattacaaatgggcactatgcaatacaacagcaggacctgattacattccctgtctcgataatgtgcaagccattaggagtcttccgagtactaaacattacgagcatcgtgagaggcattgcccagacagcccacccacctgccttgttcctttgcctgatggatacaagcggccaattgagtggcccaaaagtcgagaaaagatctggtacaccaacgtccctcataccaagcttgctgagtataaggggcatcaaaattgggttaaagttaccggtgagtatctaacttttcctggtggaggaacccaattcaagcatggtgctcttcattacatcgatttcatacaggagtctgtccctgctattgcatggggtaaacgctctcgtgtggtcctggatgttggatgcggtgttgcaagctttggaggtttcctctttgacagagatgtgatcactatgtctcttgcacctaaagatgaacatgaagctcaggtgcaatttgctcttgagaggggcattcccgccatttctgcagttatgggcacgacaaggctacctttccctggcagagtttttgacatagttcattgtgctcgctgtagagtgccatggcacattgaaggtggtaaacttctcctggagcttaaccgtgtattgagacccggtgggttctttgtgtggtctgctactcctgtttatcagaagaagaccgaagatgttgaaatttggaaagctatgagtgaactcattaagaagatgtgttgggaactcgtatccattaacaaggacactatcaatggagtaggtgttgctacttacagaaagccaacttcaaatgagtgctacaaaaacagatcagaaccggtgcctccaatttgtgcagactctgatgatccaaatgcatcttggaaagtgccgcttcaagcatgcatgcacaccgcgccagaagacaaaacgcaacgtggatctcagtggcccgaacaatggccagcgagattagagaaagcaccgttctggttatcaagttcccagactggagtttacggaaaagcagcaccagaggatttcagtgctgattatgagcactggaaacgcgtagtgaccaaatcataccttaatggtttaggaatcaactgggcatctgttagaaatgtgatggacatgagagccgtttatggaggttttgcggcagctctaagagatctgaaagtgtgggtcatgaatgtggttccaatagattcaccagacacacttgcaataatctatgaacgaggactctttggtatctaccacgattggtgcgaatctttcagtacatacccgagatcatatgatctccttcacgccgaccatcttttctccaaactcaaacaaaggtgcaatcttactgcggtgatagcagaagtggatcgtgttttgagaccccacgcgtccggactagttctagacgatgcggaaacaatacagcaagtggaaggcatggtgaaagcgatgaaatgggaagttcgaatgacttattctaaggaaaaagaaggtttgctctctgttcaaaaatcaatctggcgacccagtgaagtggaaacactcacttacgctatcggttgagaagacttacttcaagtcccactcttttttgtacgtataaaaacactcttattaactccatatcatccctttttttgttggttcgtcttttaggaagttctttttttttagctgttgagtcatttgtttgtactattcgcac

SEQ ID NO: 4235 - DNA, 778 bp, Artificial Sequence
  P1712 (35S::G1011)
cttgtttagggtttcaatctttacagatcttgtggcagaaaaaatcaagtcaaagcaagaaaaatggttagaggaaagatagagatgaagaaaatagaaaacgcaacgagtagacaagtgactttctcaaaaagaagaaatggtttgttgaagaaagcttatgagctctcagtactctgcgatgctcaactctctctcatcatcttctcccagagaggaaggctttatgaattctctagctctgatatgcagaagacgatcgaacgctaccgcaagtacacaaaagatcatgaaaccagcaatcacgactcacaaattcacttgcagcaattgaaacaagaagcaagccacatgataacaaagattgaactccttgagtttcacaagcggaagctattgggacaaggaattgcttcttgttctctagaagagcttcaagaaatcgatagtcaactccaaagaagtctgggaaaggtccgagaaagaaaggctcaattgttcaaggagcagttggagaaactaaaagcaaaggagaaacaattgttagaagagaacgtcaagttacatcaaaagaatgttattaatccatggagaggatcatcgactgatcagcagcaagagaaatacaaagttatagatttgaatttggaagttgaaactgacttattcatcggtttgccaaatagaaactgctagtaacattatataatatgtttatttatttatcatgaaatattcaaaatcattcaataaattgtgaggtaatgatttgggatag

SEQ ID NO: 4236 - DNA, 3131 bp, Artificial Sequence
  P1713 (35S::G1206)
cacaggagattcatcgttgcagagttcttcgagcttgtttttttctgtgtttgtgttcatcataaggtaaaattgagttttcgatcttcttctgatttccaattctagactcaattgtctcttttgattgatttggttttaataatgttgtttggttttgattggaatcgattgatcatatactgttttattgcgattaattttgattatgatcgaagaactcgaatttgttgtctctgttttagatattcaaatctgcatgttcgttttgtttcaattttggtgtaagaatctgtttcatagatctgaattaccatcactggcgatttttgtttgcaggagctaaagaatggattctggagttaaattggagcatatgaattgtttccaattatcttatcaatattcgtggacgactaggaagaagagaactctgaaaccattcatgtcaaaaggttctagccctagtagtagtagtgatagtaggaaacggaagctttcgagagctgaagatagcgatgattcagcggttaaacggaatgcgaaacgaaggagaaagatatgcaaagtagaagaatattatgaagatgatgattgcatattaagtgattgggttcagaggaatactgcgaaaaggattgataagcgcaacgaagaagttgaagttatggttaagatagagtcaggtgatgattgcacaataggtaagtggttttctgatgttagtagtaaaaggaaagataaacgacaagtagaagttgatgaagatgaggaatgggaagaagaagttacactgtgttctaagatcaaggcaacgtcgtcgcgaagcagaacccatagtttaagtgctaacagtccagaaaatgttacagatgttattagtccttgtcgttcacggtctccagcttctaatgtatcagattccattcagaaaaatgactgcaccagtagtagaaaacagagtggcccaatttgtcatcagtgcttgaaaggggaaaggataacacttctcatttgtagtgaatgtgagaagacaatgttttgtcttcaatgtataaggaaatggtatccaaatctatctgaggatgatgttgttgagaaatgtcctttatgccgtcaaaattgtaattgtagcaaatgcttgcatttgaatggtttaattgagacatcgaagagggaactcgcgaaatctgaaagacgtcatcatctccagtatttgattacgttgatgcttccttttctgaataagttatccatattccagaagctagagattgaatttgaggcaactgttcaaggaaaactgccttctgaagttgaaataactgcggctataagctacactgatgaacgtgtatactgtgatcattgtgcaacttcaattgttgacttgcatcgaagctgtccaaagtgctcttatgaactttgtttgaagtgctgtcaagagattcgtgaaggatcgctttctgaacgccctgaaatgaagttccattatgttgatagaggacatcgatatatgcatggtttagatgctgcggaaccgagcttgtcttccacttttgaagacgaagaagctaacccatctgacgctaagtggagccttggtgaaaatggaagcatcacttgtgcaccagaaaagctaggtggttgtggtgaacggatgctagagcttaggcggatcctaccactcacgtggatgtcagatttagagcacaaagcagagactttcttatcatcatacaatataagccctagaatgttgaactgtaggtgttcttctttggagacagagctgacaaggaaatcagcttcgaggacaacatcaagtgacaactaccttttctgtcctgaatctctcggtgtcttgaaggaagaagagcttcttcattttcaagagcattgggcaaaaggcgaaccagtaatcgttaggaacgctcttgacaacacacctggtttaagctgggagccgatggttatgtggcgggctttatgcgaaaatgtgaattcaacatcaagctctgagatgtcccaagtcaaagcaattgattgcttagctaattgtgaggtggagatcaatactcgtcagttctttgaaggttatagcaaaggaagaacatatgaaaatttctggcctgagatgttgaagcttaaggactggcctccttctgataagtttgaagatcttctacctcgtcactgtgatgagttcatatccgcgttacctttccaggaatatagtgatcctagaactggaattcttaacattgcaacaaagcttcctgaaggatttatcaaaccagatttaggtccaaaaacttacatcgcctatgggattccagatgagcttggtagaggcgattccgtgactaagcttcactgcgatatgtcagacgcggtgaatattctaacgcatacggccgaagtgaccctaagtcaagaacaaatatcctcagtcaaagcactgaaacagaaacacaagttacagaataaggtcgataaacagagtactgaagactgtaacgaaaaggaagaagaagaagaagaagaattgaacatgccagagatttcgagcaatgaaaatgaagaaacgggcagtgctctttgggacatatttaggagagaagacgttcccaagttagaagagtatctaagaaagcattgcaaagaatttagacacacttattgtagtccagttacaaaggtaacaacacccacctgcatcaattttatgacgaatttatttccggtactgacggtttcttcttttcaggtttatcatccgatacatgaccaatcatgctatttaaccttagagcacaaaagaaaactcaaggcggaatatgggatcgagccatggacatttgtgcaaaagctaggtgaagcggtgtttattcccgcgggttgtcctcatcaagttcggaatctaaagtcgtgcacaaaagtcgcagttgactttgtgtcaccagagaacatccatgagtgtctgcgtttgaccgaagagtttcgccaacttcccaaaaaccacaaggccagagaggacaaactcgaggcaagtcttttatctctttgacatttctttctttcttttttttttgttcgttgtctgagcatactgtgcattgcttgctgcg

SEQ ID NO: 4237 - DNA, 1652 bp, Artificial Sequence
  P1717 (35S::G634)
cgtcgacctagagagaaagagagagtgtgtgtgtagaaaaagattgaaacatcatcaagattgatggagcaaggaggaggtggtggtggtaatgaagttgtggaggaagcttcacctattagttcaagacctcctgctaacaacttagaagagcttatgagattctcagccgccgcggatgacggtggattaggaggtggaggtggaggaggaggaggaggaagtgcttcttcttcatcgggaaatcgatggccgagagaagaaactttagctcttcttcggatccgatccgatatggattctacttttcgtgatgctactctcaaagctcctctttgggaacatgtttccaggaagctattggagttaggttacaaacgaagttcaaagaaatgcaaagagaaattcgaaaacgttcagaaatattacaaacgtactaaagaaactcgcggtggtcgtcatgatggtaaagcttacaagttcttctctcagcttgaagctctcaacactactcctccttcatcttccctcgacgttactcctctctccgtcgctaatcccattctcatgccttcttcttcttcttctccatttcccgtattctctcaaccgcaaccgcaaacgcaaacgcaaccgcctcaaacgcataatgtctcttttactcctactccaccgtatcaaccgccacccgcggtcactaaacgtgtggcggaaccaccattatcaacagctcaatctcaatcacaacaaccaataatggcgattccacaacaacaaattcttcctcctcctcctccttctcatcctcacgctcatcaaccagaacagaaacaacaacaacaaccacaacaagagatggtcatgagctcggaacaatcatcattaccatcatcatcaagatggccaaaggcagagattctagcgcttataaacctgagaagtggaatggaaccaaggtaccaagataatgtacctaaaggacttctatgggaagagatctcaacttcaatgaagagaatgggatacaacagaaacgctaagagatgtaaagagaaatgggaaaacataaacaaatactacaagaaagttaaagaaagcaacaagaaacgtcctcaagatgctaagacttgtccttactttcaccgcctcgatcttctttaccgcaacaaagtactcggtagtggcggtggttctagcacttctggtctacctcaagaccaaaaacagagtccggtcactgcgatgaaaccgccacaagaaggacttgttaatgttcaacaaactcatgggtcagcttcaactgaggaagaagagcctatagaggaaagtccacaaggaacagaaaagaagaccttgtgatgagagagctgattcaacaacaacagcaactacaacaacaagaatcaatgataggtgagtatgaaaagattgaagagtctcacaattataataacatggaggaagaggaagatcaggaaatggatgaggaagaactagacgaggatgagaagtccgcggctttcgagattgcgtttcaaagccctgcaaacagaggaggcaatggccatacggaaccacctttcttgacaatggttcagtaaaatcagaatcattgtttcaagaaaatgtacttatgtgtgcatagttttcgc

SEQ ID NO: 4238 - DNA, 1237 bp, Artificial Sequence
  P1721 (35S::G2156)
tcacatcaattaatacgacaccgtctcgggtgaagaatctctcctctcttgccctaaagcgagttagggtttaacacacaaagcataccctttagatttgtgtctcttagctctgtttttgtcggcttgtgtaaccgatcaactcaagctattggctcctcacctcctgaaatttgacttctccaatggatctcaaagtttctcttatatgaattctatcttcaccctcacaatatctttatatatatgagccacaagaacaagaagagtcagtagatgcggctgccatggacggtggttacgatcaatccggaggagcttctagatactttcacaacctcttcaggcctgagcttcatcaccagcttcaacctcagcctcaacttcaccctttgcctcagcctcagcctcaacctcagcctcagcagcagaattcagatgatgaatctgactccaacaaggatccgggttccgacccagttacctctggttcaaccgggaaacgtccacgtggacgtcctccgggatccaagaacaagccgaagccaccggtgatagtgactagagatagccccaacgtgcttagatctcatgttcttgaagtctcatctggagccgacatagtcgagagcgttaccacttacgctcgcaggagaggaagaggagtctccattctcagtggtaacggcacggtggctaacgtcagtctccggcagccggcaacgacagcggctcatggggcaaatggtggaaccggaggtgttgtggctctacatggaaggtttgagatactttccctcacaggtacggtgttgccgccccctgcgccgccaggatccggtggtctttctatctttctttccggcgttcaaggtcaggtgattggaggaaacgtggtggctccgcttgtggcttcgggtccagtgatactaatggctgcatcgttctctaatgcaactttcgaaaggcttccccttgaagatgaaggaggagaaggtggagagggaggagaagttggagagggaggaggaggagaaggtggtccaccgccggccacgtcatcatcaccaccatctggagccggtcaaggacagttaagaggtaacatgagtggttatgatcagtttgccggtgatcctcatttgcttggttggggagccgcagccgcagccgcaccaccaagaccagccttttagaattgaaaattatgtccgtaacatagctgtaaccaaatttc

SEQ ID NO: 4239 - DNA, 1348 bp, Artificial Sequence
  P1722 (35S::G2157)
cccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaa

SEQ ID NO: 4240 - DNA, 1050 bp, Artificial Sequence; identical to SEQ ID NO: 1495
  P1724 (35S::G2383)

SEQ ID NO: 4241 - DNA, 1118 bp, Artificial Sequence
  P1725 (35S::G2085)
gttctttctctatatccttcaatcaatgtgaaaaaaaagctctcccttttggcagtttccgatgtttggtcgccattcgattatcccaaataaccagattggtaccgcctctgcttccgctggtgaagaccatgtctctgcctccgctacgtctggtcacattccttacgacgatatggaagaaatccctcatcctgactctatctatggtgctgcctccgatttgattcccgatggctctcaattggttgctcaccgatccgatggctctgaattacttgtttctcggccaccggaaggggcgaatcagcttacgatctcgttccgtggacaagtttacgtttttgatgccgttggtgctgacaaggtggatgctgtgttgtcgctgttgggtggttctactgagcttgctcctggtccgcaggtgatggaactagctcaacagcagaatcatatgcctgttgtagaatatcagagccgctgtagccttccgcaacgggcacaatccttggataggtttcggaagaagaggaatgctagatgtttcgagaagaaagtaagatacggtgttcgccaagaagttgccttaagaatggcacgtaataaaggtcaattcacctcttcaaagatgacagatggggcttataactctggcacagatcaagattctgcccaagatgatgcccatccagaaatatcgtgtactcattgcggcattagttccaaatgtacaccaatgatgcgacgtggcccttccggccccaggactctctgcaatgcctgtggacttttttgggctaacaggggtacattgagggatctctcaaagaaaacagaagagaatcagttggctttaatgaaaccggatgatggtgggagtgttgctgatgctgctaacaacttaaacactgaagctgcaagtgttgaagaacacacttccatggtttctcttgccaatggggataattctaatctgttaggtgatcactaaatactgtgataagaatcagaagatagaaatctttgtagaatcagatggtcttctctatgaatttatcttttcaccatcacatgtattatagaaaccgtaaccgaacctcaaatcaaataccatacag

SEQ ID NO: 4242 - DNA, 1235 bp, Artificial Sequence
  P1726 (35S::G1779)
tagcttggatccttctttacttgtccctgatctctcctaatctctcgtcttccctctcttttgtgcttcatcgatctctatcggtcatgggttccaattttcattacacaatagatctcaatgaagatcaaaaccatcagccttttttcgcttctcttggatcctctcttcatcatcatctacaacaacaacaacaacaacaacaacattttcatcaccaagcttcttctaatccctcttctttgatgtcaccgtctctttcctactttcctttcttgataaactctcgccaagatcaagtatatgttgggtacaacaataacacttttcatgatgttcttgatacccatatctcccaacctctcgagaccaagaactttgtatctgatggtggttcatcatcaagtgatcaaatggtgcccaagaaggagacacgactaaaattgacgataaagaagaaagataatcatcaagaccaaaccgatcttcctcaatccccaataaaagacatgacaggaactaactcgctcaagtggatatcttcgaaggtgagattaatgaagaagaaaaaggcgattattaccaccagcgacagcagcaaacaacacactaataacgaccaatcctcaaacctaagcaattcggaaagacagaatggttataacaacgattgcgtgattaggatttgctccgattgtaacacaaccaagactcctctttggagaagtggtccgagaggtcccaagtctctttgtaacgcttgtggaataaggcaaaggaaggccaggcgggccgctatggccacggcaaccgcaaccgcagtctctggcgtatccccaccggtcatgaagaagaagatgcaaaacaagaacaagatatcaaatggagtttataaaatcttatctcctttgcccctaaaggtaaacacgtgtaagagaatgatcacactagaggagaccgcattagccgaggatttggagacccagagcaactccacgatgttatcatcttcagacaatatctatttcgatgatctagcattactgttgagcaaaagttcagcttatcagcaagttttccctcaagatgagaaggaggctgccattttactaatggctctatcgcacggaatggttcacgggtgattattttaagtattttaattataactcgcatgcttaagaaataaaatataaaccataccataagccctcatagctagtaatatctagatt

SEQ ID NO: 4243 - DNA, 1775 bp, Artificial Sequence
  P1727 (35S::G957)
aagttgtaaccatttccactcgtaatcatacaacttctctactcttctagagcaaaaacccaaaaatatattgctatcttcgttaatggctgataataaggtcaatctttcgattaatggacaatcaaaagtgcctccaggtttcagattccatcccaccgaagaagaacttctccattactatctccgtaagaaagttaactctcaaaagatcgatcttgatgtcattcgtgaagttgatctaaacaagcttgagccttgggatattcaaggttaaaccctaaatatgaaaaaaaactctttcatttctacgaactctctatttctttgttctttatttttgaaccattttggtatgcaaatgcagaggaatgtagaatcggttcaacgccacaaaacgactggtacttcttcagccacaaggacaagaagtatccaaccgggaccaggacgaaccgggcaacagtcgctggattctggaaagctaccggacgtgacaaaatcatctgcagttgtgtccggagaattggactgaggaagacactcgtgttctacaaaggaagagctcctcacggtcagaaatccgactggatcatgcatgagtatcgcctcgacgatactccaatgtctaatgtaagtatatatagcaatcatcaatttgcagtttaggttagaataaacaaattacaaacttatagtcaaagaattagctagattcgtttcatgctataaaaggttttggttcatttagtacgcactagagccttcttttagcatctgcaattaaagtaatcgaacatgattctctgagttacaataagataatttcttatgaaattaacacatcatatatacatttatataaaaagattttttcacaaggcttaaaatagtttaacacggctctacaaacaatacgtagttaactagttatggttgcatatccaaaagaaaaaccaacataaaagatttttttttttgtttcaaaataaaagttgcatttttacatcatcaagatttaatcatctcttattgcatttcataagatcgatttgtgttccattatcagggctatgctgatgttgttacagaagatccaatgagctataacgaagaaggttgggtggtatgtcgagtgttcaggaagaagaactatcaaaagattgacgattgtcctaaaatcactctatcttctttacctgatgacacggaggaagagaaggggcccacctttcacaacactcaaaacgttaccggtttagaccatgttcttctctacatggaccgtaccggttctaacatttgcatgcccgagagccaaacaacgactcaacatcaagatgatgtcttattcatgcaactcccaagtcttgagacacctaaatccgagagcccggtcgaccaaagtttcctgactccaagcaaactcgatttctctcccgttcaagagaagataaccgaaagaccggtttgcagcaactgggctagtcttgaccggctcgtagcttggcaattgaacaatggtcatcataatccgtgtcatcgtaagagttttgatgaagaagaagaaaatggtgatactatgatgcagcgatgggatcttcattggaataatgatgataatgttgatctttggagtagtttcactgagtcttcttcgtctttagacccacttcttcatttatctgtatgattatctatacatacacatacacaaaatataaaataaagtttgttaaaaaatgtctcatgttctattgatagtacgtcttgat

SEQ ID NO: 4244 - DNA, 1311 bp, Artificial Sequence
  P1735 (35S::G2535)
tagacatactttggttagttataaactcgttctattttcttctcctttttctatctttagcaatgaacatatcagtaaacggacagtcacaagtacctcctggctttaggtttcacccaaccgaggaagagctcttgaagtattacctccgcaagaaaatctctaacatcaagatcgatctcgatgttattcctgacattgatctcaacaagctcgagccttgggatattcaaggttcatcatttatcttttattcttgatgaaacgtattaatagggcttgtatatattaattaaattagttttttaatgcatgtgttgagtcaagaactaaagctctgaattcaggaaattttgcagagtaatatatactttttgtgataataaaatttgcagtaacaaaattcagtcaaaacttaacacaactcttgttttttctatgtagagatgtgtaagattggaacgacgccgcaaaacgattggtacttttatagccataaggacaagaagtatcccaccgggactagaaccaacagagccaccacggtcggattttggaaagcgacgggacgtgacaagaccatatataccaatggtgatagaatcgggatgcgaaagacgcttgtcttctacaaaggtcgagcccctcatggtcagaaatccgattggatcatgcacgaatatagactcgacgagagtgtattaatctcctcgtgtggcgatcatgacgtcaacgtagaaacgtgtgatgtcataggaagtgacgaaggatgggtggtgtgtcgtgttttcaagaaaaataacctttgcaaaaacatgattagtagtagcccggcgagttcggtgaaaacgccgtcgttcaatgaggagactatcgagcaacttctcgaagttatggggcaatcttgtaaaggagagatagttttagaccctttcttaaaactccctaacctcgaatgccataacaacaccaccatcacgagttatcagtggttaatcgacgaccaagtcaacaactgccacgtcagcaaagttatggatcccagcttcatcactagctgggccgctttggatcggctcgttgcctcacagttaaatgggcccaactcgtattcaataccagccgttaatgagacttcacaatcaccgtatcatggactgaaccggtccggttgtaataccggtttaacaccagattactatataccggagattgatttatggaacgaggcagatttcgcgagaacgacatgccacttgttgaacggtagtggataacggaaatggaagagaggaagtgactaagtgagtg

SEQ ID NO: 4245 - DNA, 1548 bp, Artificial Sequence
  P1740 (35S::G2153)
gcaatttgtcttgtgtttctcacaacacaaaaacttgtaaaagtgttaaaaaatcaagatctgaaaaatcttatcaccgcttctaggtttttcagttttttttcttccttttcctgatctaaattaacttatatttcttagggtttcacttcttgaaacatttaatcagaattaattaacctctctagggctttcatggcgaatccatggtggacaggacaagtgaacctatccggcctcgaaacgacgccgcctggttcctctcagttaaagaaaccagatctccacatctccatgaacatggccatggactcaggtcacaataatcatcaccatcaccaagaagtcgataacaacaacaacgacgacgatagagacaacttgagtggagacgaccacgagccacgtgaaggagccgtagaagcccccacgcgccgtccacgtggacgtcctgctggttccaagaacaaaccaaagccaccgatcttcgtcactcgcgattctccaaatgctctcaagagccatgtcatggagatcgctagtgggactgacgtcatcgaaaccctagctacttttgctaggcggcgtcaacgtggcatctgcatcttgagcggaaatggcacagtggctaacgtcaccctccgtcaaccctcgaccgctgccgttgcggcggctcctggtggtgcggctgttttggctttacaagggaggtttgagattctttctttaaccggttctttcttgccaggaccggctccacctggttccaccggtttaacgatttacttagccggtggtcaaggtcaggttgttggaggaagcgtggtgggcccattgatggcagcaggtccggtgatgctgatcgccgccacgttctctaacgcgacttacgagagattgccattggaggaggaagaggcagcagagagaggcggtggtggaggcagcggaggagtggttccggggcagctcggaggcggaggttcgccactaagcagcggtgctggtggaggcgacggtaaccaaggacttccggtgtataatatgccgggaaatcttgtttctaatggtggcagtggtggaggaggacagatgagcggccaagaagcttatggttgggctcaagctaggtcaggattttaacgtgcgttaaaatggtttttaatttacagaagttaacaataagattataatgatgtttattatgatgatgaaaaccagtcagttgctacttgttactagtgagctatatagtttgtggacattatattatgttctctcttgactatgattattatttgctaaatttcacttagcttacttgtgtttttatgatgttttattaaaagtttttctctttgttggattctccaattttttatagtgaggttaagtgtgcatacatatatacatgtgtacatgattgacgatcctcattaaattagaacaccttggggttgaccctttttcaaatatgattagcatatacagactatatataatttgaaaatgataaaatttcaagtgcttggtgtaattcctttcgaa

SEQ ID NO: 4246 - DNA, 780 bp, Artificial Sequence
  P1742 (35S::G2155)
ctcatatataccaaccaaacctctctctgcatctttattaacacaaaattccaaaagattaaatgttgtcgaagctccctacacagcgacacttgcacctctctccctcctctccctccatggaaaccgtcgggcgtccacgtggcagacctcgaggttccaaaaacaaacctaaagctccaatctttgtcaccattgaccctcctatgagtccttacatcctcgaagtgccatccggaaacgatgtcgttgaagccctaaaccgtttctgccgcggtaaagccatcggcttttgcgtcctcagtggctcaggctccgttgctgatgtcactttgcgtcagccttctccggcagctcctggctcaaccattactttccacggaaagttcgatcttctctctgtctccgccactttcctccctcctctacctcctacctccttgtcccctcccgtctccaatttcttcaccgtctctctcgccggacctcaggggaaagtcatcggtggattcgtcgctggtcctctcgttgccgccggaactgtttacttcgtcgccactagtttcaagaacccttcctatcaccggttacctgctacggaggaagagcaaagaaactcggcggaaggggaagaggagggacaatcgccgccggtctctggaggtggtggagagtcgatgtacgtgggtggctctgatgtcatttgggatcccaacgccaaagctccatcgccgtactgaccacaaatccatctcgttcaaactagggtttcttcttctt

SEQ ID NO: 4247 - DNA, 1289 bp, Artificial Sequence
  P1743 (35S::G2522)
tcgaccggttgcatgttgttatcttgctcttgaagtctatcgaacccttttagattctgattttgttctcttcttatccctcctcctataagttagccatttagggtccccatcgaattttactaagttaaagtcagagtctttttggttaagctatggatcgaagagacgcaatggcgttatccgggtcgggttcttactatatccaaagaggaatccccggttctggtcctcctcctcctcaaactcaaccaacgtttcacggatcacaaggatttcatcatttcaccaattccatctctccttttgggtcaaacccaaacccaaatccaaaccctggaggtgtctctactggattcgtgtctcctcctttacccgttgactcttctccggctgattcgtcagcggcggcggcgggagctttggttgctcctccttcaggtgacacgtctgtgaagcggaagagaggacggcctagaaaatatggacaagatggtggttctgtttcgttggcattgtctccttctatctccaacgtttccccgaactctaacaaacgtggccgtggaagacctcctggctccggcaagaagcaacggctatcttccattggtgaaatgatgccttcatcaactgggatgagcttcacaccgcatgtaatcgtagtttccattggtgaagacattgcttcaaaggttatatcgttctcgcatcaaggtccacgagcgatatgtgtcttatccgcaagtggtgctgtctctactgcaactcttcttcagccagcaccttctcatggaactattatatacgagggtctattcgagctcatatctctctcaacttcttatctgaacacaactgacaatgactacccaaaccgcactggaagtctagcggtctcacttgctagccccgatggtcgtgtcattggtggtggaattggaggtcctctaatagcagcaagccaagtccaggtcattgttggcagcttcatttgggcaattccgaaagggaagattaaaaaacgtgaagaaacttctgaagatgtccaagatactgatgctttggaaaacaacaacgataacacagcagcaacgtcacctcctgttcctcagcaaagtcagaacattgttcagactcctgtaggcatttggtcaactggttcaaggtcaatggatatgcatcacccccatatggacattgatctaatgcgtggatgattcatgtatatataagcattgaatctaggagaagaagaagaaacttgagctaacctccctgaaacaaag

SEQ ID NO: 4248 - DNA, 1199 bp, Artificial Sequence; identical to SEQ ID NO: 703
  P1744 (35S::G937)

SEQ ID NO: 4249 - DNA, 712 bp, Artificial Sequence
  P1750 (35S::G347)
ttcgattccttacccttctccaatcgaagtttttggctttgaattggatttgggtttcgttccaaaatcagctctttttgttaatcagcagatatgcaggaccagctggtgtgtcatggttgtaggaatttattgatgtatcctagaggagcatctaatgtgcgttgtgcgttatgtaacactatcaacatggttcctcctcctcctccacctcacgacatggcacacattatatgtggtggttgtagaacaatgcttatgtatacgcgtggggctagtagcgtaagatgctcttgctgtcaaactacgaaccttgtgccagcgcactccaatcaggttgcccatgctccttccagtcaggttgcgcagatcaattgtgggcattgtcggacgaccctcatgtatccttacggtgcatcatccgtcaaatgcgctgtttgtcaattcgtaactaacgttaatatgagcaatggaagggtacctctcccaactaaccggccaaatggaacagcttgtcccccctctacatcaacttcaacaccaccctctcagacccaaaccgttgttgtagaaaaccccatgtccgttgatgaaagcggaaagttggtgagcaatgttgttgttggagtgacaactgacaaaaagtaatcaagaatgagtgagatcttaaagatcaaatccaaattcttcctctattcctgcgtttggtttg

SEQ ID NO: 4250 - DNA, 1341 bp, Artificial Sequence
  P1755 (35S::G1389)
acaaagcaagtgggcaacaaaaacggcacgcaagtttttcttccaagttaaaacaactcttggaatgtcattttgaaaggtaaaaaaataatgggacttaaaggatatagcgtcggagaaggaggaggagagatagttgaggttcaaggcggtcacataatccgagccactggacgcaaagaccgtcatagcaaagtgttcacatcaaagggtccacgtgaccggcgcgtgagactctcagctcacacggcgattcaattctacgatgtgcaagaccggttaggttatgaccggcctagcaaagccgttgattggctcatcaagaaagccaaaaccgctattgataagcttgaactcggggagactactactactactactcgtcaagaaccggtgaatactaaaccggaatctcccactttggttttccaaagagagaacaatgaccaaacgcagttcgtggcggccaatcttgatcctgaagacgcaatgaaaacgtttttcccggcgacgacaacaacaaacggtggtggtggtacaaacatcaatttccaaaactaccctcatcaggatgacaacaacatggtctcaagaacaacaacaccaccaccaaaccttagccaagatcttggtctctctcttcacccatttcaagggaacaacaacacagtcgtagttcccgagaccaacaatttcaccacgactcatttcgacacgttcgggagaatctctggatggaatcatcacgacttaactatgacgtcatcatcctcatcagaacatcaacaacaagaacaagaagaaaggagtaatggtggtttcatggtgaatcatcatcctcaccatcatcatcatcaaccgtcgatgatgacattgcttaatagtcagcaacaacaagtgtttcttggtggccaacaacaacaacaacaaaggggtacccttcagtccagtttattccctcattcgtttcgttcttgggatcatcatcaaacgacgtcggatcatcatcatcatcagaatcaagcttcttcgatgtttgcttcatcatcacagtatggttctcatgggatgatgatgatgcaaggccttagtttccccaacactacaagactactccacggagaagaagctactcaaccaaactcttcttcttctcctccaaactcacacctctaaactaaggtttgcttcttctttttaatgtatttatatattttaagtataataggttattaatcaagaaaccagacaataattaaatctttcataattaaattaccacatgtatttctttcagacaaccatggaggttcaaattcatgatgacatgcattgaacaag

SEQ ID NO: 4251 - DNA, 576 bp, Artificial Sequence
  P1762 (35S::G354)
ttcaaaatggttgcgagaagtgaggaaattgtgatagtggaagaagatacgactgcgaaatgtttgatgttgttatcaagagtcggagaatgcggcggcggctgcgggggagatgaacgtgttttccgatgcaagacttgtcttaaagagttctcatcgtttcaagctttgggaggtcatcgtgcaagccacaagaaacttatcaacagtgacaatccatcacttcttggatccttgtccaacaagaaaactaaaacgtctcatccttgtccgatatgtggagtgaagtttccgatgggacaagctcttggtggtcacatgaggagacataggaacgagaaagtctcaggctcgttggttacacgttcttttctaccggagacgacgacggtgacggctttgaagaaatttagtagtgggaagagagtggcttgtttggatttggacttagattcgatggagagtttggtcaattggaagttggagttgggaagaacgatttcttggagttaagtttttgggttgtatacagtttcacatgattttgtaatctttgttgatccaattatcgtaccg

SEQ ID NO: 4252 - DNA, 745 bp, Artificial Sequence
  P1763 (35S::G355)
cgttcaggtttcttttctaacaagcaaaaactccaacctttactttatttttgttttgttttgtaaccctctcagatcttaattctcaaagaagtatgaagagagaaagatctgatttcgaagaatccctcaagaatattgacattgctaaatgtctgatgatactagcacaaacctccatggtcaaacagatcggtttgaaccaacataccgagagccatacaagcaaccaattcgaatgcaaaacatgtaacaagagattttcttcgtttcaagcccttggtggccaccgggcaagccataagaagccaaagctcaccgttgagcagaaagatgtgaaacatcttagcaacgattataaaggaaatcattttcacaagtgttccatatgcagtcagagttttgggaccggacaggctttaggtggtcacatgagacggcataggtcaagcatgacggtcgagccatcgttcatctctccgatgattccatccatgccggttttgaaacgatgcggtagtagtaagaggattttgagtttggatttgaatctgactccgttagagaatgatcttgaatatatctttgggaagacatttgtcccaaaaatagatatgaagttcgttctttagttttttttttctttatctttaagaagacatttgtcccaaaaatgattcatttgtattgtaattcctattcttttaattcttcaaacgttaatgtcaacaaacttcatggtata

SEQ ID NO: 4253 - DNA, 1241 bp, Artificial Sequence
  P1767 (35S::G2123)
gaaatgcccaaaattactcttgtatacgaagaaatcagtgtagcaactttatccatctttctataaccttataagaagtaactaagcggttgttgtggcagatgtgatgaaatcgatgagaaaagtatgtgagcttgatatagagctaagtgaagaggaaagagacctactaacaactggatacaagaatgtcatggaggctaagagagtttcattgagagtaatatcatccattgaaaaaatggaagactcgaaaggaaacgaccaaaatgtgaaactgataaaaggacaacaagaaatggttaaatatgagtttttcaatgtttgtaatgacattttgtctctcattgattctcatctcataccatcaactactactaatgtcgaatcaattgtcctttttaacagagtgtaagtcatattccgttatcataatcatgatcaactctttttttttttttttttttaattagcattttgttatattgtttcttggtatgtgtaggaaaggagattattttcgatatatggcagagtttggttctgatgctgaacgtaaagaaaatgcagataattctctagatgcatataaggtcttctttcaatcatgtttaccctcaactttaatattttattttcccctattttcttcgaaatattagtttggaaaaagcatggaaaaacatgaaaaaggcatatattttgtaggttgcaatggaaatggcagagaatagtttagcacccaccaatatggttagacttggattggctttaaatttctcgatattcaattatgagatccataaatctattgaaaggtaatatcacatttgcttataaataaaataagtgcggcgtttcaaaatctatcaaaaactttgtatatataataactaatttatattttcattgccaattaattttaatgaacagttttttacagttttttgaatatcttagtttcttacagttaactaatagtaattttatatgtgaatttatacagcgcatgtaaattggttaagaaagcttacgatgaagcaatcactgaactcgatggccttgacaagaatatatgcgaagagagcatgtatatcatagagatgcttaaatacaatctttctacgtggacttcaggcgatggtaatggtaataagacagacggttagaaaatgtaatttgaggcgatatgatgaaggtaaatcattgatcgtgtttatcaggtttaatagtttacataa

SEQ ID NO: 4254 - DNA, 1411 bp, Artificial Sequence
  P1768 (35S::G989)
cctgtcattactctctcgaaccctttctcttttcgaatctccacttttttttctatcttctgcttcttcttcttctctcttcaatgattccactctcacaaaatctccatgactacaaaacgcatagacagagatctcccatcttccgacgatccttcctccgctaaacgccgtatcgaattccccgaagaaacactcgaaaacgacggtgctgccgcaatcaaactccttagcttactcctccaatgcgccgaatacgtagctactgatcatctccgtgaagcttcaacacttttatccgaaatctccgagatatgttctccgttcggttcctcgccggagcgagtcgtcgcttacttcgctcaagcgctacaaacgcgcgtgatcagctcttacctctccggcgcgtgttctcccctctccgagaaaccactcactgttgttcagtctcagaaaatcttctccgccttgcagacttataactccgttagtcctctgatcaaattctcacatttcacggcgaatcaagccatttttcaggcgcttgacggagaagattccgttcatatcatcgatctcgatgttatgcaaggtcttcaatggccggctctatttcacatcctcgcttcacgtcctcgaaaactccgatcaattcgaatcaccggatttggttcctcctccgatctactcgcttcaactggccggagactcgccgatttcgcatcatcgttaaacctccctttcgaatttcatccaattgaaggcataatcggaaacctaatcgatccgagccaactcgcaacgagacaaggagaagctgtggtggttcattggatgcagcaccggttatatgatgttacagggaacaatctcgagacgttggagattctacggaggctgaaaccgaatctgatcacggtggtggagcaagaattgagctacgacgatggaggaagctttttaggaagattcgtggaggctttgcattattatagcgcgttgtttgacgcgctaggagatggattgggtgaagagagtggtgagagattcacggtggagcagattgttttggggacggagataagaaacattgtggcgcacggaggaggaagaaggaagagaatgaagtggaaagaagaactgagccgggtcgggtttagacctgtttcgcttcggggtaacccggcgacacaagcgggtttattgttgggtatgttaccgtggaatggatatactttggttgaagagaatggaaccctccgtcttggctggaaggatctctcgcttttgactgcctctgcctggaaatctcagccgttcgattgattttatttttattttataatgcaaactgcaaagtgatcattaagattttttgttttgaaaatatttccaaacaaattacgataat

SEQ ID NO: 4255 - DNA, 1863 bp, Artificial Sequence
  P1770 (35S::G910)
gtcaccaatctctgatctttttagttctcttatcggtaaaaacttattcttctctttttgttcgatctgtgatctctaataaactaatttgatattttttttgatgtaacagggaggaatcttttatatgttatgtataataataattgagaatatggaaagagtatgtgagttttgtaaagcgtatagagcagtggtttattgtatagctgatacagcaaatctttgtttaacatgtgatgcaaaggttcattcagctaattcactctcgggacggcatttacgtacggttttatgtgattcttgtaagaatcagccttgtgttgttcgatgttttgaccataaaatgtttctttgccatggatgtaatgataagtttcatggtggtggctcttctgagcatcgtagaagggatttgaggtgttatacgggttgtcctcctgctaaagatttcgcggttatgtggggttttcgagttatggatgacgatgatgatgtttcgttagagcaatcttttcgaatggttaaacctaaggtttgatgcttgttttgtatacatatttacagtttcttataaccggtgtaagatctcgggtcgaaagtagactaatacacccgaggcttgtagaaagccgtctacaatggccaaaagagaaccacaacgatctgtggccttaaaccatagggcgagtctttcacctacttgaacaaaccactggaccatacgctctttagtttttttttgtatatctttttatagctttgtagatgaatagatctctttatagctgatgtaccgatgattttgatggtttcaggtgcaaagagaaggtggttttatcttggaacagattcttgaattggagaaggttcagctcagggaagagaatggtagttcttccttgacagaacgaggtgatccatctccattggagcttcctaagaaacccgaagaacagttaatcgatcttccgcagaccggaaaagagctggttgttgatttttcacacttgtcctcatcttccacacttggtgattccttttgggaatgcaaaagtccatacaataagaacaatcaggtttggtttaaatatcacacagtacatagtcttagtgggaaccattagttacatgagattagctctgtttctgcagttgtggcatcaaaatatacaagacattggagtatgtgaagatacaatctgcagtgacgatgacttccaaatacctgacattgatctcactttccggaactttgaagagcaatttggagctgatcctgagccaattgcagatagtaacaacgtgttctttgtttcttcccttgacaaatcacatgaggtttgaaatctttcatccactactatagagtctagttcagtaaccactatatatgttttattgttatataacctaagatctctctacctttgatgtgtgttcagatgaagacattttcttcttcattcaataatcccatatttgcacctaaaccagcttcatcaactatctcattctcaagcagtgaaaccgataacccttatagtcactcagaggaagtaatctcattttgtccctccctctctaacaatacacgtcaaaaggtcatcacaaggctcaaggagaagaagagagcaagagtgtaagtcttaaacaccgatgatcctaattcacattaaatagtatatcttaaacttttcataatgtaactagcattttcttaattcagggaggagaaaaaagcttaatatggtcccaagaaaatggcagagtaacacaatttcttgcaatgcctttgtacataagacactaatctacctcttcatctattttacatggctcagtttcttgcatgtaactgtg

SEQ ID NO: 4256 - DNA, 474 bp, Artificial Sequence
  P1772 (35S::G1929)
cttctttcctcaatatcacccagaagaaagagaaagtgaaacagatcaagaaagagattgagaaaaatgtgtagaggcttgaataatgaagagagcagaagaagtgacggaggaggttgccggagtctctgcacgagaccgagtgttccggtaaggtgtgagctttgcgacggagacgcctccgtgttctgtgaagcggactcggcgttcctctgtagaaaatgtgaccggtgggttcatggagcgaattttctagcttggagacacgtaaggcgcgtgctatgcacttcttgtcagaaactcacgcgccggtgcctcgtcggagatcatgacttccacgttgttttaccgtcggtgacgacggtcggagaaaccaccgtggagaatagaagtgaacaagataatcatgaggttccgtttgtttttctctgattattagatttttttggtgtaagctataaatattctagggtt

SEQ ID NO: 4257 - DNA, 1033 bp, Artificial Sequence
  P1774 (35S::G738)
cagggattaattactgtaattgaagctcacatcatggaccatcatcagtatcatcatcatgatcaataccaacatcagatgatgactagtactaacaataattcctataacaccatcgtcacaacacaaccaccaccaacaacaacaacaatggattcaacaacagcaacaactatgataatggatgacgagaagaagttgatgacgacaatgagcactaggccgcaagaaccaagaaactgtccaagatgcaactcaagcaacaccaagttttgttattacaacaactacagcttagcacagcctaggtacttgtgtaagtcttgtcggagatattggactgaaggtggctctctccgtaacgtccccgtaggcggaggttctagaaagaacaagaagcttccatttcctaattcctctacttcttcttccaccaagaacctcccggatctcaaccctcctttcgtcttcacatcatcagcttcatcatcaaaccctagcaagacgcatcaaaacaataatgacctcagcctatccttctcctcccctatgcaagacaagcgagctcaagggcattacggtcatttcagtgagcaagttgtgacaggagggcagaactgtcttttccaagctcctatgggaatgattcagtttcgtcaagagtatgatcatgagcaccccaaaaagaatcttgggttttcattagacaggaacgaggaagagattggtaatcatgataacttcgttgttaatgaggaaggaagtaagatgatgtatccttatggagatcatgaagaccgtcaacaacatcaccatgtgagacacgatgatggtaataagaagagagaaggtggttcaagcaatgagctatggagcggaatcatcctaggtggtgatagtggtggaccaacatggtgatatgaatattgtcaaaaaggacaagatgataaagacaaaaacaaatagttacgagcaaaaatatgtgattatatttggaattttcagacccggaatagtcgccttgggagggagg

SEQ ID NO: 4258 - DNA, 1494 bp, Artificial Sequence
  P1778 (35S::G1895)
cacataacacaaatctaatctcatactccatcttcttttctgtcttatgtcttcaaagattggtatgtctcaagttagagatactccggttaaattgtttggctggacaattacaccggtttctcatgatccatactcttcttcgtcccatgttcttcctgattcttcctcgtcttcctcgtcttcttctctatcacttcgaccacacatggtatgtttcatggtcttacctttatttgttaagaaatgctaaagatttaatattttctctagtccttgtatcagtttgaaactagttcatgatgttaatcctaatccaagttccttcaatttttttcagatgaataaccaatctgttactgacaatacaagtcttaagctgtcatctaatcttaacaacgagtcaaaagaaacatctgagaacagtgatgaccaacacagcgagatcacaacaattacatcggaagaagagaaaacaactgaactgaagaaaccagacaagattcttccatgtccgagatgcaacagcgcagacaccaaattctgttactacaacaactacaacgttaaccagccacgtcacttctgtagaaaatgccagaggtattggaccgctggtggatccatgaggatcgtcccggttggctcaggccgtcgcaagaacaagggatgggtttcttcagaccagtacctgcacatcacttccgaggatactgacaattacaatagctcctcaacaaagattctaagcttcgagtcttcggactctttggtaactgagaggcctaagcatcaatcaaacgaagtgaagataaacgctgaacctgtttcacaagaacccaacaacttccaagggttacttcctccccaagcatcccctgtttcgcctccttggccttaccaataccctccaaaccctagtttctaccacatgcccgtctactggggctgcgcgataccggtttggtctaccctcgacacttctacatgtcttgggaaaaggacaagagacgaaacttctcatgaaactgttaaagagagtaaaaatgcttttgagagaacaagcttgcttttggaatctcagagcatcaaaaatgaaacaagtatggctacaaataaccatgtgtggtatccagtaccgatgacccgcgagaagacacaagaattcagctttttcagtaatggagctgaaacaaagagcagcaacaacagattcgtccctgaaacgtatcttaacctgcaagcaaaccctgcagccatggcaagatctatgaacttcagagagagcatataacgttaaaggagaaaagaaactttgtagatacctttttttgtgtgatgaattaacttttaatatctatcttatttatataccacaatccccattttgtagattatccaaacagatggaaatgctgaagtgtaatgtcttttttggtaaatgtggttcgaaaatattgtttactccattatttgtattttgtagtactagtg

SEQ ID NO: 4259 - DNA, 1120 bp, Artificial Sequence; identical to SEQ ID NO: 621
  P1786 (35S::G818)

SEQ ID NO: 4260 - DNA, 1440 bp, Artificial Sequence; identical to SEQ ID NO: 1073
  P1787 (35S::G1560)

SEQ ID NO: 4261 - DNA, 1605 bp, Artificial Sequence; identical to SEQ ID NO: 1287
  P1788 (35S::G1946)

SEQ ID NO: 4262 - DNA, 1683 bp, Artificial Sequence
  P1791 (35S::G839)
atcttcatgcaagattgataattctacaagaagaagaagaagagaaaatggctactttgactgagccatcatcatctttgagtttcacatcttctcatttctcttatggttctattgggtccaatcacttctcatcaagctcagcttctaatcctgaagttgttagtctaaccaaactcagctccaatcttgagcagcttcttagtaattcagattgtgattacagtgatgcagagatcattgttgatggtgttccagttggtgttcatagatgcattttagctgcaagaagtaagtttttccaagatttgtttaagaaagaaaagaaaatttcgaaaactgagaaaccaaagtatcagttgagagagatgttaccttatggagctgttgctcatgaagctttcttgtatttcttgagttatatatatactgggagattaaagccttttccattggaggtttcgacttgtgttgatccagtttgttctcatgattgttgtcgacctgccattgattttgttgttcaattgatgtatgcttcctctgttctccaagtgcctgagctagtttcatcttttcagcggcggctttgtaactttgtggagaagacccttgttgagaatgttcttcccattcttatggttgctttcaattgtaagttgactcagcttcttgatcagtgtattgagagagtggcgaggtcagatctttacaggttctgtattgaaaaggaagttcctcccgaagtagcagagaagattaaacagcttcgacttatatccccgcaagacgaagaaaccagtcccaagatttcggagaaattgcttgaaagaatcggtaaaattctcaaggccttggattcatatgatgttcttcattttgctgcgatgcgtagagagccatcgatcattatatcgcttatcgataaaggcgccaatgcatctgagtttacatctgacggacgtagcgcagttaatatattaagaagactgacaaatccaaaggattatcataccaaaacagctaaagggcgtgaatctagtaaagccaggttatgcatcgatatcttggaaagagaaatcaggaagaaccccatggttctagatacaccaatgtgttccatttctatgcctgaagatctccagatgagactgttgtacctagaaaagagagtggggcttgctcagttgttctttccaacggaagctaaagttgctatggacattggtaacgtagaaggtacaagtgagttcacgggtttgtcacctccttcgagtgggttaaccggaaacttgagtcaggttgatttaaacgaaactcctcatatgcaaacccaaagacttcttactcgtatggtggctctaatgaaaacagttgagactggtcgaaggttttttccatatggttcagaggttctagataagtacatggctgagtatatagacgacgacatcctcgacgatttccattttgagaagggatctacacatgaaagaagattgaaaagaatgagatatagagagcttaaggatgatgtccaaaaggcatatagcaaagacaaagagtctaagattgcgcggtcttgtctttctgcttcatcttctccttcttcttcttccataagagatgacctgcacaacacaacatgaaactgcaccataagtcaaatgtaattagatatct

SEQ ID NO: 4263 - DNA, 1410 bp, Artificial Sequence; identical to SEQ ID NO: 1325
  P1797 (35S::G2030)

SEQ ID NO: 4264 - DNA, 1362 bp, Artificial Sequence
  P1813 (35S::G2011)
cacaccccaatttctcactctctctctcactaaaacccgtaaattttctactatatcaaatgagcccaaaaaaagatgctgtttctaaaccaactccaatttcagtacccgtttcgagacgatccgatatacccgggtctctctacgtcgacactgacatgggtttctctgggtcaccacttcccatgccactagacatcttacaagggaatccaattccaccttttttatccaagacttttgatttggttgatgacccgactcttgacccggtcatctcttggggactgaccggagctagcttcgtagtttgggatcctctagagtttgccagaatcatacttccaaggaatttcaaacacaacaatttctccagcttcgtcagacagcttaacacttatggatttcgaaagattgatactgacaagtgggaattcgctaacgaggctttccttagaggcaagaagcatcttctgaagaacattcatcgtcgtcgatcaccacaatccaaccaaacttgctgcagtagcactagccaaagccaagggtcacctactgaggttggaggagagattgagaagctgaggaaagagcggcgtgcattgatggaggaaatggttgagcttcagcagcaaagcagaggcacagctcgacatgtggacactgtaaaccagaggctgaaagctgcagagcaacgtcagaagcaattgctctctttcttggctaagttgtttcagaaccggggtttcttggaacgcctgaagaacttcaaaggaaaagaaaaaggaggagctcttggattggaaaaggcgagaaagaagttcatcaagcaccaccagcagcctcaagattctccaacaggaggggaggtggtgaagtatgaagctgatgattgggagagattgctaatgtatgacgaagagactgagaacaccaagggtttaggagggatgacttcaagcgatccaaaaggcaagaacttgatgtatccatcagaagaagagatgagcaaaccagattacttgatgtccttcccatctcctgaaggacttattaaacaagaagagacgacatggagcatgggtttcgatactacaataccgagtttcagcaacaccgatgcatggggaaacacaatggactataatgatgtctcagagtttggttttgctgcagaaacaacaagtgatggtttgcctgatgtctgctgggaacaatttgctgcaggaatcacagagactggattcaactggccaactggtgatgatgatgataatacgccaatgaatgatccttaggatcttttcatatatagtttagaccaaaaacccgtttcttatcgggtgaactattaattcatta

SEQ ID NO: 4265 - DNA, 832 bp, Artificial Sequence; identical to SEQ ID NO: 1539
  P1829 (35S::G2512)

SEQ ID NO: 4266 - DNA, 828 bp, Artificial Sequence
  P1830 (35S::G2513)
tttcaacagtaatttaagttaaccggagtctctttttgttttccggcgaatttttggtactttgagttatgaataatgatgatattattctggcggagatgaggcctaagaagcgtgcgggaaggagagtgtttaaggagacacgtcacccagtttacagaggcataaggcggaggaacggtgacaaatgggtctgcgaagtcagagaaccgacgcaccaacgccgcatttggctcgggacttatcccacagcagatatggcagcgcgtgcacacgacgtggcggttttagctctgcgtgggagatccgcatgtttgaatttcgccgactccgcttggcggcttccggtgccggaatccaatgatccggatgtgataagaagagttgcggcggaagctgcggagatgtttaggccggtggatttagaaagtggaattacggttttgccttgtgcgggagatgatgtggatttgggttttggttcgggttccggctctggttcgggatcggaggagaggaattcttcttcgtatggatttggagactacgaagaagtctcaacgacgatgatgagactcgcggaggggccactaatgtcgccgccgcgatcgtatatggaagacatgactcctactaatgtttacacggaagaagagatgtgttatgaagatatgtcattgtggagttacagatattaagtgggactcacatatctactatacataatatttagcttttatgtaagaggtatttatgtgagttttaagattgtagatgtgtcccaggcgttagaagtttccttgatggtatggaatctttgtacctata

SEQ ID NO: 4267 - DNA, 820 bp, Artificial Sequence
  P1831 (35S::G2107)
accacaaaacagagcaacacacaacacaaagcttcatttcaattctgtttcgagaaccctttgagaaccagatcggagatggaaaacgacgatatcaccgtggcggagatgaagccaaagaagcgtgctggacggaggattttcaaggagacacgtcacccaatctacagaggcgtgcggcgtagggacggcgacaaatgggtatgcgaagtccgtgaaccgattcatcagcgtcgagtctggctcggaacttatccgacggcagatatggccgcacgtgctcacgacgtggcggttcttgctctgcgcgggagatccgcgtgtttgaatttctccgattctgcttggaggttgccggtgccggcatccactgatccggacacgatcaggcgcacggcggccgaagcagcggagatgttcaggccgccggagtttagtacaggaattacggttttaccctcagccagtgagtttgacacgtcggatgaaggagtcgctggaatgatgatgaggctcgcggaggagccgttgatgtcgccgccaagatcgtacattgatatgaatacgagtgtgtacgtggacgaagaaatgtgttacgaagatttgtcactttggagttactaaaatacgtatgtgttaaaaaaccaaagatcgtatgtgtatgtatgcataataaatgggcttaatgatgggcatagatatgataggtccagcctatatgttaaatgtgttttattttttggtttatctagtttcctaggtatttaccaaattgtattagtataagttttattaagaaataatcaaaaatgttgttgcc

SEQ ID NO: 4268 - DNA, 931 bp, Artificial Sequence; identical to SEQ ID NO: 1547
  P1833 (35S::G2517)

SEQ ID NO: 4269 - DNA, 1004 bp, Artificial Sequence
  P1835 (35S::G2131)
ctctcaatcttttattcttctcattcaccggtaatggcaaaagtctctgggaggagcaagaaaacaatcgttgacgatgaaatcagcgataaaacagcgtctgcgtctgagtctgcgtccattgccttaacatccaaacgcaaacgtaagtcgccgcctcgaaacgctcctcttcaacgcagctccccttacagaggcgtcacaaggcatagatggactgggagatacgaagcgcatttgtgggataagaacagctggaacgatacacagaccaagaaaggacgtcaagtttatctaggggcttacgacgaagaagaagcagcagcacgtgcctacgacttagcagcattgaagtactggggacgagacacactcttgaacttccctttgccgagttatgacgaagacgtcaaagaaatggaaggccaatccaaggaagagtatattggatcattgagaagaaaaagtagtggattttctcgcggtgtatcaaaatacagaggcgttgcaaggcatcaccataatgggagatgggaagctagaattggaagggtgtttggtaataaatatctatatcttggaacatacgccacgcaagaagaagcagcaatcgcctacgacatcgcggcaatagagtaccgtggacttaacgccgttaccaatttcgacgtcagccgttatctaaaccctaacgccgccgcggataaagccgattccgattctaagcccattcgaagccctagtcgcgagcccgaatcgtcggatgataacaaatctccgaaatcagaggaagtaatcgaaccatctacatcgccggaagtgattccaactcgccggagcttccccgacgatatccagacgtattttgggtgtcaagattccggcaagttagcgactgaggaagacgtaatattcgattgtttcaattcttatataaatcctggcttctataacgagtttgattatggaccttaatcgtattttctacaagttttgttttgatt

SEQ ID NO: 4270 - DNA, 662 bp, Artificial Sequence
  P1839 (35S::G2094)
cactagttcacgaatcacgatctgcggttcctgaagctggtaatgctagatcccaccgagaaagtaatcgattcagaatcaatggaaagcaaactcacatcagtagatgcgatcgaagaacacagcagcagtagcagtaatgaagctatcagcaacgagaagaagagttgtgccatttgtggtaccagcaaaacccctctttggcgaggcggtcctgccggtcccaagtcgctttgtaacgcatgcgggatcagaaacagaaagaaaagaagaacactgatctcaaatagatcagaagataagaagaagaagagtcataacagaaacccgaagtttggtgactcgttgaagcagcgattaatggaattggggagagaagtgatgatgcagcgatcaacggctgagaatcaacggcggaataagcttggcgaagaagagcaagccgccgtgttactcatggctctctcttatgcttcttccgtttatgcttaacgaattttctggatcttaagttttaaggtgaaataataattaattttgtaggatgtgtaacgaattaatgtgtaatttttgtatgcgtttttttggtgttgtttgaattaactaaattttgaaatttttgtatcttgtttatgtgatctctggtgaagaatgaatgaatg

SEQ ID NO: 4271 - DNA, 1281 bp, Artificial Sequence
  P1840 (35S::G2147)
gtcaagagtttgaacacacaaagaagaaagaagaactcaacatttcaagcaagaagaaagagagaagagagaaggtccaataatagagagaacaaaaaaaaagagagcttaattgtcagtttattctctgcaaacgtgcggcctaagtaacacatgtcgaattatggagttaaagagctcacatgggaaaatgggcaactaaccgttcatggtctaggcgacgaagtagaaccaaccacctcgaataaccctatttggactcaaagtctcaacggttgtgagactttggagtctgtggttcatcaagcggctctacagcagccaagcaagtttcagctgcagagtccgaatggtccaaaccacaattatgagagcaaggatggatcttgttcaagaaaacgcggttatcctcaagaaatggaccgatggttcgctgttcaagaggagagccatagagttggccacagcgtcactgcaagtgcgagtggtaccaatatgtcttgggcgtcttttgaatccggtcggagcttgaagacagctagaaccggagacagagactatttccgctctggatcggaaactcaagatactgaaggagatgaacaagagacaagaggagaagcaggtagatctaatggacgacggggacgagcagcagcgattcacaacgagtccgaaaggagacggcgtgataggataaaccagaggatgagaacacttcagaagctgcttcctactgcaagtaaggcggataaagtctcaatcttggatgatgttatcgaacacttgaaacagctacaagcacaagtacagttcatgagcctaagagccaacttgccacaacaaatgatgattccgcaactacctccaccacagtcagttctcagcatccaacaccaacaacaacaacaacaacagcagcagcagcagcaacaacagcagcaacagtttcagatgtcgttgcttgcaacaatggcaagaatgggaatgggaggtggtggaaatggttatggaggtttagttcctcctcctcctcctccaccaatgatggtccctcctatgggtaacagagactgcaccaacggttcttcagccacattatctgatccatacagcgcctttttcgcacagacaatgaatatggatctctacaataaaatggcagcagctatctatagacaacagtctgatcaaacaacaaaggtaaatatcggcatgccttcaagttcttcgaatcatgagaaaagagattagtctagcgacctagtattattgatccat

SEQ ID NO: 4272 - DNA, 1444 bp, Artificial Sequence; identical to SEQ ID NO: 717
  P1852 (35S::G962)

SEQ ID NO: 4273 - DNA, 938 bp, Artificial Sequence
  P1856 (35S::G2371)
tcctctctctctctctcactccaagaaaccaaaaaaaaagatgtcagtcaaccattaccacaacactctctcgttgcatcatcaccaccaaaacgacgtagctatagcacaacgagagtctttgttcgagaaatcactcacaccaagcgacgtcggaaagctaaaccgcttagtcataccaaaacaacacgccgagaaatacttccctctcaataataataataataatggcggcagcggagatgacgtggcgacgacggagaaagggatgcttcttagcttcgaggatgagtcaggcaagtgttggaaattcagatactcttattggaacagtagccaaagctacgtgttgaccaaaggatggagcaggtacgtcaaagacaaacacctcgacgcaggcgacgttgttttctttcaacgtcaccgttttgatctccatagactcttcattggctggcggagacgcggtgaagcttcttcctctcccgctgtctccgttgtgtctcaagaagctctagttaatacgacggcgtattggagcggcttgactacaccttatcgtcaagtacacgcgtcaactacttaccctaatattcaccaagagtattcacactatggcgccgtcgttgatcatgctcagtcgataccaccggtggtcgcaggtagctcgaggacggtgaggctttttggcgtgaacctcgaatgtcatggtgatgccgtcgagccaccaccgcgtcctgatgtctataatgaccaacacatttactattactcaactcctcatcccatgaatatatcatttgctggggaagcattggagcaggtaggagatggacgaggttgatgactgacattcaaaaagaagtgacaactttctagatttttaactttagaatttagattatgggcccatacttggcccaattgtcatagagaaa

SEQ ID NO: 4274 - DNA, 1997 bp, Artificial Sequence; identical to SEQ ID NO: 1507
  P1857 (35S::G2430)

SEQ ID NO: 4275 - DNA, 1223 bp, Artificial Sequence; identical to SEQ ID NO: 1527
  P1858 (35S::G2465)

SEQ ID NO: 4276 - DNA, 2324 bp, Artificial Sequence; identical to SEQ ID NO: 853
  P1891 (35S::G1190)

SEQ ID NO: 4277 - DNA, 2334 bp, Artificial Sequence
  P1897 (35S::G2543)
taaatggtccattagtagtttgtggttgggtgaaaagtaaagagattaaagactgttttactgtcttttcgaaacattaattaaaaaaaatgagtttcgtcgtcggcgtcggcggaagtggtagtggaagcggcggagacggtggtggtagtcatcatcacgacggctctgaaactgataggaagaagaaacgttaccatcgtcacaccgctcaacagattcaacgccttgaatcgagtttcaaggagtgtcctcatccagatgagaaacagaggaaccagcttagcagagaattgggtttggctccaagacaaatcaagttctggtttcagaacagaagaactcagcttaaggctcaacatgagagagcagataatagtgcactaaaggcagagaatgataaaattcgttgcgaaaacattgctattagagaagctctcaagcatgctatatgtcctaactgtggaggtcctcctgttagtgaagatccttactttgatgaacaaaagcttcggattgaaaatgcacaccttagagaagagcttgaaagaatgtctaccattgcatcaaagtacatgggaagaccgatatcgcaactctctacgctacatccaatgcacatctcaccgttggatttgtcaatgactagtttaactggttgtggaccttttggtcatggtccttcactcgattttgatcttcttccaggaagttctatggctgttggtcctaataataatctgcaatctcagcctaacttggctatatcagacatggataagcctattatgaccggcattgctttgactgcaatggaagaattgctcaggcttcttcagacaaatgaacctctatggacaagaacagatggctgcagagacattctcaatcttggtagctatgagaatgttttcccaagatcaagtaaccgagggaagaaccagaactttcgagtcgaagcatcaaggtcttctggtattgtcttcatgaatgctatggcacttgtcgacatgttcatggattgtgtcaagtggacagaactctttccctctatcattgcagcttctaaaacacttgcagtgatttcttcaggaatgggaggtacccatgagggtgcattgcatttgttgtatgaagaaatggaagtgctttcgcctttagtagcaacacgcgaattctgcgagctacgctattgtcaacagactgaacaaggaagctggatagttgtaaacgtctcatatgatcttcctcagtttgtttctcactctcagtcctatagatttccatctggatgcttgattcaggatatgcccaatggatattccaaggttacttgggttgaacatattgaaactgaagaaaaagaactggttcatgagctatacagagagattattcacagagggattgcttttggggctgatcgttgggttaccactctccagagaatgtgtgaaagatttgcttctctatcggtaccagcgtcttcatctcgtgatctcggtggagtgattctatcaccggaagggaagagaagcatgatgagacttgctcagaggatgatcagcaactactgtttaagtgtcagcagatccaacaacacacgctcaaccgttgtttcggaactgaacgaagttggaatccgtgtgactgcacataagagccctgaaccaaacggcacagtcctatgtgcagccaccactttctggcttcccaattctcctcaaaatgtcttcaatttcctcaaagacgaaagaacccgtcctcagtgggatgttctttcaaacggaaacgcagtgcaagaagttgctcacatctcaaacggatcacatcctggaaactgcatatcggttctacgtggatccaatgcaacacatagcaacaacatgcttattctgcaagaaagctcaacagactcatcaggagcatttgtggtctacagtccagtggatttagcagcattgaacatcgcaatgagcggtgaagatccttcttatattcctctcttgtcctcaggtttcacaatctcaccagatggaaatggctcaaactctgaacaaggaggagcctcgacgagctcaggacgggcatcagctagcggttcgttgataacggttgggtttcagataatggtaagcaatttaccgacggcaaaactgaatatggagtcggtggaaacggttaataacctgataggaacaactgtacatcaaattaaaaccgccttgagcggtcctacagcttcaactacagcttgacacacaccattaaaagctctcttccctctttcttctgggtgtctctttctcttcaatgatggaacagagaagggaa

SEQ ID NO: 4278 - DNA, 1668 bp, Artificial Sequence
  P1898 (35S::G922)
gttaagagtctctcaaagtttaaatctttctttacaaaaaaggttacttttggttctgagtaaatcaaaatcaagcttttggccttcaatggtggctatgtttcaagaagataatggaacatcttctgtagcttcatcaccacttcaagtcttctcaactatgtcactcaacagaccgactctcctcgcttcttcatctccgtttcattgtctcaaagatctcaaaccagaggagcgtggtctctacttaatccacctcttgctaacttgtgccaaccacgtggcttcaggtagcctccaaaacgctaacgcagcgctcgagcagctctctcacctcgcttctcctgacggcgacacgatgcagcgaatcgctgcttacttcaccgaagcgcttgctaacagaatccttaagtcctggcctggtctttacaaggctcttaacgcaactcagacaagaactaacaatgtctctgaggagattcatgttagaagactcttctttgagatgttcccgatactcaaagtctcttacttgctcactaatcgagctatactcgaggctatggaaggagagaagatggttcatgtgattgatctcgatgcttctgagccagctcaatggcttgctttgcttcaagcttttaactctaggcctgaaggtccacctcatttgagaatcactggtgttcatcaccagaaggaagtgcttgaacaaatggctcatagactcattgaggaagcagagaaactcgatatcccgtttcagtttaatcccgttgtgagtaggttagactgtttaaatgtagaacagttgcgggttaaaacaggagaggccttagccgttagctcggttcttcaattgcataccttcttggcctctgatgatgatctcatgagaaagaactgcgctttacggtttcagaacaaccctagtggagttgacttgcagagagttctaatgatgagccatggctctgcagctgaggcacgtgagaatgatatgagtaacaacaatgggtatagccctagcggtgactcggcctcatctttgcctttaccaagttcaggaaggactgatagcttcctcaatgctatttggggtttgtctccaaaggtcatggtggtcactgagcaagactcagaccacaacggctccacactaatggagaggctattagaatcactttacacctacgcagcattgtttgattgcttggaaacaaaagttccaagaacgtctcaagataggatcaaagtggagaagatgctcttcggggaggagatcaagaacatcatatcctgcgagggatttgagagaagagaaagacacgagaagcttgagaaatggagccagaggatcgatttggctggttttgggaatgttcctcttagctattatgcgatgttgcaggctaggagattgcttcaagggtgcggttttgatgggtatagaatcaaggaagagagcgggtgcgcagtaatttgctggcaagatcgacctctatactcggtatcagcttggagatgcaggaagtgaatgatatattacagtttgtcttctattttggttatgagcagagtccctttcttttttgtatacatggggacacaatcttagttgttttgtgatggtgactttctgtctctttatgctattttggcttaaat

SEQ ID NO: 4279 - DNA, 1501 bp, Artificial Sequence; identical to SEQ ID NO: 347
  P1900 (35S::G427)

SEQ ID NO: 4280 - DNA, 914 bp, Artificial Sequence
  P1905 (35S::G2143)
caccagcttctccatatctctcaaagaaaaaacaaaccctataaattccacaaaaaaggaggatggataactccgacattctaatgaacatgatgatgcagcagatggagaagcttcctgaacacttctctaactcaaaccctaaccctaatccccataacattatgatgctttctgaatccaacacccacccgttcttcttcaaccccactcattctcatctcccatttgaccaaaccatgcctcaccaccaacccggtttaaatttccggtacgccccctccccgtcatcatctctcccggagaagagaggaggctgcagcgacaacgccaacatggcggcgatgagagagatgatctttcgaatagccgtgatgcagcctatacatattgatccggaatccgtaaagccaccaaagagaaagaacgtgaggatctctaaggatccacagagcgtggcagctcggcatcgaagggagaggataagcgagcggattcggattcttcagcggcttgttcccggtgggactaagatggatacggcgtcgatgctcgatgaggctatccattacgttaagtttctcaagaagcaagtgcagtcgctggaggaacatgcggtggttaacggcggaggaatgacggcggtggccggaggagcacttgcgggtactgttggtggaggatatggaggaaaagggtgtggcattatgcggtctgatcatcaccagatgcttggaaatgcacagattcttagatgatgatgatgttgatttttaaatatatatcatatgtttattaatatgacgggaaaaaatattatcgagggagttgaatttagtatcatgaaactatgagagcattttttttaaatgtttttatctttccgggtttcgataatgtttgggatggttaat

SEQ ID NO: 4281 - DNA, 1335 bp, Artificial Sequence
  P1906 (35S::G2144)
gctgaatttggtttcgattattggtgttattgttttcgaagatttccagtgagtttccgtttatggatctgactggaggatttggagctagatccggcggtgttggaccgtgccgggaaccaataggccttgaatcgctacatctcggtgacgaatttcggcaactagtgacgactttacctcccgagaaccccggcggttcgttcacggctttgcttgagcttccacctacacaagcagtggagcttctccatttcactgattcttcgtcttctcaacaagcggcagtgacagggatcggtggagagattcctccgccgcttcactctttcggtgggacattggcttttccttctaactcagttctcatggagcgagcagctcgtttctcggtgattgccactgagcaacaaaacggaaatatctccggggagactccgacgagctctgtaccttccaattcaagtgctaatctcgacagagtcaagacggagcctgctgagaccgattcatctcagcggttgatttctgattcagcgattgagaatcaaatcccttgccctaaccagaacaatcgaaatgggaagaggaaagatttcgaaaagaagggtaaaagctcgacgaagaagaacaaaagctctgaagagaacgagaagctgccatatgttcacgttagagctcgtcgtggtcaagcaaccgatagccatagcttagcagaacgagcaagaagagagaagataaatgcacgaatgaagctgttacaggaactggtcccaggctgtgataagattcaaggtaccgcgctggtgctggatgaaatcattaaccatgtccagtcattacaacgtcaagtggagatgctatcaatgagacttgctgcggtaaaccccagaatcgacttcaatctcgacaccatattggcttcagaaaacggttctttaatggatgggagcttcaatgccgcaccaatgcagcttgcttggcctcagcaagccattgagaccgaacagtcctttcatcaccggcaactgcaacaaccaccaacacaacaatggccttttgacggcttgaaccagccggtatggggaagagaagaggatcaagctcatggcaatgataacagcaatttgatggcagtttctgaaaatgtaatggtggcttctgctaatttgcacccaaatcaggtcaaaatggagctgtaagttgggaaaacggtagagatcatgaatgtgtatatacatcgtataagctcgtttctctctatataaatataatcataaatatagatatctgttaagaaggtatcagtcatttgattcagagagacaacactgg

SEQ ID NO: 4282 - DNA, 816 bp, Artificial Sequence
  P1933 (35S::G1808)
ccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaag

SEQ ID NO: 4283 - DNA, 557 bp, Artificial Sequence
  P1935 (35S::G2070)
cattctctagctttaacacaaattataccaatatcttttgccacttacatcaatgttttatactaatatggagacggttcataactgcttcaatgatgctacgataaccggtgatgaaatcattgatatattggcgtttcttcaatcagacgagtcggacaatccaagcggtataaacgaggtagtaccggtggatgataagaagagaagacggacgatatcaaaccgggaatcggccaagagatcgaggatgaaaaagaagaaacgttttgaagagttaactgaagaggtgaaccggttaaacataagaaatcaggagctgaaaaaccggttagctaatgttgttagttgtggtaattttatatctagggagaataaccggttgaaaaccgaatcggtttgccttgagataaggcttttagagttgtaccgttttttagtggccatgcaatcgccaatctcaacgagtgtaaattacatcacaacgctcgagatttaagtttgaaacaaaataaacagaaaaacgatgccaagtaactttgagcatttttgtaaag

SEQ ID NO: 4284 - DNA, 1536 bp, Artificial Sequence; identical to SEQ ID NO: 1359
  P1937 (35S::G2105)

SEQ ID NO: 4285 - DNA, 508 bp, Artificial Sequence
  P1939 (35S::G2117)
catacttgtcaacaaaaattttcttaaagaacgcataactgtttttttcatggctggttctgtctataaccttccaagtcaaaaccctaatccacagtctttattccaaatctttgttgatcgagtaccactttcaaacttgcctgccacgtcagacgactctagccggactgcagaagataatgagaggaagcggagaaggaaggtatcgaaccgcgagtcagctcggagatcgcgtatgcggaaacagcgtcacatggaagaactgtggtccatgcttgttcaactcatcaataagaacaaatctctagtcgatgagctaagccaagccagggaatgttacgagaaggttatagaagagaacatgaaacttcgagaggaaaactccaagtcgaggaagatgattggtgagatcgggcttaataggtttcttagcgtagaggccgatcagatctggaccttctaatcgtctcgtaagcttgttggttttttgttgtttatttaaagg

SEQ ID NO: 4286 - DNA, 3003 bp, Artificial Sequence
  P1944 (35S::G2192)
ggaaagagatcaaccaacgatagaggagaagaagaacttgcatacgcaaaaaaactttcccgggaaaattccagaaactgctttggaaaaatgtgcgagcccgatgataattccgctagaaacggcgtcactactcaaccttcgaggtcaagggagcttctaatggatgttgacgacttagatcttgacggttcatggccactagatcaaatcccttacttatcctcatcgaatcgcatgatttctccgatttttgtctcctcttcctctgagcagccttgctcgcctctctgggctttctccgacggtggaggaaatggttttcaccacgcaacctccggtggcgatgatgagaagatcagctctgtctccggtgttccttctttccgtctcgccgagtatcctctcttcctcccttactcttctccatcagcagctgagaacacaacagagaagcataacagtttccagtttccgtctccattgatgagcctagtcccaccagagaacacagacaactactgtgtgatcaaagagaggatgactcaggcgcttcgatacttcaaagaatcaaccgaacaacacgttttggctcaggtctgggctcctgtgagaaagaatggtcgtgatttgctgacgactttgggtcaaccttttgttcttaatcctaatggtaatgggcttaatcaatacaggatgatctctctcacatatatgttttctgtggatagtgaaagtgacgtagagctcggactcccgggtcgagttttccgtcagaaattgcctgaatggactccaaatgttcagtactattccagcaaagaattctcgcggcttgatcacgccttgcactacaacgtgcgtggtacactggccttgcctgtctttaatccctctggtcagtcctgcataggtgttgtggaacttataatgacctcagagaagattcactatgcacccgaagtggacaaagtttgcaaagcccttgaggcggtaaatctgaaaagctcggaaatacttgatcaccaaacaacacagatatgcaatgagagtcgccaaaacgcgcttgctgagattctcgaagtgctgacagttgtatgtgagacccataacttgcctctcgctcagacttgggttccatgtcagcatgggagcgttcttgccaatggtggcggtctaaagaaaaactgcaccagctttgacggtagctgcatgggtcaaatctgcatgtctacaaccgacatggcctgctatgtcgtggatgctcatgtctggggctttagagatgcctgtcttgaacaccatctccagaaaggccagggagtcgctggacgagcttttctcaatggtggctcatgtttctgcagagacatcaccaagttctgcaaaacgcagtacccactagtccattatgcgctcatgttcaagttgaccacttgttttgcaatatctctccagagctcttacacgggcgacgacagttacattcttgaattttttcttccttcgagtataacagacgaccaagagcaagatttgctgttgggttctattttggtgacaatgaaagaacattttcagagtctgagggttgcatctggggttgactttggtgaagatgacgacaaattgtctttcgagatcatccaagcattaccggacaagaaggttcattcaaaaatagaatccattcgagttcccttttctggttttaagtcaaatgcaacagagacgatgttgattcctcagcctgtggttcagtcttctgatccagtaaatgagaaaatcaacgtggccactgttaacggtgtggttaaggagaagaagaaaacagagaaaaagcgtgggaagactgagaaaacaatcagtctagatgtacttcagcagtatttcactggaagtctcaaagacgctgcaaagagcctaggagtttgcccgacgacaatgaagcgaatttgcaggcaacacggaatctcgcggtggccatcgaggaagatcaagaaagtgaatcgttcaatcacaaagctgaaacgagtcatcgaatctgttcaaggtactgatggaggcctcgacctgacttccatggccgttagttccatcccttggacacacggtcaaacatcagcacagccactaaactcacccaatggttccaaaccacctgagctaccaaacaccaataattcacctaaccattggtcaagtgatcacagtccgaacgagccaaatggttcgcctgagttaccaccaagcaatggtcacaagcgatcacgaacggtggatgagagcgctgggactccaacctctcatggctcatgtgacggtaaccaattagatgaaccgaaagtcccaaatcaagatccgctcttcacggttggtggatcacccgggctcctttttccaccttattctagagatcatgatgtatctgcagcttccttcgcaatgccgaacaggcttcttggttctatagaccatttccgaggaatgctcattgaagacgctggaagttcaaaagatctgagaaatctctgccccactgcagcatttgacgataagtttcaagacacaaactggatgaacaatgataataatagcaacaacaacttatacgctcccccaaaggaagaggccattgcaaatgttgcatgcgaaccatcaggctcagaaatgagaacggtaacaatcaaagcaagttacaaagacgacataatacggttcagaatatcctcgggttcaggtataatggaattgaaggatgaagtggctaagaggctgaaagttgatgcaggaacgttcgatatcaagtatcttgacgatgataacgaatgggttttaatagcttgtgatgctgatcttcaagaatgtctcgagatccctagatcctcccgcacgaaaatcgtaaggctcttagttcatgatgtaacgacaaatctagggagctcctgcgagagcactggagaattgtgacctgataattcattcgaactcttttgtaaatag

SEQ ID NO: 4287 - DNA, 883 bp, Artificial Sequence
  P1948 (35S::G2215)
gagctatatacatagaggtctcatggtcttgtttgttctgtagatgtactcaattcatacagctctgcgtcatggaacgaaacagagcaaaacagaggagatggcgcttcatcggagaagaagagggaaaatggaacagtgaaagagacaactaagaagaggaaaatcaatgagagacacagagaacatagcgtgagaatcatcagcgatattactacctacacaactagttcagctccaacgacattgtcaaaggaaactgtctctcgctacttctacatgcccataactcaggctgcaatagcacttaacgttggtttaactctactaaaaaggagatgtcgcgaattgggtattcgccgatggcctcatcgtaaacttatgagcttaaacactttgatcagtaacgtcaaggtatgtagaacaaggcactacacttaatattattgttttcagataattgaactcaaatgttttatcatatgaataggagctgcagaagatggaaggcgaagagaatgcagaaaaactgcaggacgcgttggagatgcttgagaaggagaagaggacaattgaggatttgccggatttggagtttaaggacaagacaaagaggctaagacaagcttgtttcaaggctaaccacaagaggaagaagaagagaagtctcaagtccgatcagtctcaagtaccctcgtgttcaagcagcggatcagttcctagtgatgagtcggttgatgaagcaggaatggagagtgatgaagaaatgaagtatctcttgtgtggtttctcaagtgaatttactagtggtttgtgaaatctgtttttagtgagaaattggggattgtaaagccaaatgctttttgactaattcaatgaacag

SEQ ID NO: 4288 - DNA, 1263 bp, Artificial Sequence; identical to SEQ ID NO: 1487
  P1949 (35S::G2373)

SEQ ID NO: 4289 - DNA, 799 bp, Artificial Sequence; identical to SEQ ID NO: 1491
  P1951 (35S::G2379)

SEQ ID NO: 4290 - DNA, 758 bp, Artificial Sequence
  P1958 (35S::G162)
acgagaggttctctcttattcgtaccgttttagcaaacaaatgggtcggagaaagatcaagatggagatggttcaggacatgaacacacgacaggttaccttttcaaaacggaggactggtttgttcaagaaggcgagcgagttagccacgctctgcaacgctgagttgggcatcgttgtcttttcaccaggaggcaagcctttctcctacgggaaaccgaatcttgattctgttgcagagcgattcatgagagaatatgatgattcagacagtggcgatgaagaaaaaagtggtaattacaggcctaaactgaagaggctgagtgaacgtctcgatttgctcaaccaagaggttgaagctgagaaggaacgaggcgagaagagtcaggagaagcttgaatctgctggggatgagagattcaaggagtccattgagacgcttaccctcgatgaactcaatgaatacaaagataggcttcagacagtccatggtaggattgaaggtcaagtcaatcacttgcaggcttcgtcttgcctcatgcttctctccagaaaatagctagaccgacttgttagagttacattctattttttgtatcagcctacagaacttaccaacacatgaaagttattgctggtgtagaattttctgtcatctatggggtgtgactttctatttgacatcaaatgaaaatgtacctggaaatttgtctgtattaatctcaagtgtacttgctaaacttgatcagctttttcgc

SEQ ID NO: 4291 - DNA, 2390 bp, Artificial Sequence
  P1959 (35S::G1225)
tcagaagtacccttccatgatagtaccgatcacaatcaaataatgtctcacatgtacacacactcagagcaccatagcttcaacgtttgtcaagaaaaaaatttccttttaatcattgccttttattttttcgaaaatgtcgttttcgcccgcaaatatttataacctttatatatttttttcgaaaacaataaattaaagatttggaatgttgctatataaatcaatgatacttagtaattcaataaggaataaacttcgtgaagagaaatgactctagaagctttatcatcaaacggtcttttaaactttttgctctctgaaactctttcaccaactccattcaagtctctcgtcgatctcgagccattgccggaaaatgatgtcatcatatcgaagaacacaatttcggagatatctaatcaagaaccgccaccacagcgacaaccaccagctacgaatcgagggaagaagcggcggaggaggaagcctagggtttgcaaaaacgaggaagaagctgagaatcaacgaatgactcacattgccgtcgaaagaaatcgaagaagacaaatgaatcaacatctctctgtcttgcgatctctcatgcctcaaccttttgctcacaaggtttaacttttatggatatatattctttttaatgtttgtaaagtttcaagtagggtttcaatttttatggataatttttttaaatggtttactatttcgatttgggtttcaattaatatttacaattcactgaaaaagattaaattttcatcttgagttttattttttatgaaagattcattctaacggtttaaatctatttgattttcaatatttatggccaattctaaaaaattgattttttattaaatatatatttgggtttttatttgtttacttatatgttgttttggtggatttatttgtttccccatgaaagggtgatcaagcttcaatagttggtggagccatagatttcatcaaagaacttgaacacaaattactatctcttgaagctcaaaaacatcataatgctaaattaaaccagtcggttacttcttcaacaagtcaagactcaaatggtgaacaagagaatcctcatcaaccatcttcactatctctatcgcagttctttcttcattcatacgatccgagccaagagaataggaacggctcaacaagctcggtgaaaacccctatggaagatcttgaggtgactctaatcgaaactcatgctaacatcagaatcttgtcgagaagaagaggtttccggtggagcacgttggccaccaccaaaccgccgcagctttcgaagctggtggcttctctacaatcgctgtccctctccattcttcaccttagtgtcacaacattggacaattatgctatttactccatcagcgctaaggtaataaaattaaaaccctatcatctgaaccggactaaaccggattagtttcaatgcaatttgtgcggtatttagatcaaacagattacaagataggacatttatgctatttactctatcagtaactgatgaaaaaaaaaaaaaaactctatcagtaactagggtgatacaaaccggagctaaaccggatttgttcaaatgcgacttgaggggtattttgggaatatatgttaggaatttaaagctagacggtcgattatgtgcggtccaagggacagagcatataaaaggaatgtctatgagctcttaactagatttggtccaacatttattaccatacttggtggagtcatttttcttatttttcacccatttcttgaaaacaggttcaattattgccacgtgggttataaaaattgtaacaatttgaagcttttttcaaattcacattatgctatttttgtaaaatcattttcttattggatgttgaaaggtggaagagagttgccagctaagttcagtagatgacattgcaggagcagttcaccacatgctaagtatcattgaagaggagcctttttgttgctcatcaatgtcagaattaccatttgacttctctttgaatcactcaaatgtcactcattctctctgagaaatctcttttttgttgttgttattccttcttttaattttatcacatagcacatctttagtttttttttttcagaatgaagaaacacataagctttcttttaaaatcctaggttctttttctgactttgtaaaggctaaatgtgaatttataatggcacataacatattagttgttttactcttaattttatgcattttctgatagtaattaagttataaattagtacacttgtgagtgtttgaattgttttatatatataactggattcttatatatacaaatcatcaaaaaatttagctaggctctcgatcttggatatta

SEQ ID NO: 4292 - DNA, 1466 bp, Artificial Sequence
  Artificial sequence
  P1960 (35S::G1649)
caaagtgtgaagtccgaatctctctgattctacaattcacaaaaaccggaaaaaaaaaaagacaagtaaagaaagctttgttcagtttacttcaatggaagcaaaacccttagcatcatcatcatctgaaccaaacatgatttctccatcatcaaacattaaaccaaaattaaaagatgaagattatatggagctggtgtgtgaaaatgggcagattcttgcaaagattcgaagaccaaagaacaacggttcttttcaaaagcaacgtaggcaatctctcctggatttgtatgagaccgagtacagcgagggtttcaagaaaaacatcaagattcttggagacacacaagttgttccggtgagtcagtctaagccacaacaagataaagaaaccaatgaacaaatgaacaacaataagaagaagctaaagtcctccaaaatcgaatttgagagaaatgtttcgaaaagcaacaaatgtgttgaatcatcaacattaattgatgtttctgctaaaggtccaaagaatgttgaagttactacagctcctcctgatgagcaatctgcagctgttggtagatccacggaattgtattttgcttcttcatcgaagttttctcgaggaacttcgagagatctaagttgttgttctttaaagaggaagtatggagatattgaagaagaagaatcaacctatttaagtaataattcagatgatgaatcagatgatgcgaagacacaagttcatgcgagaacaagaaagccggtgactaaaagaaaacgaagcacagaagtccataagttatatgaaagaaaacgaagagatgaattcaacaagaaaatgcgtgctttgcaggacctactaccaaattgttacaaggatgataaggcttcattgttggatgaggctatcaaatatatgcggacccttcaacttcaagttcagatgatgagtatgggaaatggattaataagaccacctacgatgttgccaatgggtcattactctcccatgggtctaggaatgcatatgggtgcagcagcaacaccaacatcaataccgcaattcctgcctatgaatgttcaagcaaccggttttccggggatgaacaatgcaccaccacaaatgctaagctttcttaatcacccaagtggactaattccaaacactcctatcttttctccattggaaaattgctctcagccattcgtggtgccttcgtgtgtttctcagactcaggctacttcttttactcaattcccaaagtctgcgtccgcctcaaacttagaagatgcaatgcaatatagaggaagcaacggttttagttattatcgctcgccaaactaatgatttgtagaaagttgatgttttctccaactaactaactttaagcaaaaaaaaatgatcgtctactctgtgttgttagtctatgggcttttgggccttgattcttggaacgatttgaact

SEQ ID NO: 4293 - DNA, 2025 bp, Artificial Sequence
  P1961 (35S::G1662)
aactcttgttccaccaggacaataaataccatcttctgatcacacgtcatctttccatattcaagaaaacttcattttccatcggaagattcgtttaggagagaaaatggaaagtggcttttattcagattggaaagatacttcttcttcttcgttctttggatcagagaatatggaggaagagttggaagatggagttcttagagctgaagagcttttctcatcgattcctcaacctcagacacctaaagagccaatggagtttctgtctagatcctggagtctctctacttctgaaatctccaaagcacttgctctcaaacatagacaacaacaagatcagttttgtgttggccagaacagtcctcctgttttgttccctgatgctgctgcagatccactcgtggtacgatccttttatcccttttccaaattccaatgaaaccctttttccaactatttcttagaattatgatgagccttaaaagtcagagacttttcaattgtatatgattgccattgcaccagttcctaacatagttcttgggaattggaatggataataatagtggactcttttcatattttacaactttgggattttgattctaggctgggaagatcatgaactctgttggcacacgtagagcagggacattgtctaaatggtttcaccacaacaaggaacacagcaccagcagtactactaccaatctcaagaagaaagataaagtgcgtgtggagaacgcccacgtgcattctgccgtctctatagcggctctggctgcaggtttagcctctgtgacatctgctagcaattgcaaagggtcaggctccaagatggcactggctttagcctcagccactgaactgttggcctcacactgtgttgagatggctgagcgagccggtgctgaccatgcacgtgttacttccacggttagatcttctgtggatatccacagccccggtgatctcatgactctaacagccgctgctgcaactggtaaggctttgttgcagcttcacaaggctttttcagtttcgttgatatgcatttgatctgactttgtttaaactgacactagctttgagaggagaagcggctctgaaggcgaggcagccaaaggaagcaaggaaaaatgcagctattaccccttttgagagaagtttctctgattctcattggcatgcaaattttcagtatagattggaagaaccaaatcttccatttgaaggcgaactgatgcaatgtgcacgaaatggtaattgtcttctgtcaccgagtctgatcactttaagagttcactggatctgagataagacagagagcttaactcttcttccttgtgctttaacttgcaggagtgcagcgaactaagcgtgtctgtgtctatatcaacaagaagtctcaggtatagcagatttgattagtatctatatataacacataacacaactcagttcacttttgattcaatgcttattatgctacttatgattttgcaggtaatgatcaaactcaaaagcaaacatgttggaggggcattctctaagaaaatcaaatgtaagcatttactaatctttcagtttggataaattacctgaaagacgacactctgaacttgttcttcctttctgaaggcgttgtctatggagtctgcgatgagaaatcagcttggccttacaggaaagagagggaaaattcagaagaagtctacttcggtctgaaaaccggacaaggtcttttggagttcaagtgcaagagcaagattcacaagcagagatgggttgatggggttcagtctcttctccgccaagtaaattgctttgaggctgccaaatgctcgctgggatctctgaatctcactggtcacacgtgatgcaggatcctgtatatatttgattatattcatatatataatatccaaatttttgctgttgtgaggtatttgcaaaacctggcaatgtaacctcagaagacttttggataaaacaaagcaggttgttcaaatgatcacaaca

SEQ ID NO: 4294 - DNA, 1114 bp, Artificial Sequence
  P1964 (35S::G1482)
accaccatctctatctctctcttaatcgatcgatgaagatcaggtgcgacgtctgcgataaagaagaagcgtcggtgttttgcacggccgacgaagcatctctctgcggcggctgcgaccaccaagtccaccacgctaacaaactcgcctctaaacatctccgtttctctctcctttatccttcttcttccaacacctcctctcctctctgcgacatctgtcaggataaaaaagctctgttgttctgtcaacaagatagagctattttatgcaaagattgcgattcatcgatccacgctgcgaacgaacacacaaagaaacacgataggtttcttcttacaggggttaagctctctgcaacatcgtctgtttacaaacctacttcgaaatcttcttcttcttcttcaagcaaccaagatttctctgtccctggatcatcaatctctaatcctcctcctctcaagaaacctctctcagctcctcctcagagcaacaagatccaacccttttcgaagatcaacggcggtgatgcgtcggtgaatcagtggggatccacaagcacgatttctgagtatttgatggatacgttacctggttggcacgttgaggatttcctcgattcctctcttcctacttatggtttctctaagagtggtgatgatgatggagtgttaccatatatggaaccagaagatgacaacaacactaagagaaacaacaacaacaacaacaacaacaacaacaatacagtgtcacttccatctaagaatttagggatttgggtccctcagattccacaaactcttccttcttcatacccaaatcaatacttttctcaagacaacaacatacagtttgggatgtacaacaaagaaacatcaccagaagtagtgtcttttgctccaatacaaaacatgaaacaacaaggacagaacaacaagagatggtatgatgatggtggcttcactgtcccacagatcactcctcctcctctttcttctaataaaaagtttagatctttctggtaattttactatctccctaaatgggggagttttttttttgtttgtttgtttctccttcatttctcccaactttgatctcagaattaggc

SEQ ID NO: 4295 - DNA, 1117 bp, Artificial Sequence
  P1967 (35S::G1594)
attttgcaagaagacaattcaagaaagcgatttagaagacggaggagtttttaccggagatcttatacttatggatggaatgtacaatttccattcggccggtgattattcagataagtcggttctgatgatgtcaccggagagtctcatgtttccttccgattaccaagctttgctatgttcctccgccggtgaaaatcgtgtctctgatgttttcggatccgacgagctactctcagtagccgtctccgctttgtcgtcggaggcggcttcgatcgctccggagatccgaagaaatgatgataacgtttctctaactgtcatcaaagctaaaatcgcttgtcatccttcgtatcctcgcttacttcaagcttacatcgattgccaaaaggtcggagcaccaccggagatagcgtgtttactagaggagattcaacgggagagtgatgtttataagcaagaggttgttccttcttcttgctttggagctgatcctgagcttgatgaatttatggaaacgtactgcgatatattagtgaaatacaaatcggatctagcaagaccgtttgacgaggcaacgtgtttcttgaacaagattgagatgcagctacggaacctatgtactggtgtcgagtctgccaggggagtttctgaggatggtgtaatatcatctgacgaggaactgagtggaggtgatcatgaggtagcagaggatgggagacaaagatgtgaagaccgggacctcaaagataggttgctacgcaaatttggaagccgtattagtactttaaagcttgagttctcaaagaagaagaagaaaggaaagttaccaagagaagcaagacaagctcttcttgattggtggaatctccattataagtggccttaccctactgaaggagataagatagcattagctgatgcaacggggttagaccaaaaacaaatcaacaattggtttataaaccaaaggaaacgtcattggaagccatcagagaatatgcctttcgctatgatggatgattctagtggatcattctttaccgaggaatgaatttatttatggtacttatttaacgttgattaaaagatggatgtataattctgccttgctttg

SEQ ID NO: 4296 - DNA, 1644 bp, Artificial Sequence
  P1968 (35S::G1587)
caacaacaaaagacctattttgtgaatcttttctctaaattaagagttattagggcaaatttctacatagcatgggctacatctccaacaacaacctcatcaactatttgcccctctctactactcaacctcctcttcttctcacccactgtaataaaatccttacttcttcatttatagacttaattcatatcaatgtgttaatatttttgtttttttcaggtgatattaacggcaatgatcaccatcagctcataaccgcatcatcaggagaacacgatattgatgaacggaaaaacaacattcctgcggcggcgactttgagatggaatccgacgccagagcagatcacgacgctagaagagctttacagaagcggaacacggacgccgacgacggaacagatccaacagatagcatctaagcttcgtaaatatgggagaatcgaagggaagaacgttttctattggtttcagaatcataaggctagagagagactaaaacgccgccgtcgtgaaggtggtgctattatcaaaccacataaagacgtcaaggattcatcatcaggtacgataaatatttagttcggtttatatctagagatttaaatacccatctccttcggttctgaatatttctttaaaaatggttaagaggatataaagttttggtttgtatcaaaattgatgaaatttgatggaacgttccttaaaacttaaaagtggatatacatgctaatttcggagatatatgtaagatgacgtgacaattgcaggtggtcatcgagttgatcagacaaagctctgcccatcttttccacacacaaaccgaccacagccacaggtattttctttgaattatgtttacgtgtaatagttatatgtaaaaagatactcacaaatcatgcatgcataaataaataggtgaccaaaacaatacatagatgtatatataagtgtaaataactaaatatgtgtggaaagttggggagacaagtaaatagggtgcagaatagagttatagagaagctttttctatcatatgttgggacttgagaacaataaggaaattaacaaagatgttttcaaaaggccataatttttttttttttaatccatttcatcatatgttgggacttgatatgtattatcatttcactttagaatagttaataggcgtctcccgaaaataatttattattttgttgtagtatctagctcatgaaggaatttgctcatcctaaaagaattaattatttcgtatttttctgcttagcatgaattagatcctgcgagttacaataaagacaacaatgctaataatgaagatcatgggacgactgaagaatctgatcagagggcatcagaggttggtaaatacgccacatggagaaatcttgttacttggtcgataactcaacaaccggaagagattaatatcgacgaaaatgtcaacggagaagaagaagaaacgagggacaaccggactttaaatctctttccggttagggagtaccaagagaaaacaggccggttgatagagaagacgaaagcatgcaactactgttactactacgagttcatgcctctgaagaactgaaacaaaaaacccatgtgtgaataataaataggactttaatgaagg

SEQ ID NO: 4297 - DNA, 2332 bp, Artificial Sequence
  P1970 (35S::G1855)
ttgtttctgtctcagtctctatcttagataaagattcagtctttgcactcaagaatggcgaaagagaacagtggtcatcatcaccaaacagaagcaagaagaaagaaactaactttgattcttggtgtaagtggactctgcattttgttctatgttttaggtgcatggcaagccaataccgtcccatcttctatctcgaagctcggatgcgagacgcaatcaaacccttcttcgtcctcttcctcttcctcatcttcagagtcagctgaactagatttcaaaagccataatcagattgagttaaaggaaacaaaccaaaccattaagtactttgaaccatgtgaattatctctcagtgagtacactccttgtgaagaccgacaaagaggaagaagattcgataggaacatgatgaaatatagagaaagacattgtcctgtaaaagatgagcttctttattgtttgattcctcctccaccaaactacaagattccatttaaatggccacaaagtagagactatgcttggtatgacaatatccctcacaaggaacttagtgttgagaaagcagttcaaaactggattcaagttgaaggtgaccgctttagattccctggtggtggtactatgtttcctcgtggagctgatgcttatatcgatgatattgctaggcttattcctcttactgatggtggaatcagaacagctattgacactggatgtggtgtaagtgtttcattgtaagagtatacgtatacacttctttttgatcattgtttgattcaatatctgttttttatattaggttgcaagttttggtgcttacctcttgaagagagacattatggctgtgtcttttgctccaagagacactcatgaagctcaggtacagtttgctttagaacgcggagttcctgcgataatcgggattatgggatcaagaagacttccttatccagctagagcttttgatcttgctcattgttctcgttgtttgatcccttggtttaaaaatggtaatgatttgactctgtttctgttcatagctgaggaagaaacataacactgaaatcttttgtagatggtttgtaccttatggaggtcgaccgggttttaagaccgggcggttactggatcctctcgggaccaccgattaactggaaacagtactggagagggtgggagagaacagaggaggatttgaagaaagagcaagattcaatagaagatgtagcaaagagtctttgctggaagaaagtaactgaaaaaggtgacttatcaatttggcaaaagcctctcaatcacattgagtgtaaaaagctcaaacaaaacaataagtcacctccgatatgcagctcagataacgcggattccgcttggtaatactaatttacatctcgaaaatgtagtcttaactttgtgaaagaacaatgtcaaaacttggttttctctgttttaggtacaaagacttggaaacttgtataacaccattaccagaaacaaacaatccagatgattcagcaggcggtgcactcgaggattggccagaccgagcattcgcggtacctccaagaatcatcagaggaactataccagaaatgaacgcggagaaatttagagaagacaacgaggtttggaaagagagaatagcacattacaagaagatagtccctgagctttcacatggaagattcaggaacattatggacatgaacgcttttctcggcggattcgctgcttccatgctgaaatatccctcatgggtcatgaacgttgtcccggtcgatgcagagaaacaaacgttaggtgtgatctacgaacgtggattgatagggacgtatcaagattggtgtgaaggattctcaacgtatccaagaacttatgatatgattcatgcaggaggattgttcagcttatacgaacataggtaaagtttcatggtcttccaactcaaaactatatccgtgaaacgcgactaatggaatgttctttgtgtatgttttaaggtgtgatttgacgttgatattgttggagatggatcgaattttgagaccagaaggaacagttgtgttgagagataatgtggagacgttgaataaggtagagaagatagtgaagggaatgaagtggaagagtcaaattgttgatcatgagaaaggtccttttaatcctgagaagattcttgttgctgttaaaacttattggactggtcaaccttctgacaagaacaacaacaacaacaacaacaacaacaactagtgttccaactctctaggaactcttcactcttttgttgttgttgtgttttttttactttacgcagattctgatt

SEQ ID NO: 4298 - DNA, 1888 bp, Artificial Sequence
  P1975 (35S::G312)
gtttggcagtggtttttatagaccgccgggagggttagatctaggcgttaagaatggcttacatgtgcactgatagtggcaatctaatggctattgctcaacaagtcatcaaacagaagcagcaacaagaacaacaacagcagcaacatcatcaagaccatcagatttttggtattaatcctttgtctcttaacccatggcccaatacttccctcgggtttgggctttcaggttcggcttttcccgacccgtttcaagttaccggcggcggagattccaacgatcctggctttccttttcctaacttagaccaccaccacgccacaaccaccggcggtgggttcaggttatctgatttcggcggtggaaccggcggcggcgagtttgagtccgacgagtggatggagactcttatcagcggtggagactccgttgcagacggtcctgattgtgacacctggcatgataatcccgattacgtaatctacggtcctgatccattcgatacttacccgagtcgactcagtgtccaaccgtcagatctaaaccgagtcattgacacgtcgagtccgcttcctccgccgaccttgtggcctccttcttcgccattatcgattcctccgcttactcatgagtcaccaaccaaagaagatccagagactaacgactccgaagacgatgacttcgacctagaaccacctctcctcaaagctatatacgactgtgcacggatctcagactctgaccctaacgaagcttccaagacgcttcttcagatccgagaatctgtatcggagctaggtgatccgacggagcgagttgcattttacttcacggaagctctctccaacagactgtctcctaattcgccggcgacgtcgtcttcttcttcatctacggaggatttaatcttatcttataaaaccctaaacgacgcttgtccttactccaaattcgcacatttgacggcgaatcaagcgattctagaagcgacggagaagtcgaacaagattcacatcgtcgattttggaatcgttcaaggtatacaatggcctgctcttcttcaagctctagctactcgtacttctggtaaacccactcaaatccgggtctcgggtatacccgctccatctctcggtgaatctccggaaccgtcgttaatcgccaccggaaaccgcctccgtgatttcgccaaggttctggatctgaatttcgatttcatcccaattctcactcccatacatttacttaacgggtcaagtttccgggtcgacccggatgaagtactggccgtgaatttcatgctccagctctacaaattactcgacgagacgccgacgatagttgacaccgcactacggctcgccaaatcgttgaacccgagggtcgtcactctcggagaatacgaagtgagcttaaaccgggtcggtttcgctaaccgggtaaagaacgcgcttcaattctattccgcggttttcgaatcccttgaaccgaacttggggcgtgattcggaggagagagtgagagttgagcgagagttgttcggccggagaatctcgggtttgattggaccggagaaaaccggaattcatagagaaagaatggaagagaaagagcaatggcgggtattaatggagaatgccggttttgaatcggttaagctgagtaattacgcagtgagccaagcgaagattctattgtggaattacaattacagcaatttgtattcaattgttgaatctaagcctggcttcatctctttggcctggaacgatttacctctcctcactctttcttcctggcgataaccaaaccaaaccgatccggtattcttagttttgttttgttttcaatgttatttttggttaggcaaatattcaattgttaa

SEQ ID NO: 4299 - DNA, 1455 bp, Artificial Sequence
  P1982 (35S::G2713)
tggagtctctcatcttagtctgaagctctttttttttggatttgagcatttctggtttgagaagaatcttgtggaaaccaaagagaaatgtcgtttcgaggcattgttcaagatttgagagatgggtttgggagcttgtcaaggaggagtttcgattttaggctctcgagtcttcataaagggaaagctcagggttcttcgttccgtgagtattcgtcatcccgtgatctcttgtcgcctgtgatagttcagacaagtagatgggctaatcttcctccagagttactctttgatgtgatcaaaagattagaggaaagtgagagtaattggcctgcaagaaaacatgttgtggcttgtgcttcggtttgtcggtcttggagagctatgtgccaagagattgttttggggcctgaaatctgtgggaaactcactttccctgtttccctcaaacagccagggcctcgtgatgcaatgattcagtgtttcatcaaaagggataaatcaaagctaacatttcacctttttctttgtttaagtcccgctctattagtggagaatgggaaatttcttctttcagctaaaagaactcgtagaactactcgaaccgagtacattatctccatggatgctgataacatctcaagatccagcaactcttacctcggaaagctcagatcaaacttccttgggacaaagttcttggtgtacgacacgcaaccaccaccaaacacatcttcgagcgcacttatcactgatcgaacaagccgaagcaggtttcactccagacgagtttctcctaaagtaccatccggaagctacaacattgctcaaatcacctatgagctcaacgtgttgggcacacgcgggccacgacgaatgcactgcatcatgaactccatcccaatttcatcgctcgaaccaggcggttcagtccctaaccaacccgagaaactcgtccctgcaccatactctctcgacgactcattccgcagtaacatctccttctccaaatcatcatttgaccaccgctccctcgatttcagcagttctagattctccgaaatgggaatatcctgcgacgacaacgaagaagaagcgagtttcagaccgttgattctaaagaacaagcagccaaggtggcacgagcagttgcaatgctggtgtttgaatttccgcggacgtgtgacagttgcatcggttaagaatttccagcttgtagcagcaagacagccgcagcctcaagggacaggtgcagcagcagcaccaacaagtgcacctgctcaccctgagcaagacaaggtgattctccagtttggtaaagtagggaaagatatgttcacaatggactataggtatccattatcggcgtttcaggcgtttgcgatatgcttaagcagctttgacaccaagcttgcttgtgaatagaagaaaccactcgtctccttgatcattcat

SEQ ID NO: 4300 - DNA, 2516 bp, Artificial Sequence
  P1984 (35S::G416)
agggtaagatcttatatgaaatgatttgctaagaggactataagtctcggtgatcggggaattcgatatggaggagagtgaaacaaaggggagaatcagtcaagaaactgataaggcttgtgtttcagttgagagaattgggtctactttactctcatcatttgtgaagaaaggtaaagaagtatcaaataagagaaattctaagcagaataagcgaaaagcggaagaagaactctgttcgaaatcaagaaccaagaagtactctcggggatgggtccgttgtgaggaaatggaggaggagaaggttaagaaaacaagaaagaggaaaagtaagagacagcaaaaggataataaggttgaggttgatgattctttaaggttgcaaaggaggacaaggtatttgctcattaagatgaagatgcagcagaatcttatcgatgcatacgcaactgaaggttggaaaggtcagagccgggaaaagataagaccagacaaggagcttgagagagcccggaaagagatcttaaactgcaagcttggactacgcgacgccattcgccaactggatctgcttagttctgtgggaagcatggaagagaaagtgatagcttcagatggatctattcatcatgatcatatattttgtgcagaatgcaattctcgagaagcttttccagacaatgatataatactttgtgatggaacgtgtaatcgagcatttcaccagaaatgccttgaccctcctttggaaacagaaagcatacctcccggagatcagggctggttttgcaaattttgtgattgcaaaattgaaattatcgacacaatgaatgcacaaattggaactcatttccctgtggacagcaactggcaggatatcttcaatgaagaagctagtcttcctattggatctgaagctacagttaacaatgaagcagattggccttcggatgactccaaggatgatgattatgaccctgaaatgagggaaaacggtggaggaaacagcagcaacgttagtggtgatggtggtggtgataacgatgaagaaagcatttcaactagcttgagcttatcatctgatggtgttgccctttcaacgggatcatgggaaggccatagactcagcaatatggtggagcagtgcgaaacaagtaatgaagaaactgtatgtgggccaagacagcgaaggactgttgactatacacagttgtactatgaaatgtttggaaaggatgcagttttgcaagagcaaggtagtgaagatgaagactggggtccgaatgacagaaggaagagaaaaagggaatctgatgcaggaagcacacttgtaactatgtgtgaaagcagtaagaaagatcaagatgttgtagaaacgctagaacagagtgagagagattctgtctctgtggaaaataaaggaggtcgaaggcggatgttcagactcccaagaaatgcagttgagctacgtcaagtatttgcagagactgagcttccctcaaaagctgtgagggatcgtcttgcaaaagagctgagtcttgatccagagaaggtcaataaatggtttaaaaatactcggtatatggcactgcggaataggaagactgagagcgtgaaacaacctggggattctaagacagtctctggaggagattctggaccagaagcagtcatggagaacaacactgaaacaaatgaagttcaagatactttggatgacactgttccacccggatttgacgctacaaatcaaaacatactctccccatgtaataacaaccaggaggaatttcaacaggaaaatgtctcttttccttcacccacagatgaaagtcaacagtatctggaacaaaacgattcttctttcgttctagtgccacatgaaaagcaaagcagcgaaattagcttaaagacggctgtagaggagaatgagacagaaagcaagatgatgaaagagccacatgaagagctaagcagtgaaatgagcctaaagacggctgctgaggagaaggagacagagagcaagatgatagaagagccacatgaagagctaagcagagaaatgagcttaaagacggctgtagaggagaaggagacagagagcaagatgatggaagagccacatgatgagctaaacagcgaaatgagcttaagtacagcggtagaggagaaggagacagggagcaagatgacggaagagtcacatgaagagctaagcaacgaaatgagcttagaagagaaggagacggggagaaagatgacggaagaggaagaattggaagcagtaatggagatgctttgtagaacagaaaacaagttactggacgtgacgcagaggcttgatagatttaaaacaccaaaaggccgaaaaaagttaggcaattcttcttctcctttacttgaagaagactcagtagtgtatgttccaatagcagagatcaaggagaaaaggtaacaatatatatatatatatcaagaaaagaaaaaagtcctttgcagaagttttggtattgtta

SEQ ID NO: 4301 - DNA, 1928 bp, Artificial Sequence
  P1987 (35S::G550)
aaagtttccgctttttgctcgctggagaagaaagaaagaaagaagtgaaaaggaatcattaccatggctgatccggcgattaagctctttggaaagacgattcctttacctgagcttggtgttgttgattcttcttctagctataccggatttttaaccgaaactcagattcctgttcggttatcagattcgtgtaccggcgatgatgatgatgaagagatgggtgattccggtttaggacgagaagaaggtgatgatgttggtgatggtggaggagagagcgagactgataaaaaggttagttttttttggaacttgtgaattgattttgatttgttaaatggaaatgattgatgggtttatgttagattggtcaaatcttagttttattgataaagttatgatttttggtttgtttatgtaagaactaggttttcagagcttttggggattcgaaaattgtaaatctggattctcaaatgagtttttttttttccttttgttataaagtgatttgagatcttaattagttccatttggttttgattgatggttataggttttgatattgatttgcttaagaacttttcagggttttagcttctctgtgattggaatcaagtctttgatccctgtagcttctagcttctgtttgttgtttgtttgattaggatacataacaacgatctgactctggttcttatgttattcttcaggaagaaaaagatagtgagtgtcaggaagagtcattgaggaatgaatctaatgatgttactactactacatcgggtataactgaaaaaacggaaacaacaaaagctgcaaagacgaatgaagagtcaggtggtactgcttgctctcaagaggggaagttaaagaaacctgataagattctaccgtgtccgcgatgtaacagcatggaaaccaagttctgttactacaacaactataatgttaaccaacctcgccatttctgcaagaaatgtcagagatattggacagctggtggaacgatgaggaatgttccggttggtgctgggagacgtaagaataagagtccagcttctcattataaccgtcatgtaagtataacatctgcggaagctatgcagaaggtggcgagaactgatcttcaacatcctaatggtgcaaatcttctcacttttggctctgattctgtgctttgtgaatctatggcttctggattgaatcttgttgagaagtcattgttgaagacacaaactgtattgcaagaacccaatgaaggcttgaagattacggttccgttaaaccagacaaacgaagaagctggaacagtcagcccgttaccaaaagttccatgctttccaggaccaccaccaacttggccttacgcttggaacggagtttcgtggacgattttaccgttttaccctccaccggcttactggagctgcccgggggtttcaccgggggcatggaacagcttcacatggatgccacaacccaattcaccatctggttccaatccaaattctcctacactaggtaaacattcacgtgacgagaacgctgctgaaccaggaaccgcttttgatgaaaccgagtcacttggtagggagaaaagcaaacccgagagatgcttgtgggttcccaagacgctgaggattgatgatccagaggaagctgctaaaagttccatctgggaaacattagggatcaaaaaagacgaaaatgcggatactttcggagctttcagatcatcaaccaaagaaaaaagcagtctttctgaaggaagacttccgggaagaagaccggagttgcaagcgaatcctgctgctctttctaggtcagcaaacttccatgagagctcatagaaagaagaagaatctaagcagctgatttgattgtttttgggttcagtcttgtgttccaagaaagcaggtgag

SEQ ID NO: 4302 - DNA, 1026 bp, Artificial Sequence
  P1989 (35S::G1142)
tttaggacagaacccaccgaaagctccacaaaccccattaattaacaaaaaaccaaaagaaggcggcgcaaacaaaagataatgcaaccagagacctcagatcagatgttgtactcgtttcttgccggaaacgaagtcggcggtggagggtactgcgtctccggcgactacatgacgactatgcagagcttatgtgggtcttcgtcgtcgacgtcatcgtattacccactggcgatctccggcatcggagaaacgatggctcaagacagagctttagctgctttgaggaaccacaaagaagctgagagaagaaggagagagaggatcaattctcatctcaacaagcttcgtaacgtactctcttgtaattctaagaccgataaagccacactgctcgccaaagtagttcaacgagtcagagaacttaaacagcaaaccctagagacctccgactccgaccaaacattattaccatcagagaccgacgaaattagtgttctacactttggagactattcaaacgacggtcatataatcttcaaagcctctctatgttgtgaagatagatcagatctcttgccggaccttatggagattctcaagtctcttaacatgaagactctccgagctgagatggtaaccattggtggtcggacaagaagtgttcttgtcgtagctgctgacaaagagatgcacggcgtcgagtctgtgcattttttgcaaaatgctctcaagtcgctgcttgagcggtcaagcaagtcgttgatggaacgtagttctggtggtggaggaggagaacggtcaaagcggcgtcgtgcgctggatcacatcataatggtgtgaaatgatgagaattgagcacactaaaaagtctataattgattaatatatatagggtatgatcataattaacttggttataattaccaaaaccttttttattcctctttaataatatatatgttatatggttttagttactaagtcttgggagtgtaagcaaatgttgtaagtaggtttggtgtg

SEQ ID NO: 4303 - DNA, 1453 bp, Artificial Sequence
  P1993 (35S::G2557)
tcgacttcctgtgaactcatctgtttgttctcttcttccggtttcactttttcatgtcctgccgttattacaacgaggattgtgtttgatccgatggaaggattggaatctgtgtacgctcaagctatgtatggaatgacacgagagagcaaaatcatggagcatcaaggatcagatttgatttggggaggaaatgagctaatggctcgagaactctgttcttcttcttcttatcaccaccaactcattaatccgaatcttagcagctgtttcatgtctgatcttggagtcttaggtgagattcaacagcagcaacatgttggcaacagagctagctcgatagatccatcatcactcgattgtttgttatctgcgacgtcgaatagcaacaacacctcgacggaggacgatgaaggaatatctgtgcttttctcagattgtcagactctttggagctttggtggagtctcatctgcagagtctgagaacagagagatcactactgagacgacaacaacgataaagcctaagcctttgaagagaaacagaggaggagatggaggaactactgagactacaacaacaacaacaaaacctaagtctttgaagagaaacagaggagacgagacaggaagtcactttagtcttgttcatcctcaagatgattcggagaaaggaggtttcaagcttatatacgatgagaatcaatcgaaatcaaagaaaccaagaacagagaaagaacgaggcggttcttcgaacattagtttccaacattcaacttgtttgtctgacaatgtcgagcccgatgctgaggcgattgcacaaatgaaggagatgatatacagagcggctgcatttagaccggtgaatttcgggttagagattgtggagaagcctaagaggaagaacgtcaagatatcgacggatcctcaaacggttgcagcgagacagagaagggagaggataagtgagaagattagggttttacaaacattggttccaggtgggacgaagatggatactgcatcaatgcttgatgaagctgctaattatctcaagttccttagagcacaagtaaaagctttagaaaacttgagacccaagcttgaccaaaccaatctctctttctcttctgctcctacatcgtttccattattccacccatcttttcttccattgcaaaatcctaatcaaatccatcatccagagtgttgacagattataaacttttgagtttcatcatcatcaacagaatcatggcgtcttgattgttttagcagttctcaagaaaggcaacttctgtgacaagggtggtgtcgggcagtgttgtttacactttccagtctttgttttgcatttctttttatataaagtttgtattttatatagaatctgtggaattcgagggttgaaatattgtgaaaaacagagccgcaagaggttaattacagtc

SEQ ID NO: 4304 - DNA, 1069 bp, Artificial Sequence
  P1998 (35S::G2571)
cttatactccacgaaacgtctggttgagaaaaaatggaagaaagcaatgatatttttcagaacaatttcagtcctaaaatctcagaaatcagagcatctctgtctcagatcatattagcaggaggaccaaacacactcgactcaatcttctcacttctcactccctcctccgtagaatccgccacaacatcattcaacactcacaatcctccgccaccgccgcagctcgggtcctccgtctatctccgccaacgagatatcatcgagaagttccaccttcagaacagagcaatctccactcctcatcctcctctgttttcctcaacgtacgatcatcatcaaacttccgagctaatgctccaagcggcggccgggtctccagccgccgctttcgccgctgcgttagcggctgggagggtgacgaaaaagaagaaactttacagaggagtgaggcagagacattggggaaaatgggttgcggagataagattgccgcaaaacagaatgagggtttggttaggtacttacgacacggcggaagccgccgcttacgcttacgatcgcgccgcctataagctccgtggagaatacgctcgtctcaattttcctaatctcaaagacccgagtgagctactcggactcggagattcctctaagctaatagctctcaagaacgccgtcgacgggaagatccaatccatttgccagagagtcagaaaagagagagcaaaaaagagcgtaaaagtgagcaaaaactcgtcggccacggcggattcttcgtgtttgtcatcgccggagattctgtcgtcgtctccggtgacgacaactactactgcggttacttcagaggatagttattgggtttcacctatgggtttgtgtaacagtgaaaatagttctccggtatcagtttcggtccctagtgaagtaccggcgacggcggaggaagaggcaatgatgggagtggacactgatgggtttttattagcgaggatgccatcgttcgatccagagctgatttgggaagttcttgccaattaatactacacaaagaatgtgaattttgatc

SEQ ID NO: 4305 - DNA, 653 bp, Artificial Sequence; identical to SEQ ID NO: 1589
  Artificial sequence
  P2002 (35S::G2583)

SEQ ID NO: 4306 - DNA, 1378 bp, Artificial Sequence
  P2004 (35S::G2589)
aagaaaagaaaaataaagataatgaggacgaagactaagttagtactcatacctgatagacactttcggagagccacattcaggaagaggaatgcagggataaggaagaaactccacgagctgacaactctctgtgacatcaaagcatgtgcggtaatctacagtccgttcgagaatccaacggtgtggccgtcaaccgaaggtgttcaagaggtgatttcggagttcatggagaagccggcgacagaacggtccaagacgatgatgagtcatgagactttcttgcgggaccaaatcaccaaagaacaaaacaaactagagagtctacgtcgtgaaaaccgagaaactcagcttaagcattttatgtttgattgcgttggaggcaagatgagtgagcaacagtatggtgcaagggaccttcaagatttaagtctttttactgatcaatatcttaatcagcttaatgccaggaagaagttccttacagaatatggtgagtcttcttcttctgttcctcctctgtttgatgttgcgggtgccaatcctcctgttgttgcagatcaagctgcggtaactgttcctcctttgtttgctgttgcgggtgccaatcttcctgttgttgctgatcaagctgcggtaactgttcctcctctgtttgctgttgcgggtgccaatcttcctgttgttgcagatcaagctgcggttaatgttcctactggatttcataacatgaatgtgaaccagaatcagtatgagccggttcagccctatgtccctactggttttagtgatcatattcaatatcagaatatgaacttcaatcaaaaccaacaagagccggttcattaccaggctcttgctgttgcgggtgccggtcttcctatgactcagaatcagtatgagcccgttcactaccagagtcttgctgtcgcgggtggcggtcttcctatgagtcagttgcagtatgagccggttcagccttatatccctactgtttttagtgataatgttcaatatcagcatatgaatttgtatcaaaatcaacaagagccggttcactaccaagctcttggtgttgcaggtgccggtcttcctatgaatcagaatcagtatgagccggttcagccctatgtccctactggttttagtgatcattttcagtttgagaatatgaatttgaatcaaaatcaacaggagccggttcaataccaagctcctgttgattttaatcatcagattcaacaaggaaactatgatatgaatttgaaccagaatatgagtttggatccaaatcagtatccgtttcaaaatgatccattcatgaatatgttgacagaatatccttatgaataagcgggttatgttggagagcatgcac

SEQ ID NO: 4307 - DNA, 1090 bp, Artificial Sequence
  P2005 (35S::G2590)
cacacaccaaagaaaagaaaaacaaagataatgaggtcgaaaattaagttatcactcatagctaataagacctcaaggagaaccacattcaggaagaggaagggagggataacgaacaaactccatgagctaacaactctctgcggcgtcaaagcatgtgcggtaatctccagtccgtacgagaatccagtggtgtggccgtcaaccgaaggtgttcaagaggcggtttccatgtttatggagaggccggcgacagaacaatccaagctgatgatgagtcatgagacctacttgcaggacaaaattaccaaagaaacaaagaaactggagagtctacgtcgtgaaaaccgagaatctcagcttaggcaatttatgtttgattgtgttgaaggtaagatgagtgagcatcagtatggtgcaagggaccttcaagatttaagtctttatattgatcactatatcaatcagcttaattcaagtgtcatgctccttacaaacaatggtgcgtcttcttcttcctttcctcctccgcttcatacttcagttgcgggtgcgggtgcgggtgcgggtgctgctcctcttgttgttgcgggtgcgggtgcggctcctcttgctgttgcgggggcgggtgcgagtcctcttgctgttgcgggtgtgggtgcggctcctcttgctgttgcgggtgccggtcctcctatggctcagaatcagtatgagccgattcagccctatatccctactgcttttagtgataatattcaataccaagctcctgtggattttaatcatcagatccaacatggaatctatgataatctcagtttggatccaaatcatcagtatccgtttcaagatgatccattcatggagatgttgatggaatatccttatgaacaagtgggttatgctgcagagcatgcacacatccctttcatgaacggaaactactacaactaccaccaaccaccaaccgttggtcttactaccaccggtcacatgccttccaacaacgccaccaccaccaccaccaccaacaccaccgttgtgtgatgtgtttcagtagtttgcatttgtgttttgtccatttcaa

SEQ ID NO: 4308 - DNA, 1329 bp, Artificial Sequence
  P2009 (35S::G2719)
tgcagttaggaaagctggtacaaaccaaatttcattttttttcttttaattaattttggccaaaaagaaaaaaaaatcgaaactttttttgtgtaaatggaaggagaaactcatcaatcggagccgttacctttagcatctggagattccgatgaagggatcagtgctgcgattgaggcggagcttgctgagttagctgctggagattcaagcggcggtggtggttgcggcggcggaggaggagggattaggagtaaagtcaaaggaccttggtctacggaggaagacgcggttcttacgaagcttgtgaggaaactaggaccgaggaattggagtttgatcgctcgtggaatccctggtcgttctggtaaatcttgtcgattgcgttggtgtaatcagcttgacccttgtctcaagcgtaaacctttctctgatgaggaagatcgtatgataatttctgctcacgcggttcacggaaacaaatgggcagtgattgcgaaactgttaactggaagaacagataacgctatcaagaaccattggaactcaactcttagacgtaaatacgcagatctatggaataatggtcaatggatggctaattcagttactaccgcttccgtcaaaaacgaaaatgtcgatgaaacaactaatcctccatcctcaaaacaacagttgcctcaaggagatatcaattcctccccgccaaagcctccacaagtgagtgatgttgtaatggaagaggcagctaatgaacctcaagaacctcaagaacaacaagaacaagctccaccggtagtgagtaacgttccaacagaaaataacgtgtttcgccccgtggctcgcgttggtgcattcagtatctataacccaaccagccagaaaaatggttacagagactacaatatagttccatgtgagggaccgttgattcaagcagctaaacccgattcattggctggtaaatttctacaatctctttgtgatgaacctcaaatcccgtcaaaatgtggtcacggctgctctactcttccagctgaaactaagttctcacgtaactcggtgttgggacctgagtttgtggattatgaagagccttctgcggttttcaaccaagaactaatatctatagcaaccgatttgaacaacattgcatggataaagagtggccttgacaatgctgttgtcagagaagcagaacagagtttgaagatggataattacaattataatgatcctcgaatcaagtttactggaatgatgcctagacaagatttcttctgtgcaagaagctgaaactcaaaagtagggcttgagattcatcaaccc

SEQ ID NO: 4309 - DNA, 646 bp, Artificial Sequence
  P2011 (35S::G2631)
aacttcgcggtctagatcttccggtaatctgattttccttttgaattctgatcatgtagatttaaaactatggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagctaatcaacaaaaccgcaaaggaatcccttattttaacattatccttttgacttctttttctttctagcaatatctctgtaaagtgcaa

SEQ ID NO: 4310 - DNA, 864 bp, Artificial Sequence
  P2012 (35S::G2701)
gtgtttgtagttgaaacttattcttccctttttttgtttttaggtatggagactctgcatccattctctcacctacctatctctgaccaccggttcgttgttcaagagatggtgagcttacacagctcgagtagcggtagctggactaaagaagagaacaagatgttcgaacgagctcttgcgatatacgctgaagactcgcctgatcgctggtttaaagttgcttccatgatccctggaaagactgtttttgatgttatgaagcaatatagtaagcttgaagaagacgttttcgatattgaagcaggacgtgttcccattcctggttatcctgcagcttcttctcccttggggtttgacacggacatgtgtcgtaaacggcctagtggagctagaggatctgatcaagatcgaaagaaaggagtcccttggacagaggaagaacacaggagattcttgttaggccttctcaagtacggtaaaggagattggagaaacatatcgagaaacttcgtggtgtcaaagacgccaacgcaagtggcgagccacgcccaaaagtattaccagagacagctctccggagccaaggacaaacgcaggccaagtatccatgacatcacaaccggcaatcttctcaatgccaatctcaaccgttccttttccgatcatagagatattctccctgatttagggtttatcgataaggatgatacggaggagggagtaatatttatgggtcagaatctctcttcagaaaatctgttttctccatcaccaacttcattcgaagctgccattaacttcgccggagaaaatgtcttcagtgccggagcttaaggcaacatagaatccccaaactcagcg

SEQ ID NO: 4311 - DNA, 756 bp, Artificial Sequence
  P2014 (35S::G2724)
aagtagaacagaattcgcaaactgtaaaacccttataaatcataaagaagaagtcgaagaagtcgagaaaaagatggaaatagaaataaggagaggtccatggactgtggaagaagacatgaagctcgtcagttacatttctcttcacggtgaaggaagatggaactccctctctcgttctgctggactgaatagaacggggaaaagttgcagattgcggtggctaaattatctccggccggatatccgccgtggagacatatcccttcaagaacaatttatcatccttgaactccattctcgttggggaaatcggtggtcaaagattgctcaacatttaccgggaagaacagataacgagataaagaattattggagaacacgtgttcaaaagcatgcaaaacttctaaaatgtgacgtgaacagcaagcaattcaaagacaccatcaaacatctctggatgcctcgtctcatcgagagaatcgccgccactcaaagtgtccaatttacctctaaccactactcgcctgagaactccagcgtcgccaccgccacgtcatcaacgtcgtcgtctgaggctgtgagatcgagtttctacggtggtgatcaggtggaatttggaacgttggatcatatgacaaatggtggttattggttcaacggcggagatacgtttgaaactttgtgtagttttgacgagctcaacaagtggctcatacagtaggcatttcatgggtttattaatgaatgtaatgt

SEQ ID NO: 4312 - DNA, 1235 bp, Artificial Sequence
  P2016 (35S::G2893)
cccaaatcataaaagcctctctcttagtctatttttatctcacggctctctctcccctctctacacacacaaacacaaataaagcgtaaaactgaaatattttaattacaattagaaagagaacatattaatatgtcaaatataacaaagaagaagtgtaatggaaatgaagagggtgcagagcagaggaaagggccttggacactcgaggaagacactcttctcaccaattacatttcccataacggtgaaggccgatggaatctgctcgctaaatcttctggtaatattcttttcttttatgttttctttgtactattccaacaaaatgcaattggtgaaaatgtcttcctcccacttcatatttttgtattaaaagtttgatctctttttacaaaaaaacaaaaaaacagggctaaagagagcaggaaaaagttgtagattgagatggttgaattaccttaaacccgacataaagcgtgggaatctcactcctcaagaacaacttttaatccttgagctccattctaaatggggtaataggtaagttagttactcaaatgctctctttagctttataattttcttataatctaacgtgtaacatgttgcttcttaattaggtggtcaaaaatttcgaagtatttaccaggaagaacagacaacgatatcaaaaactactggagaactagagtccagaaacaagcacgccagctcaacatagattccaatagccacaagttcatagaagttgttcgtagcttttggtttccaagactgatcaacgagattaaagacaactcatacaccaacaatattaaagctaatgctcctgatttacttggaccaattttacgagacagcaaagatttgggtttcaacaacatggattgttccacttccatgtcagaagatctcaagaaaacttcacaattcatggatttttctgatcttgaaaccacaatgtccttggaaggatcacgagggggtagtagtcaatgtgtgagtgaggtttatagctccttcccttgcctagaggaggagtacatggtggccgttatgggcagttcagacatttcagcattgcatgattgtcacgtggctgattccaagtacgaggatgatgtgacacaagatctaatgtggaacatggatgacatttggcagtttaacgagtatgcacactttaattaggttatattatatttatgtacttcttacaacttggaggggtt

SEQ ID NO: 4313 - DNA, 1119 bp, Artificial Sequence
  P2017 (35S::G478)
agagagatcttcctcgggattgcaacatgttggactacgaatgggataatccttcctccatcgttctctccggagatgaaagaaacccggactctgacccgacccggtcatccttctcctttttcgaccccatctcccattacaacaacgaccaccgtcacatcaccatttctcctcccctcctctcttccttctctaaccaacaacaacagcatcacctcaccctctacggtcagaccaacagcaacaaccagtttcttcatcatcaccatcaccaccactccttgtacgggtccaccaccaccaccactccttacggcgcctccgatcccatctaccatccccactcttccgctccgccagcctccttgttctcctacgaccagacaggaccgggctcgggatccggatcttcctacaacttcctcatccccaagacagaagtggatttcacgtccaacaggatcgggctgaacctgggaggccgtacgtacttctcagcggcggacgacgacttcgtgagcaggctatacaggaggtctcgaccaggtgagtcagggatggcgaactcgctgagcacgccgcggtgccaagcagagggatgcaacgcggatctgagccacgcgaaacactaccacagaaggcacaaagtgtgcgaattccactcaaaagcatcgacggttgtagccgccggactaagccaaaggttttgccagcaatgcagcaggttccatttgctgtcggaattcgacaacgggaaacggagctgccgtaagcgacttgctgaccataaccgccgccgccgtaaatgtcaccaatcagcctccgccacccaagacaccggcaccggcaagactactccaaagtcaccgaacgattcgggtgttaaagcgtcatcgtcaccgtcgtccaacgcgccgcctacgatatcactggagtgcttccggcaaaggcagttccaaacgacagcgtcttcatccacgtcagcgtcttcgtcttcaaattcaatgtttttctccagcggatagttataagctttactcatatgatatattatgcttaaaatgagaaatcaaaggactcttcaatatcactagttaatgctagctgtctatcatc

SEQ ID NO: 4314 - DNA, 2361 bp, Artificial Sequence
  P2020 (35S::G1331)
agaatgagttggtggggagtgaaaggaggaggatggggaatggtggaagaagtttggagaaagggtccatggaccgccgaagaagaccgtcttttgatcgaatacgtccgtgttcacggtgaaggtcgttggaactctgtctctaaactcgcaggtaccaccactttctgtgtaatgcatgttttaatatatgtttttttttcttcaaatgaatgaatgattgattcatgaatgttttgatcgttaggattgaaaaggaatggcaaaagctgcagactaagatgggtgaattaccttagaccagacctcaagagaggacagatcactccacatgaagaaagtataatacttgagctacacgctaagtggggaaataggtaaaaatacctcaaaacgaaaacaaacaacctcaagtcttttttttgtttttttaggtttgtcgatggcttttatcttaagtattagggttttgtataggtggtcaacaattgcacgtagtttaccaggaagaacagacaatgagatcaagaactattggagaacccatttcaagaaaaaggcaaagcctacgactaacaatgcggagaagataaagagtcgtctcctaaaaaggcaacacttcaaggaacagagagaaatagagttgcaacaagaacagcagttgtttcagttcgaccaactcggtatgaaaaagatcatctctttactcgaagaaaacaatagcagtagcagtagcgatggcggtggtgatgtgttctattatcctgatcaaataacacattcatcaaaaccctttggctataactctaattcattagaggagcagttacaaggtagattttctcctgtaaacatacctgatgctaatactatgaacgaagacaatgccatatgggacgggttttggaacatggatgttgtaaatggacatggtgggaacttgggtgttgtggctgctactgctgcttgtggcccaaggaagccctatttccataacttggtgattccattttgttaagtatggtctacttttggacttcggttttctgtcttttcaggtttggttactagtttctatgctatgaacctataagtcgtttgtgatgaagtgtgtgtgtgtgatgtaagaggaatattgtaagttcaagattataaaaaaaaaaacttcaaacgtaagttaatgagcagggaaccatgattcttggatttttatgaatttgtttttgtgtccaatcacaaaaaaaaaaaactcatattagctttgatttgtgatttagatagacaaatccgatttgagttaagcctctaaaattagccgaaatccgtcaaaacaggtgatccagtcatatacacaaagcccacttaataaaaagatttagtcaaaatttgattaattattaggacttcaatttgactaaatgttaaattacaaattaaattgtaagagatttgtttccatttgaagcttgtttccagttttctttgtcaaacttatggaaaagcatttatcttattttctttctatctaatatgaattaaaagtacactatttttgttctttctcttttttttttccttaatttattgataaattatattaaaacaaaaaatcaacgtttttttacataaaatgcaaacttttctttataaagattacaaaatatctctatccgtgatgttctcgcgatgcaaaccacatttgcaatattataatcatatatatgaaagttggacaactctctctatatgattgacacatcatcacttttacatttgccatgtgtccactaaataattaatgtaagctcttcaacttttaataatgtatttattatttaattttacatatttaattgtactaatactaaatttattttgttattacatgtttttcaataaaattattttattggttttctcgtactcaaatatttttttctgtaatcttaactcaaattatgagtgtatagtagtcatggattagttaatagtttgaatagtttgcatattgttatatatctatataataaatcgtcgagggtgaagagtatgtatgaagtttaatcatcaaatttttaggtttcgataatcccaatattaccctctatttaattagtttaagacgaacattgtttaggaatagtgtgtataatgtattgttgataatgttgttagaaaaaaatactttaatactaagaataattacttattatataagtaaatgattagataattaaaaattatatttaaattaaacgatacaaaaaatctgaaaataccgcagtgtaacgcaggtgattacctagtaaaataaaaagaggtcacaaaactttctgatgcacaaagaaactcaatgtcaag

SEQ ID NO: 4315 - DNA, 1661 bp, Artificial Sequence
  P2022 (35S::G1304)
cataacaatattcgtgttatagctagtaataatggggcgatcaccatgttgcgatgagaatggtctaaagaaagggccatggacacaagaggaggatgataaactgatagatcacattcaaaaacatggccatggcagctggagagctcttccaaagcaagccggtttaaaccgatgcggaaagagttgtagattaagatggaccaactacttgagacctgacatcaagagaggaaatttcactgaagaggaagaacaaactattatcaacctccattcccttcttggaaacaagtaatcaattactttttcactttataattccttgctttgttttaaaaaccatcgaatgttaattctttctagtcaaatcattaattatatctcataaaaagttagtgtgaaacgatctaggatgaagtttataactagaattaagagtagtgtgatatatgaaatatataataacatatatattagtatatagtttatggatgaaagaatataattgacatatatacctactacactggttttctctaggtgcatacgtctgtagccgtttttcaatcttgaaaagtaaatcttgttacgactaaagcaagacaatattaggtatatattagtcttagactaatccactgccataatatcaatttgattaatgtttaattatttcgtatatgttttggaaggtggtcgtcgatagccggtaatcttcctggaagaacggacaatgaaataaaaaactattggaacacacatttgagaaagaaacttctccaaatggggattgatccggtgacccataggccaagaaccgaccatctaaacgttttagcagctctcccgcagcttatagccgccgcaaatttcaacagcctcttgaatctcaaccaaaatgtgcaactggatgcaacaactcttgctaaagctcaactgctacacactatgattcaagtccttagcaccaataacaacaccaccaatccttctttttcttcatcaactatgcaaaacagtaacaccaatctctttggccaagcttcttacttagagaaccaaaatctttttggtcagtctcaaaacttctctcacattcttgaggatgagaatttgatggtcaaaacccaaattattgataaccctttggactctttttcttcccccatacaacccggttttcaagatgatcataattcactccctctattggttccggcgtctcctgaagaatctaaagaaactcaaaggatgatcaagaacaaagacatcgtcgattaccatcatcatgatgcttcaaacccttcatcatcaaactcaacgtttacacaagatcatcatcacccatggtgtgacactattgatgatggagcaagtgattctttttggaaagagataatagagtaagtcctatcagtactctcccacatagattgaattttatagttaccacatgaatgcattcagtgaatatggacgatttggctagtctaatgttataattctccgttttgcaggcaaacttgttcggaaccatggccatttcctgaatagacaagattgaaaaatgattaaagagagagtatatttatttttcttgttatttgttgtcgatagagttaaaagcatatttattcttcactaatccttaccgtgtt

SEQ ID NO: 4316 - DNA, 948 bp, Artificial Sequence
  P2023 (35S::G2452)
ttgccttggtcactcaagactctcttcttcactctctgttttttgtcctcttctaaaatttagagaaaaaaacgaaagttttcaccaaaaacagaggaggagctatgtcatcgtcgacgatgtacagaggagttaatatgttttcaccggcaaacacaaactggatttttcaagaagtcagagaagccacgtggacggcggaggagaacaaacggttcgagaaagctctcgcttatctggacgacaaagacaatcttgagagctggtccaagatcgcagatttgattcccggcaaaacagtagctgacgtcattaaacgatacaaggagctagaggatgatgtcagcgacatcgaagccggacttatccccattccgggatacggcggcgacgcctcctccgctgcaaacagtgactatttctttggtctagaaaactccagctacggttatgattacgtcgttggaggaaagaggagttcgccggcgatgactgattgttttaggtctccgatgccggaaaaggagaggaagaaaggagttccgtggaccgaggacgaacacctacgatttctgatgggtttgaagaaatatggaaaaggagattggagaaacatagcaaaaagctttgtgacgactcgaacgccgacgcaagtcgcttcacacgctcagaaatattttcttcgacaactcacagatggtaaagacaaaagacgatcaagtattcacgatatcaccactgttaacatccctgacgcagacgcatccgcaaccgccacgaccgctgacgtagcactctctcctactccagccaattcttttgacgttttccttcagccaaatcctcattacagtttcgcgtctgcgtctgcgtctagctattataatgcgtttccgcagtggagttaaatcacttagaaattatctagagtttgtggtctcctataga

SEQ ID NO: 4317 - DNA, 819 bp, Artificial Sequence
  P2024 (35S::G1305)
cgatgatgatgacaaaagttacatgtccccataagattctctaaaattaaaagtggggtgtgatggggaatagaagagcaccatgctgtgacaaaagccaagtgaagagagggccatggagtgatgaagaaagtgaaagactcagatcttttatcctcaaaaatggtcatcaaaattggcgatctcttcccaaactcgctggattgatgagatgcggaaagagttgtcgtctaagatggataaactatctgagaccaggtctcaaacgaggcaacttcaccaaggaggaggaagataccattatccaccttcaccaagcttatggaaacaagtggtctaagatcgcatccaacttcccgggaaggacagacaacgagatcaagaatgtatggaacactcatctcaagaagcggttggtgaagaggagcatttcatcatcatcatccgatgttaccaatcattcagtgtcttctacctcttcttcctcttcctcaatctcgtcagtcttgcaggacgttattattaagagtgagaggcctaaccaggaagaggagtttggggaaatcttggtggagcaaatggcatgtggatttgaggtggatgcaccacaatcactagaatgtctctttgacgatagccaggttcctcctcctatatctaaaccagactcactacaaacccatgggaagtcatcagatcacgaattttggagccgactgattgaaccagggttcgatgattacaatgagtggctcattttcttggataaccaaacttgctagtgctagaacacacaaggagttgacccatcatgtctta

SEQ ID NO: 4318 - DNA, 1589 bp, Artificial Sequence
  P2025 (35S::G2346)
ctattctcctccgtccttactatttccagagttcagtacttagaaagaaagagagtgatgagcagaagcatctctttctctgtctgagtaagaggaagccaaaaccataatggagttgttaatgtgttcgggtcaggccgagtcaggtggttcttcttccaccgagtcttcttcactcagtggtggactcaggtttggtcagaagatctacttcgaggatggatccggatccagaagcaagaaccgggtcaataccgttcgtaagtcgtctaccacggcgaggtgccaagtggaaggttgtagaatggatctaagcaatgttaaagcttattactcgagacacaaagtttgttgcattcactctaaatcatctaaagtcattgtctctggtcttcatcaaaggttttgtcaacaatgtagcaggtttcccccttttttcttcttccttttatttactcattttgccatttccggtgatcggaatagttctaagggaaccatagctttacgcttttttcaggttttatgttccttttgagctttttgagttttggctcttaacgtcattgaagagtcttatcaaaacttaaactttacagctagttattatgtggtcttgtctcttgtcttatgcattatttaggttgcttttctttgaagctttcttttctttatatcaaatcaggtttcaccagctttctgagtttgacttggagaaaagaagttgtcgcagaagactcgcttgtcataacgaacgacgaagaaaaccacaacccacaacggctcttttcacttctcattactctcgaatcgctccatctctttacggttagatcccaatatacacagcccttttcagctcaatgagtctcaaaaacaagttattgaatttcctgtgtgtcaggaaaccccaatgctgcaatgattaaaagcgttttgggagatcctactgcgtggtcaaccgcaagatcagtgatgcagcggcctggaccgtggcagattaatccagttagggaaacccatccacacatgaatgttttatcacatggaagctcaagctttactacatgtccagagatgataaacaacaatagcacagattcaagctgtgctctctctcttctgtcaaactcatacccaattcatcagcagcaacttcagacaccaacaaatacatggcgaccatcttctggtttcgactcgatgatctcattctccgataaggttacaatggctcagccaccgcccatttcaacccatcagccgcccatctcaacacatcagcagtacctcagccaaacttgggaagtcatcgcgggcgaaaagagcaattcacattatatgtctcctgtgagtcaaatctcggagccagcagatttccagataagcaatggcaccacaatgggtggatttgagctgtatcttcatcagcaggttctgaagcaatacatggaacccgagaacacaagagcttatgactcctctcctcaacatttcaattggtctctttgagtctaatctctttcaccttttaagatcttcatcagtttgttactaaaatcttatcaactatctcttgtgtgctactt

SEQ ID NO: 4319 - DNA, 849 bp, Artificial Sequence
  P2026 (35S::G1332)
aacagcctcactcacttgcaaaactgtggaagaaaaaataaaagatggaatgcaaaagagaagaagggaagtcttacgtgaagagagggttgtggaaaccagaagaagatatgatattaaaaagctatgttgagactcatggtgaaggaaactgggcagacatttctcgtagatccggttcgatttccaaatttttgtgtttactagtaaaggggagatgggattttgggacattaaagaatttgtgtttctgcatgatgtttttttcagggttgaagagaggaggaaaaagctgtaggctgagatggaagaactatctaagaccaaatatcaaaagaggaagcatgtcaccacaagaacaagaccttatcatccgcatgcataagcttcttggaaacaggtctttcctctttcaccactgatcatccctctcataagtttaccgatactaacttcttattcttttccatcagatggtcgttgatcgctggtcgccttccaggtcgtactgacaatgaagtgaagaactactggaatactcatttgaacaagaaacctaattcccgaagacagaatgcacctgaatcaatcgtcggcgccactcctttcacggataagccagttatgtctacagaactgagaagaagccatggagaaggaggagaagaggagagcaatacctggatggaggagaccaaccactttggctatgacgtccacgtaggatctcccttgccacttatttcccactacccagacaacactctcgtgtttgacccatgtttttcctttaccgatttctttcctctgctttaggactttcctggatttatctcgaaggataaattc

SEQ ID NO: 4320 - DNA, 1626 bp, Artificial Sequence
  P2027 (35S::G1313)
tccggagttagggtgggagcttgatgtctaaattgttactgtcagtggtttaattagaaaagagatgagttacacgagcactgacagtgaccataatgagtcaccagctgctgatgataatggaagtgactgcagaagtagatgggatggtcatgctctcaagaaaggcccttggagttcagctgaagatgatattcttattgactatgtgaataagcatggtgagggtaactggaatgctgtgcagaaacacaccagcttgtttcgttgtggtaaaagctgtcgtctaagatgggctaatcatctgaggccaaatttgaagaaaggagcttttagtcaagaagaagaacagcttatcgttgaattgcatgccaagatgggtaatagatgggcacgtatggctgcacatgtaagtgttttgtttctgataaggatatggttccttttgtaaaagtgtgtttcgagactaatttcatagagtttttgtttgctccagttgcctggccgaacggataatgagataaagaattattggaacactcgtatcaagaggcgacaacgagctggtttgccactttatcctcctgagatgcatgttgaggcacttgagtggagtcaagagtatgccaagagtagagttatgggagaagatagaagacatcaagatttcttgcagctggggagttgtgaatctaatgtcttctttgatactcttaattttaccgacatggtacctggtacttttgatctagcagatatgactgcctacaaaaatatgggtaactgtgcaagttctcctcgatatgaaaacttcatgacaccaacaatcccctcctcgaagcgactttgggaatctgagttgttgtatcctgggtgtagcagtaccataaagcaagaattctcgtcgcctgaacaattccggaacacatctccacaaacgatttccaaaacttgcagcttctcagttccttgtgatgttgagcatcctctctatggaaaccgacattcacctgttatgattccagatagccatacccctacggatggcattgttccttattctaagcccttatatggggcagtgaagctggagctcccttcattccaatattcagaaacaacatttgaccagtggaagaaatcgtcatctcctccacactctgatctccttgatccctttgatacttacattcagtctccaccaccaccaacggggggagaagagtcagatttatattcaaattttgatactggtctgctcgatatgttgcttctggaagccaagatcagaaataatagtacaaagaacaatttgtacaggagctgcgcttcaactattccatcagctgatcttggccaggttactgtatcccaaactaaatccgaggagtttgacaattcccttaagagcttcttggttcattccgaaatgtccacacaaaatgcagatgaaactccaccaagtgagttactattcaccttaccatcacttgaaatagtttgttgaagatttcatctttttccctagaattctatttggtatcctgattttactttttgagaatcatcacttgcattaatttgtttcttatagccgagattttgagctgatcaagaactcaccta

SEQ ID NO: 4321 - DNA, 1727 bp, Artificial Sequence
  P2029 (35S::G1927)
ctcgttgaccccgatcgagatggttgattcttctcgtgattcgtgtttcaaagctggtaagtttagtgctccaggttttcgatttcaccctactgatgaagagcttgtggtttattatcttaagaggaagatctgttgtaaaaaacttcgagtcaatgccattggtgtcgttgatgtttacaaagtcgatccttctgaattgcctggtctatcgatgttgaagacgggagatagacagtggttctttttcactccaaggaataggaagtatcctaacgcagctaggtcaagtagaggtactgcaactggttattggaaggcgacaggaaaggatcgagtcattgagtacaattcaagatctgttggactcaagaagactcttgttttctatagaggtcgtgctcctaatggtgagagaactgactgggtgatgcatgagtacactatggatgaagaagagctagggagatgtaagaacgctaaggagtattatgctctttataagctttataagaagagtggggctggtcctaagaatggtgaacagtatggtgctccgttccaagaagaagaatgggttgatagtgatagtgaagatgcagatagtgtcgctgtaccggattatcccgtggtccgttatgagaatggtccttgtgtggatgatactaaattttgcaatcctgtcaaacttcagttagaggatattgagaagcttctcaatgaaatcccagatgcacccggggttaaccaaagacagtttgatgagtttgttggtgttccacagggtaatagtgcagaagtgatacagagcacattgctgaataattcttctggagagtatattgaccctcggacgaatggaatgttcttgccaaatggccagctatacaacagggactcgagttttcagtcccatttgaattcatttgaggctacctctggtatggcacctcttctagataatgagaaggaggagtacattgaaatgaatgatcttctgatccctgagctcggtgcttcttcaacagagaaatccacagagttcttgaaccatggtgaatttggtgatgttaatgaatacgaccaattgttcaatgacatatctgtttttcagggaacttctacagatctgtcttgtctgagtaattttactaataacacatcaggccaaagacagcaattactttatgaacagttccagtaccagacacctgagaaccagcttaataactacatgcatcctagtaccactcttaatcagttcactgacaatatgtggtttaaagatgatcaggctgctctctatgttcaaccaccacaatcttcttctggagcattcacttcacagtcaacaggtgtgatgcctgagtctatgaatcccactatgagtgtaaatccccaatacaaggaaggacaaaatggtggtggaacaaggagccagttctcatcagctctgtgggaattattggaatcaataccatcaacaccagcctctgcctgtgagggtcctcttaaccagacctttgtgcgtatgtctagcttcagccgcatcaggttcaatggaacgtcagtgactagtagaaaagtcactgtagcaaagaagcgtatcagtaacagaggttttcttctgttatcaattatgggtgctttgtgtgctatcttctgggtgttcaaagccaccgttggagttatgggaagacctctcttgtcgtgaacctagactcttg

SEQ ID NO: 4322 - DNA, 977 bp, Artificial Sequence
  P2030 (35S::G2531)
gatcagtaaaataagaaggatgagttggtgtgatggttcagatgataactacgatcttaatcttgaaagagtatcgaacactgatcatccatcggttcaactcaaagaccaatctcaatcatgtgtaacgagccgtccagattccaagattagcgctgaaactcccatcacgacttgtccttcttgcggacacaagctccatcatcaccaagacgaccaggttggtagcatcaaagatttaccaagcttaccggcaggagtcaaattcgatccgtcggataaagagatccttatgcatttggaggcgaaggtatcatccgataagcgaaaacttcatccgttgattgatgaatttatacctacgcttgaaggagagaatggaatttgttatacgcatcctgagaaacttcctggagtaagcaaggacgggcaagtacggcacttcttccaccggccatcaaaggcttatacgaccggaacacgaaaacgaagaaaagtgagcacagatgaggaaggccatgaaacaaggtggcacaaaacaggcaagactcgacctgttttgtctcaatcaggagaaaccggtttcaagaagatcctagtgctctacaccaactatggtcgccagaagaagcctgagaagacgaattgggtgatgcatcagtatcatttaggtagcagcgaggacgaaaaagacggtgaaccagtcctctctaaagtcttctaccaaacacagcctaggcaatgcggttcgatggaacctaaaccgaaaaatctcgtaaacctaaaccggtttagttatgaaaatattcaggccggtttcgggtatgagcatggtggtaaaagtgaagagacgacgcaggtgattcgagagttggtagttcgtgaaggcgatgggtcatgttcgtttcttagttttacttgtgatgcaagtaagggtaaagaaagcttcatgaagaatcaatagaacataacatata

SEQ ID NO: 4323 - DNA, 1042 bp, Artificial Sequence
  P2032 (35S::G2053)
atggagaatccggtgggtttaagattccgtccgaccgacaaggagatcgtcgtcgattacctccgaccaaaaaactccgatagggacacgagtcatgttgatcgagtcattagcacagtcactatccgtagcttcgacccttgggagttaccttgccagtctaggatcaaactgaaagatgagtcttggtgtttcttcagccctaaggagaacaaatatggcagaggtgatcaacaaattagaaaaacgaaatctggttactggaagattactggcaaaccaaagcctatcttgcgtaaccgccaagagatcggtgagaaaaaggttttgatgttttacatgagtaaggaacttggtggatccaaatccgactgggttatgcacgagtaccatgctttctctcctactcagatgatgatgacatatacaatatgtaaagttatgtttaagggtgacgtgagagagatttcttcttcttctgcttcttatggtagtgaaattgagcagagtcgtgactctttaatccctcttcttgtgaacgattctgaggaagaagctcaaatcgaggatgctataccaatagaggaatgggaaacatggttgactgatgatggtgttgatgagcaggtgaatcatattatgaatatgaaagatgatcgcaacaaccacaggcctcaaaagccattgactggtgtcttgattgacgatagtagtgatgatgatgatgattctgatttgctatctccaacaacaaattctattgaaaattcgagcacttgtgatagttttggtagctcagaccaaatcaacttagtgtcactaactcaagaggtgagccaagctctgataaccagtattgatacacccgagaagattaagagtccttatgatgatgcacaagggactggggctggagggcaaaaattgggtcaagagactcgagagaagaaacgagctggtttctttcacaggatgatacaaatattcgtcaagaaaattcaccaatgttcttctatctcaagaacataatagcagtaaatga

SEQ ID NO: 4324 - DNA, 621 bp, Artificial Sequence
  P2038 (35S::G2510)
ataacaaactctttaatgtcaccacagagaatgaagctatcatcaccaccagttaccaacaacgaaccaaccgccaccgcttctgccgttaaatcttgcggcggaggaggtaaagaaaccagctcatcgaccacgaggcatccagtgtaccacggagttcgcaaacgccgatggggaaaatgggtttctgagatcagagagccccggaaaaagtctcggatttggctcggatcttttccggtgccggagatggctgctaaggcctacgacgtggcagcgttttgtctaaaaggtagaaaagctcagctgaatttccctgaagaaatcgaggatctacctcgaccgtccacgtgtactcccagagatatccaagtcgcagcggccaaagcagccaacgccgtgaagatcatcaaaatgggagatgatgacgtggcaggaatagacgacggagatgatttctgggaaggcattgagctgcctgagcttatgatgagtggaggtgggtggtcgccggagccttttgttgccggagatgatgccacgtggcttgtcgacggagacttgtatcagtatcagttcatggcgtgtctgtgagtgttgctgtcgattgtgtcgtattcg

SEQ ID NO: 4325 - DNA, 1183 bp, Artificial Sequence
  P2039 (35S::G2509)
atatattccctctttcattctccttcttcgtcttttctttgtttctcatattcaagacatcctcaattccaaatcttaaaccctaaatttacagacacaatcgagatcacctgaaaaaagaggtttaaagattttagcaaagatggcgaattcaggaaattatggaaagaggccctttcgaggcgatgaatcggatgaaaagaaagaagccgatgatgatgagaacatattccctttcttctctgcccgatcccaatatgacatgcgtgccatggtctcagccttgactcaagtcattggaaaccaaagcagctctcatgataataaccaacatcaacctgttgtgtataatcaacaagatcctaacccaccggctcctccaactcaagatcaaggtatatttacatatatagttgacaaattagttaccatatttatgggatgatatatgtgaatgaaaaaatgagcataatgttttataatagcagttgaatttgtgctctggacgacgaatatatccatgtagtatatatgagaaatatatcaagtatatatacgaatgttttctcttgttgattagggctattgaggaagaggcactatagaggggtaagacaacgaccatggggaaagtgggcagctgaaattcgggatccgcaaaaggcagcacgggtgtggctcgggacatttgagactgctgaagctgcggctttagcttatgataacgcagctcttaagttcaaaggaagcaaagccaaactcaatttccctgagagagctcaactagcaagtaacactagtacaactaccggtccaccaaactattattcttctaataatcaaatttactactcaaatccgcagactaatccgcaaaccataccttattttaaccaatactactataaccaatatcttcatcaaggggggaatagtaacgatgcattaagttatagcttggccggtggagaaaccggaggctcaatgtataatcatcagacgttatctactacaaattcttcatcttctggtggatcttcaaggcaacaagatgatgaacaagattacgccagatatttgcgttttggggattcttcacctcctaattctggtttttgagatcttcaataaactgataataaaggatttgggtcacttgttatgaggggatcatatgttttct

SEQ ID NO: 4326 - DNA, 949 bp, Artificial Sequence
  P2042 (35S::G2295)
gtaatatataacaataactcaggttacaaaggatggttccgaaagtggtcgacctacaaaggatagcgaacgataagacaaggataacaacttacaagaagaggaaagctagtctttacaagaaggcacaagagttctcaactctctgcggcgtcgagacatgtctcatcgtctacggtcccacgaaggctaccgatgtggtgatttccgagccagagatatggccgaaggacgagaccaaagtcagggccatcatacgcaagtacaaagacacagtgtcgaccagctgcaggaaagaaaccaacgtggagactttcgtcaacgatgtagggaaaggaaacgaggtggtgactaaaaagagagtgaagcgtgagaataagtattctagttgggaggagaagctagacaagtgttcacgagagcaactacatgggattttctgtgccgtggatagcaagttaaatgaagctgtaacgagacaggagcgtagtatgtttagggttaatcatcaagccatggacacaccattcccgcagaatttaatggaccaacaattcatgccacagtattttcatgagcagccacagtttcaaggcttccctaataatttcaataatatgggtttctcgttgatttcacctcatgatggtcagattcaaatggacccaaatctcatggagaagtggaccgacttggctttgactcaaagcttgatgatgtcaaagggaaacgatggtactcaattcatgcagaggcaagaacaaccatactataatcgtgaacaggttgtatcgaggtctgcaggtttcaatgttaacccgtttatgggatatcaagtcccgtttaatattcctaattggagattatcgggaaatcaagttgaaaattgggagctttcagggaagaaaacgatatgatttgaattacggagctttattagtttttaggg

SEQ ID NO: 4327 - DNA, 1005 bp, Artificial Sequence
  P2043 (35S::G2290)
ctttctcttccaatcaagaacaaaccctagctcctctctttttctctctctacctctctttctctatcttctcttatcactacttctctcgccgatcaatcatcatgaacgatcctgataatcccgatctgagcaacgacgactctgcttggagagaactcacactcacagctcaagattctgacttcttcgaccgagacacttccaatatcctctctgacttcggttggaacctccaccactcctccgatcatcctcacagtctcagattcgactccgatttaacacaaaccaccggagtcaaacctaccaccgtcacttcttcttgttcctcatccgccgccgtttccgttgccgttacctctactaataataatccctcagctacctcaagttcaagtgaagatccggccgagaactcaaccgcctccgccgagaaaacaccaccaccggagacaccagtgaaggagaagaagaaggctcaaaagcgaattcggcaaccaagattcgcattcatgaccaagagtgatgtggataatcttgaagatggatatcgatggcgtaaatatggacaaaaagccgtcaagaatagcccattcccaaggagctactatagatgcacaaacagcagatgcacggtgaagaagagagtagaacgttcatcagatgatccatcgatagtgatcacaacatacgaaggacaacattgccatcaaaccattggattccctcgtggtggaatcctcactgcacacgacccacatagcttcacttctcatcatcatctccctcctccattaccaaatccttattattaccaagaactccttcatcaacttcacagagacaataatgctccttcaccgcggttaccccgacctactactgaagatacacctgccgtgtctactccatcagaggaaggcttacttggtgatattgtacctcaaactatgcgcaacccttgaggtaagcttggtacgtagcaatagctaaggaggtgct

SEQ ID NO: 4328 - DNA, 733 bp, Artificial Sequence
  P2046 (35S::G2136)
acaaaaatctcttgttcttcttgtcttcaatatggaggatggggaagcttcaacaatcactttcttaccaaccacggaaccaaaacccctacaaaaccctaacttgctggccaaaccaaaaaaagagactaaacaaaaaaaacctaaaaccaccaaaggtcgacagaagatagagatcaaggagatcatgctggagacccgaaggcaagtgacgttttccaaacgacgatccgggcttttcaaaaaagcggcagaattaagcgttctctgcggcgcacagattggtatcataacgttttcacgttgcgataggatctactcgtttggtaacgtgaactcactcatcgataaatacttgcgtaaggctccggtgatgctgaggtcacatcccggtggtaacgtggcaaacggagaggaagataacgacggtttgatgtggtgggagagagcggtggagagtgtgccggaggagcatatggaagagtacaagaatgccttgagtgtgttaagggagaatttgttgacgaggatctaccagatgagtggtgatcggacggttgagaatcttccggcatttccaaatgagatggctatggctgactggaaattaacgaatgaaaatctgatggctaggaacgatcgaggttatggaggtaacaatggtgatttggagtttgcgtttatgcctcaaaacggtagacagtgaggtgttttttctttaatttattattac

SEQ ID NO: 4329 - DNA, 2366 bp, Artificial Sequence
  P2048 (35S::G2110)
gagagctaataaaaaatttatcaaagaagactaatatggagaaggacgatttcttgaggagtggtcatggaagagaagaaagccatgatgagatgagaaaacttgattcatctcacgatgattctcatcaagaacacgaccatattataagatccaaggtatcataaatttccttttgtatagttttcaaatatttagacgtcatttataaatcgcataaatcaatccttggaattacatacatgtatctttcataatcttatcacatagatggtttgttttatccaaaatccatttttattaattgattgattagtcttaatcaatgaatcttaatttgaattctaaaatcatactaaattagatcttcaaatctcttgtcagtttcataattttctgtctttgcggaggtttttacgaagaatttgctcatctatatatcacaagtacaataattatgagaaagaaagaaaaaaatatgtattggatttttgaggcatgcatatataatttgaggaaagatcaaccaaacgatagatatttgtatatttgttaagcatatcgtgattaaccatatcttataaacgtatgatgagatcagttggactcaactaaagtcgaaatggatgaggctaaagaggaaaatcgaagactaaagtcatcattgagtaaaatcaagaaagattttgacatccttcaaacacaatacaaccaattaatggccaaacataacgaaccaaccaagttccaatcaaaagggcatcatcaagacaaaggcgaagatgaagacagagaaaaagttaacgaacgtgaagaacttgtctcgttgagcctaggcagacggttaaattcagaggttccaagtggttcgaataaagaagaaaaaaataaagatgttgaagaagcggaaggtgacagaaattatgatgataatgaaaaaagcagtattcaagggttgagtatggggattgaatacaaggctttgagtaatcctaatgagaagttagagattgatcataatcaagaaaccatgtcgttggagattagtaacaataataagatcagatcacaaaatagttttgggtttaagaatgatggagatgatcatgaagatgaagatgagattttgcctcaaaaccttgttaagaaaactagggtttcggtgagatcaagatgtgagacaccaacggttagtacattttattcatatctttaatttaattagtatatacatctatgaatgctaacagtataatccttccttttttctcacttctatttttataagaaaaaaaaacttctcaaagagtatattccacaagaacagaatcaaagtttgtgttttaatttcttgggctatatattgtctctgtagatgaacgacggatgtcaatggaggaaatatggccagaaaatagctaaaggcaatccatgtccccgagcttactatcgttgcaccattgcagcttcttgtccagtaagaaaacaggtaaaagtactaaactgataattatattctaaatagtcctatgttattaaagaaccatatatatatcatatcaactcttttatttaggtgcaaagatgttcagaagatatgtctatacttatctcaacgtacgaaggaacacataaccatccacttcccatgtcagcaactgccatggcctctgccacttccgctgccgcctccatgcttctctccggcgcctcctcctcctcatccgccgcagctgatcttcatggccttaacttctctctttccggcaacaacatcactccaaaacctaaaactcatttcctccaatccccttcttcttctggccatccgaccgtcactctcgacctcacaacctcctcctcgtcgcagcaaccgttcttatcaatgctcaatagattcagctctcctccaagtaatgtctcacgatctaatagttatccttcaaccaatctcaacttttcaaacaacaccaacacattgatgaattggggtggtggtggtaatcccagtgatcaataccgtgcagcttacggcaacattaacacccatcagcaatcaccttaccacaaaatcattcaaacccgaaccgccgggtcatctttcgatccgtttggaagatcatcttcatcacattctccacaaataaatcttgatcatatcggaatcaagaacatcatcagtcaccaagtgccatctttaccggctgaaacaatcaaggcaatcacgacagatccaagtttccaatcggctttggcgacagctctatcttccatcatgggcggcgatttaaagattgatcacaatgtgactagaaatgaagctgagaagagcccttaaagagaattgttatatatatgttcttata

SEQ ID NO: 4330 - DNA, 1243 bp, Artificial Sequence
  P2051 (35S::G1794)
taagtttcagaggaggaggatttagaaggagggttttgtatgtgtgtcttaaaagtggcaaatcaggaagataacgttggcaaaaaagccgagtctattagagacgatgatcatcggacgttatctgaaatcgatcaatggctttacttattcgcagccgaagacgaccaccaccgtcatagcttccctacgcagcagccgcctccatcgtcgtcgtcctcatctcttatctcaggtttcagtagagagatggagatgtctgctattgtctctgctttgactcacgttgttgctggaaatgttcctcagcatcaacaaggaggcggtgaaggtagcggagaagggacttcgaattcgtcttcttcctcggggcagaaaaggaggagagaggtggaggaaggtggcgccaaagcggttaaggcagctaatactttgacggttgatcaatatttctccggtggtagctctacttctaaagtgagagaagcttcgagtaacatgtcaggtccgggcccaacatacgagtatacaactacggcaactgctagtagcgaaacgtcgtcgtttagtggggaccaacctcggcgaagatacagaggagttagacaaagaccatggggaaagtgggcggctgagattcgagatccatttaaagcagctagagtttggctcggtacgttcgacaatgctgaatcagcagcaagagcttacgacgaagctgcacttcggtttagaggcaacaaagccaaactcaacttccctgaaaacgtcaaactcgttagacctgcttcaaccgaagcacaacctgtgcaccaaaccgctgctcaaagaccgacccagtcaaggaactcgggttcaacgactacccttttgcccataagacctgcttcgaatcaaagcgttcattcgcagccgttgatgcaatcatacaacttgagttactctgaaatggctcgtcaacaacaacagtttcagcaacatcatcaacaatctttggatttatacgatcaaatgtcgtttccgttgcgtttcggtcacactggaggttcaatgatgcaatctacgtcgtcatcatcatctcattctcgtcctctgttttccccggctgctgttcagccgccaccagaatcagctagcgaaaccggttatctccaggatatacaatggccatcagacaagactagtaataactacaataatagtccatcctcctgatgacttgcttcattttatttgtttcact

SEQ ID NO: 4331 - DNA, 782 bp, Artificial Sequence
  P2052 (35S::G2298)
cactatactgtcagctccaaaacatacctgaataagtgaatatacattaaaacctaatctatcatcatatccatctctttccctctctgcatttagagatatggatgcatccccaaagtacacaggtgtacggaagaggaagtggggaaaatgggtggctgagattcgtctccccaacagccgtgacaggatctggttaggctctttcgactctgctgagaaggcggcgcgtgctttcgacgcggctctttactgtcttcgtggccccggagcacgcttcaacttccccgacaatcctccggagattcccggtggtcgttctctgacgccgcagcagattcaggtcgtagctagccgtttcgcctgcgaggaggagctactaccaccggaacaacatcatccgtcaccgccacgtggcgaccataataccgaggaagaagtgataatttcggcacgtggggaaattaatagtggtagtggtgggcctacgttagggcaagttggggaagataataacaacgagggtaatagtaatgacacgtcgtcgtattggcctttaatatgggaggaggagaattttgtaggtcctcctaactcagatcatgagttcggttttttcacagatgattcaaccaatttgtacttcccgacacaacaacaacaacaacatcagctctcgtctgatttttactatgatggagcttgtgaagatgatttctctcattacaatattaacctttggaatttctgagatccatttttttggtgatcttggaccaaat

SEQ ID NO: 4332 - DNA, 1048 bp, Artificial Sequence
  P2053 (35S::G1796)
ttgtcctcaaaccaaaaccctagaaaccaaaaatggaaaaagccttgagaaacttcaccgaatctacccactcaccagaccctaatcctctcacaaaattcttcactgaacctacagcctcacctgttagccgcaaccgcaaactgtcttcaaaagataccactgtaaccatcgccggagctggcagcagcacgacgaggtaccgcggcgtacgccggaggccgtggggacgatacgcggcggagatacgtgacccaatgtcgaaggagagacgttggctcggaacatttgacacggcggaacaagccgcttgtgcttacgactctgcggctcgtgcctttcgtggagcaaaggctcgtactaattttacttatccgacagctgtcattatgcctgaaccaaggttttctttttccaacaagaaatcttcgccgtctgctcgttgtcctcttccttctctaccgttagattcctctacccaaaacttttacggtgcaccggcagcgcagaggatctataatacacagtctatcttcttacgcgacgcctcgtgttcctctcgtaaaacgactccgtataataactctttcaacggctcatcatcttcttactcagcatcgaaaacggcatgcgtttcttattccgaaaacgaaaacaacgagtcgtttttcccggaagaatcttctgatactggtctattacaagaggtcgttcaagagttcttgaagaaaaatcgcggcgttcctccttctccaccaacaccaccgccggtgactagccatcatgacaactctggttatttctctaatctcactatatactctgaaaatatggttcaagagactaaggagactttgtcgtcgaaactagatcgctacgggaattttcaagctaatgacgacggcgtaagagccgtcgcagacggtggtttatcgttgggatcaaacgagtgggggtatcaagaaatgttgatgtacggaactcagttaggctgtacttgccgaagatcgtggggatagctagatattcatcatgattatgttttgag

SEQ ID NO: 4333 - DNA, 1036 bp, Artificial Sequence
  P2055 (35S::G904)
ctctcctctcatcaatggaatctctcatcaatcccagccatggcggaggaaaactacgattctcactcttcttctctcgatagtctcaaaccaagcgtactagtcatcattctcattctcctcatgactcttctcatctccgtttccatttgcttcctcctccgctgtctcaatcgctgtagccaccgctccgttctccctctttcatcttcctcttccgtcgcaaccgtaacttccgattcccgacgattctctggacatcgagtctctcccgaaacagaacggtcctccgtgcttgattcgcttccgattttcaaattctcctccgtcactcgccgatctagctccatgaattccggagattgcgccgtttgtttgtcgaaattcgaatcggaggatcagctccgtcttcttcctctctgttgtcacgcttttcacgccgattgtatcgatatctggctagtctctaaccagacttgtcctctctgtcgctctcctctcttcgcttcagaatctgatctcatgaagtctctcgccgtcgtcggctcaaacaacggcggaggagaaaacagcttccgtctcgaaatcggatccatcagccgtcgtcgtcaaacaccgattccagaatccgttgagcagcatcgaacttactcaatcggttcgttcgattacatagtagacgacgtagattcagaaatctcagagtcaaatttcaaccgtggaaaacaggaagacgcgactacaacaactgccacagcaacggcggttacgactaatccgacgtcgtttgaagctagtttagcggcggatataggtaacgatggttctagaagctggctcaaggattacgttgacagactctcacgaggtatatcgtcgcgtgcaatgtcgtttagaagctctggtagattttttactgggagtagtcgtcggagtgaggaattgacggtgatggatttagaagcgaatcatgccggagaagagataagtgagcttttccggtggctctcaggggtgtgagtgacaggtgagttgg

SEQ ID NO: 4334 - DNA, 1033 bp, Artificial Sequence
  P2058 (35S::G2789)
tttagggacaccaaatctattcaacctaaaagccttcttttcccctatattgaccaactttttagcgaatcagaagaggaatggatgaggtatctcgttctcatacaccgcaatttctatcaagtgatcatcagcactatcaccatcaaaacgctggacgacaaaaacgcggcagagaagaagaaggagttgaacccaacaatataggggaagacctagccacctttccttccggagaagagaatatcaagaagagaaggccacgtggcagacctgctggttccaagaacaaacccaaagcaccaatcatagtcactcgcgactccgcgaacgccttcagatgtcacgtcatggagataaccaacgcctgcgatgtaatggaaagcctagccgtcttcgctagacgccgtcagcgtggcgtttgcgtcttgaccggaaacggggccgttacaaacgtcaccgttagacaacctggcggaggcgtcgtcagtttacacggacggtttgagattctttctctctcgggttcgtttcttcctccaccggcaccaccagctgcgtctggtttaaaggtttacttagccggtggtcaaggtcaagtgatcggaggcagtgtggtgggaccgcttacggcatcaagtccggtggtcgttatggcagcttcatttggaaacgcatcttacgagaggctgccactagaggaggaggaggaaactgaaagagaaatagatggaaacgcggctagggcgattggaacgcaaacgcagaaacagttaatgcaagatgcgacatcgtttattgggtcgccgtcgaatttaattaactctgtttcgttgccaggtgaagcttattggggaacgcaacgaccgtctttctaagataatatcattgataatataagtttcgtcttcttattctttttcactttttacctttttcactttcttaggttttgttttaacgtttgattaatacctgaaggtttttggaaaattttcgatcggataaaaggatttatgttgcgagccgaaac

SEQ ID NO: 4335 - DNA, 1879 bp, Artificial Sequence
  P2062 (35S::G2140)
tctcttaactttcgtttcttctcctaccttcttttaccaacctttcctttctcttacacacatatatatatacatatatagagagagagaagaggacaaagagttgaaagatgaagactctcatgtcttcatagaaacaagtgatatgtgcgctaagaaagaagaagaagaagaagaagaagaagacagttctgaagccatgaacaacatacaaaattaccaaaatgacctcttctttcaccaactcatctctcatcatcaccatcatcatcatgatccttctcaatctgaaactttgggagcatccggtaacgttggatctggtttcactatcttctctcaagattccgtctctccaatatggtctctacctccacctacctcgatccaaccaccatttgatcagtttcctcctccttcttcttctccagcatctttctacggaagtttcttcaacagaagtcgagctcatcatcagggattacagtttgggtacgagggttttggtggagccacgtcagcagcacatcatcatcatgaacaacttcggatcttgtcggaagctttaggtccggtagtacaagccgggtccggtccttttgggttacaagctgagttagggaagatgacagcacaagagatcatggacgctaaagctttggctgcttcaaagagtcatagtgaagctgagagaagaagaagagagagaatcaataatcatctcgctaagctccgtagcatattacccaacaccaccaaagtaagtccaaaatttttataacataaattttcatacataagtaaaaacattcatcaatcacacaccgtttaagttttttgtaaataaaaaataatactaaaacaatgtagagtttaagtggaaaaacatagtagctgcgacatgaaagtttatgtcacattttgtctctttttatttttttacatttaggttttataaaaggagaagtaagttattcaaaggttttctgttttgatcaatgatcttgtgggtatttgttaaagtcccgagagagaatcagtcagagactgtagtataaataaaaaagcaaggaatatggaacgtctatgtcgtcgtttggttaattgatgtaataaagagaaacaaccggcgctgcttaaaaagcataaaaagtcttattgccggaccaaatcataacttctacgaccacataattttctcctcgaaactatacaaatatgttttttcttcgttttttttaatgcagacggataaagcgtcgttactagctgaagtgatccaacatgtgaaagagttgaagagagagacttcagtgatctcagagacaaatcttgtcccaacggaaagcgatgagttaacggtagctttcacggaggaggaagaaaccggagatggcagatttgtaattaaagcgtcgctttgctgtgaagacaggtcggatctcttgcctgacatgattaaaacattgaaagctatgcgtctcaaaacgctcaaggcggagataaccaccgttgggggacgagtcaagaacgttttgtttgttaccggagaagagagctccggtgaggaagtggaggaagagtactgtatagggacgattgaggaagctttgaaagcggtgatggagaagagcaatgtagaggaatcatcttcttctggaaatgctaagagacagagaatgagtagtcacaacactatcactatcgtcgaacaacaacaacaatataatcagaggtaatcaattttttacttaaatcgctttttttttcttactttcggtgtatctactacgtgtgttgtttgctggttatggaaatgaatgttgtacgtcacgttatactatagatatatgtgtgtttgtgtgtatgtataacggaa

SEQ ID NO: 4336 - DNA, 1176 bp, Artificial Sequence
  P2064 (35S::G2145)
aagaaaggcaagagttgatcagttagagcgatggacgtttttgttgatggtgaattggagtctctcttggggatgttcaactttgatcaatgttcatcatctaaagaggagagaccgcgagacgagttgcttggcctctctagcctttacaatggtcatcttcatcaacatcaacaccataacaatgtcttatcttctgatcatcatgctttcttgctccctgatatgttcccatttggtgcaatgccgggaggaaatcttccggccatgcttgattcttgggatcaaagtcatcacctccaagaaacgtcttctcttaagaggaaactacttgacgtggagaatctatgcaaaactaactctaactgtgacgtcacaagacaagtaagtggaagatccaatatataatgtttactttcattcactactactacgcaataaactaaataaaatatcattaatttgtgggatataggagcttgcgaaatccaagaaaaaacagagggtaagctcggaaagcaatacagttgacgagagcaacactaattgggtagatggtcagagtttaagcaacagttcagatgatgagaaagcttcggtcacaagtgttaaaggcaaaactagagccaccaaagggacagccactgatcctcaaagcctttatgctcgggttagaaaacatactttatattacttcggtctcaaaaccaaatgacaatgagtaaagtcgttcttaagtgtgttatcaattgttgcagaaacgaagagagaagattaacgaaaggctcaagacactacaaaaccttgtgccaaacgggacaaaagtcgatataagcacgatgcttgaagaagcggtccattacgtgaagttcttgcagcttcagattaaggtatgtagattgttaaaaggattttttgtttttagtcagaatcttatcataactcatgttcaagttaactaaccaaaatgcatattttataaatgtagttgttgagctcggatgatctatggatgtacgcaccattggcttacaacggcctggacatggggttccatcacaaccttttgtctcggcttatgtgaaggacttacaagttacaatgtcaatgtaaagaaacccatttagaacatatatatccctatttgagccaaactaaagagatctacgctaagat

SEQ ID NO: 4337 - DNA, 1219 bp, Artificial Sequence
  P2066 (35S::G2520)
atactcaccaagccacaatcatttctctcttctctatctctctggttttgaatcggcgacgactgagtcaactcggtgttgttactggtttcgtcgtatgtgttgtaactgattaagttgatggatccgagtgggatgatgaacgaaggaggaccgtttaatctagcggagatctggcagtttccgttgaacggagtttcaaccgccggagattcttctagaagaagcttcgttggaccgaatcagttcggtgatgctgatctaaccacagctgctaacggtgatccagcgcgtatgagtcacgcgttgtctcaggcggttattgaaggtatctccggcgcttggaaacggagggaagatgagtctaagtcggcgaagatcgtctccaccattggcgctagtgaaggtgagaacaaaagacagaagatagatgaagtgtgtgatgggaaagcagaagcagaatcgctaggaacagagacggaacaaaagaagcaacagatggaaccaacgaaagattatattcatgttcgagctagaagaggtcaagctactgatagtcacagtttagctgaaagagcgagaagagagaaaataagtgagcggatgaaaatcttgcaagatcttgttccgggatgtaacaaggttattggaaaagcacttgttctagatgagataattaactatatacaatcattgcaacgtcaagttgagttcttatcgatgaagcttgaagcagtcaactcaagaatgaaccctggtatcgaggtttttccacccaaagaggtgatgattctcatgatcatcaactcaatcttctccatttttttcacaaaacaatacatgtttctatcgaggtattctcggggtaggagtctcgatgtttatgcggttcggtcatttaagcattgcaataaacggagtgacctctgtttttgctcctgctccccaaaaacagaacttaagacaactatattttcacaaaacatgacatgtttctgtcgatattctcgagtaggagtcgctattagttcatctaagcattgcaatgaaccgtttggtcagcaagcgtttgagaatccggagatacagttcgggtcgcagtctacgagggaatacagtagaggagcatcaccagagtggttgcacatgcagataggatcaggtggtttcgaaagaacgtcttgataaagaaacaacacttggtcatcatcttactaca

SEQ ID NO: 4338 - DNA, 1504 bp, Artificial Sequence
  P2068 (35S::G2552)
atgcatgacattacaagacgtaactgaataaactaatatcaaccaactatcaagagtacatttctttaaatttgttttaattgatttcttaacttattatgttaattaatacagtttatttcatactcactctattatataaactcattttgtctctctttcgttgtcaacaacttttcttcattgacaaaaacacacaaatggaaggaagagtcaacgctctgtcaaacataaacgatctcgaacttcacaatttcttggtcgatccaaacttcgatcagttcataaacctcataagaggagatcatcaaaccattgacgaaaacccagttcttgatttcgatcttggtccattacaaaacagcccctgtttcatagacgagaaccagttcatcccaacacctgtcgatgacctcttcgacgaattgcctgacttagactccaacgttgctgaatcattccgtagcttcgacggtgatagtgttagagccggtggtgaagaagatgaagaagattacaacgacggtgatgattcttcagccactactacgaataatgatgggacccgtaagacgaagactgatcggtctaggactttgatctctgagagaagaaggagagggcgtatgaaggataagctttatgcattgagatctcttgttcccaatattactaaggtaagtcacaacattttcaagatttggtaatgactaatgaaactgtaaatattgatgaagtatgtgtgtgttggcatttagatggataaagcatccattgttggagatgcagtgttgtatgttcaagaacttcagtcacaagcgaagaaactcaaatccgatatcgcgggtcttgaagcttctttaaactctactggagggtaccaagaacatgctcctgatgctcaaaagactcaaccttttcgcggtatcaatcctcctgcttccaaaaaaatcattcaggtaataacctaaaaaaaccaatcaatcttcttgaaacatcaaagtgtttaaagtttgtatgttttgttgtgttagatggatgttatacaagtggaggagaaagggttttatgtgagattggtgtgtaacaaaggagaaggtgttgctccatctctttacaagtctttggagtctcttacaagtttccaagtgcagaactctaacctaagctctccttctccggacacatacctcttaacatataccttagatgtaaatcaacttgtgcccttttactttgttttgtttccgagtataccgtttacttaccgagttttcttgtgtggtggaaacaggggacatgcttcgaacagagcttaaacttgcctaacctgaagctgtggatcactggatcacttttaaatcaaggttttgaattcatcaagtcatttacttgattctataacgcttgctctaacgtgagtcaaatccggttctgcactatattgattgtgtacctttcttacatgtttcataacttccagggctctaatttctattctagt

SEQ ID NO: 4339 - DNA, 2197 bp, Artificial Sequence
  P2069 (35S::G2555)
aaagacaacaatcggagaacaatctggtctgctgctaaaatttaataaattgttttgtctaattgtctccacccataaaaaagcgcgaattcaattcaccgactaaagacattctccggtggagaccccgatgcaatccactcatataagcggcggaagtagcggtggtggtggtggaggaggaggagaggtgagtcgaagtggattatctcggatccgttcagctccagctacttggattgaaaccctactcgaagaagatgaagaagaaggtttaaaacctaacctttgtttaacagagctgcttactggtaataataactctggaggagtgataacgagtcgtgacgactcgttcgagttcctgagttctgttgagcaaggattgtataatcatcatcaaggtggtggctttcaccgtcagaatagttctccggctgattttcttagtgggtctggttctgggactgatgggtatttctctaattttggtattccggcgaattatgactatttgtcgaccaacgttgatatttctccgactaaacggtctagagatatggaaacacagttttcttctcagctggtaagactctgtttccattaaattcagataaaaatgcgaactttaatggaaagataaacttttttttgttgcttactttaatgtcaagttgtgtgaatttgtggtcaaaatggtgaggttaggttctattttggggattgatacggttttagtttaattgggtgtttgaattcttcagttgtggagacaataaagatgtaaaagagttgtcttgtctaatttgacaacttgcatttgtttgaaacaaattcccctgcaagttgcagttgttttttctttgtttccctgtggctgtgaaagtgaatgttgcataaagtttgtattagtagatgggcaaacaaaaagagccttcattggttagatatgtatcgatcttgtaactttagaagtttctgaatcatgacttttgtgaaatgaaacatgttttcatgtgtgcatatggtttgtgagttaactaataactcttcccttttggtttgtgagtagaaagaagagcaaatgagtggtgggatatcaggaatgatggatatgaacatggacaagatttttgaggattcagttccttgtagggttcgtgctaaacgtggttgtgctactcatcctcgtagcattgctgaacgggtaattacttaaaagtttgtgctagatgctttgcagtactaattctgtttctgcctcattcttgttttgtcattaagcttttctctgttcattttgttaggtgagaagaacgcgaataagtgatcggattaggaggctgcaagagcttgttcctaacatggataaggtaaattctttttacaaggcagattggttttaagttttctttgaagtttttaaaaagaattaccaaatgggtccaagattagatatgcttaaagcttaaggttagagcattattgtgaaggcattattggttcttaaggtaggagctagtgcttagccgtaaagtaaaggaatttggatgttaactgttgatgattgtgaaggcattattggaacttcaaaactacttactccttaatccataaactatggttgtgcagtcttttagaagattcaatgcatgatagtccgggagagttataacgcgaagattcgtttttttttgtattttctttgttgcagcaaaccaacactgcagacatgttggaagaagctgtggagtatgtgaaggctcttcaaagccagatccaggtttatctacagatactaattgattagaaacacaaatttatgtttaataaaatatgttaggattttggatttttttgatcattttatttggttttgatgatggattcaggaattgacagagcagcagaagagatgcaaatgcaaacctaaagaagaacaataatgtatcctttaggatttgatatatctgtattttatttttgtactatctaaaaatggtgatgatctgttcgaaaattcgaaacatgatcttatatattgaactagaaaaaatagatatatatgaattttagctgtaaaatttttgtacaataaggagaaaaagatttagaagagtcaataaaaagatgatgtttacaagtcgagaatatatattttgttagttttgtttatcaatttatgctcaaggtttca

SEQ ID NO: 4340 - DNA, 1728 bp, Artificial Sequence
  P2071 (35S::G720)
agcggcggtgttggccgcaaaaacgatgcaaaaccagctatggtcattaccgctaacgatttatcaaaatgggaaaattttcctaaaggacttaaggttcttcttctcctcaacggctgtgacagcgacggagatggctcctcagccgccgagactcgatcagagctcgaatcaatggactatatcgttactacattcaccgatgaaactgaagcactctctgcggttgtcaagaacccggagagcttccacattgccatcgtcgaggtgaatatgagcgctgagagtgagagtttcaagtttcttgaggctgccaaagacgttcttcctactataatgatttcaaccgatcattgcatcactactacaatgaaatgcatagcgcttggtgcagttgagttcctacaaaaaccgctctcaccggagaaattaaagaacatttggcagcatgttgttcataaggcattcaatgatggtggaagtaatgtttcgatatcacttaagccagtgaaagaatccgttgtctcgatgcttcatcttgagaccgacatgacaatcgaggagaaagatccagcgccatcaacaccgcaattgaaacaagattcacggttactagacggtgattgccaagagaacataaatttctcgatggaaaatgtaaattcctcgaccgagaaagataacatggaagatcatcaagacatcggtgaatctaaatcagtcgacactacaaaccgcaaattagatgacgacaaagtggttgtcaaagaagagagaggagacagtgaaaaagaagaagaaggtgaaaccggagatctcataagcgagaagacagattcagttgatattcataagaaagaagatgagactaaaccgattaataaatcatccgggatcaagaacgtgtctggtaacaaaactagtcgaaagaaggtggattggacaccagagctgcacaagaagtttgtgcaagcagttgagcaactcggcgttgatcaagcgataccctcgcggattcttgagttgatgaaagtaggcaccttaacaagacacaatgtagctagtcaccttcagaaatttcggcagcataggaagaatattcttccaaaggatgatcataaccatagatggatacaatctagagagaaccatagaccaaatcaacgtaattataacgtttttcaacagcaacaccgtcccgtgatggcttatcccgtttggggtcttcccggtgtttatccgccaggagcgattccacctttgtggccaccgccgctgcagtccattggtcaaccacctccgtggcattggaaaccaccttatccaacggtgagcggtaatgcatggggttgtccggttggaccgcctgtgaccggatcatatattactccttcgaatactaccgccggcggatttcaatatcccaacggagctgaaaccggcttcaaaataatgccggcgagtcagccggacgaggaaatgttagatcaagtggttaaagaagcgataagcaaaccgtggctgccgctaccgctcgggctaaaaccgccgtccgcggagagcgttttggctgagctaacgcgtcaaggcatctcagccgtcccttcttcttcttgtctaatcaacggctctcatcgtctccgctgacgtgtccatgatgaaacagaacccgcagatatgatgacgtcatgcgtggcgtacttgtccgtgtctgacgatccgaagcgg

SEQ ID NO: 4341 - DNA, 618 bp, Artificial Sequence
  P2074 (35S::G2063)
tttttataaccaataaactcataattgtttttttctccaaaatgaatcccaagaaaaccaaaggaaaacaaaagattaacatcaagaaaattgaaaaagatgaaggcagatcggtcacattctctaagcgtctaaatggtatctacactaaaatcagtgagctttctattctctgtggtgttgaagttgcgtttatcgggtattcttgctctggaaaaccatacacttttggcagtccatccttccaagccgtggcggagcggtttctcaacggcgatgcctcgtcgtcttcttcatcatcattggtcatgaatgctcacaagcaagcgaagattcaagagctttgcaaaaaatacaatagattggtggaggagttaaaggtggacgaagtcaaagtcaagaaggcagctgcattggcggagacgagggtcgtgaataaggatgtgtggtggaaagtggatccaaatgacgtgaaggatcacgaaaaggcgaagaagatgatggagaagtatcaagagctctatgataaactgtgtgagcaagctgcttcaaggatcaagagaggacatgatgagaataataacaaatgattcataatcaagattttaattagtagat

SEQ ID NO: 4342 - DNA, 1172 bp, Artificial Sequence
  P2076 (35S::G2436)
tacaatctctccttttgccaacaatcattgcttaaaaaacacataccttcttctttagttataaaaatgttgaaagaagagagtaatgagagtggtacttgggcacgagcatgtgacacttgtcgttcagccgcctgcactgtctactgtgaagccgactctgcctacttgtgcaccacctgtgatgctcgagttcacgcagccaaccgtgttgcttctcgccatgaacgtgttcgtgtctgtcagtcatgtgagtctgccccagctgcgtttttgtgtaaagcagacgctgcgtctctttgtacagcttgtgatgcagagattcattccgcaaacccactagctagacgtcatcagcgagttccgattcttccattatctgcaaactcttgcagctccatggccccaagtgagactgatgctgataacgatgaggatgatcgagaggttgcttcgtggttactccctaatccagggaaaaacatcggtaatcagaataatgggttcttgtttggtgttgagtaccttgatcttgtggattacagctccagcatggacaaccaattcgaagataatcagtacactcactaccagaggagctttggaggagatggagttgtgccgcttcaagttgaagaatcaacaagtcacctgcaacaaagccaacaaaactttcagttgggtatcaactatggattctcctcaggagctcactacaacaacaactccttaaaggacctaaaccatagcgcatccgtttcatcaatggacatcagtgttgtgccagagtcaactgcaagtgacataacagtccaacacccaagaactactaaagagacgatagaccaactatctggtcctcctactcaggtggtgcaacagcttactccaatggagagggaggctagggtcctgagatacagagagaagaagaagacaaggaaatttgacaagacaataagatatgcttcaagaaaggcatatgcagagataagaccacggatcaagggcagattcgcaaagaggatagaaactgaagctgaggctgaagaaatcttctcaacatcgctaatgtctgagactggatatggaattgtcccttccttctaaactcctatggcgaagatagactagattgcatgctgtaaattacttctagtttggatttctac

SEQ ID NO: 4343 - DNA, 1053 bp, Artificial Sequence
  P2085 (35S::G1945)
ctttatacaccataccatttcccaaagggatttacgaaaagtccctctcctctatcatctctttattcaccccataccaacaacctctacatcttcttcttcttcttcctcctcttttattttctttttaaatcatttacacaaaaatccaaagacaaatctgaaatctctaataaacaaatccataaaataagaaaaacaaagatgaaaggtgaatacagagagcaaaagagtaacgaaatgttttccaagcttcctcatcatcaacaacaacagcaacaacaacaacaacaacactctcttacctctcacttccacctctcctccaccgtaacccccaccgtcgatgactcctccatcgaagtggtccgacgtccacgtggcagaccaccaggttccaaaaacaaacctaaaccacccgtcttcgtcacacgtgacaccgaccctcctatgagtccttacatcctcgaagttccttcaggaaacgacgtcgtcgaagccatcaaccgtttctgccgccgtaaatccatcggagtctgcgtccttagtggctctggctctgtagctaacgtcactttacgtcagccatcaccggcagctcttggctctaccataactttccatggaaagtttgatctcctctccgtctccgcaacgtttctccctcctccgcctcgtacttccttgtctcctcccgtttctaacttcttcaccgtctctctcgctggacctcaaggacaaatcatcggagggttcgtcgctggtccacttatttcggcaggaacagtttacgtcatcgccgcaagtttcaacaacccttcttatcaccggttaccggcggaagaagagcaaaaacactcggcggggacaggggaaagagagggacaatctccgccggtctctggtggcggtgaagagtcaggacagatggcgggaagtggaggagagtcgtgtggggtatcaatgtacagttgccacatgggtggctctgatgttatttgggcccctacagccagagctccaccgccatactaaccaatccttctttcacaa

SEQ ID NO: 4344 - DNA, 1126 bp, Artificial Sequence
  P2093 (35S::G2690)
gtccttttcttgatttttgtatttttttgttatggatatggacgagatgagcaatgtagccaagacaacgacagagacttcaggcttaactgactctgtcttgagcctcacgaaacgcatgaaacctactgaggttacgaccaccacaaaacctgccttgtccaacacgacgaaattcaaaggagttgttcagcaacagaacggtcattggggtgctcagatttacgcagaccatcgaaggatttggcttggaactttcaaatccgctcatgaagccgctgctgcttacgatagcgcatcgattaagcttcgaagctttgatgctaactcgcaccggaacttcccttggtctgattttaccctccatgaaccggactttcaagagtgctacacgacagaagctgtgttgaacatgatcagagacggttcttatcaacacaagttcagagattttctcagaatccggtctcagattgttgcgaatatcaacatcgtgggatcaaaacaagtcttaggaggaggagaaggtggtcaagaatcgaacaagtgtttctcgtgcacgcagctttttcagaaagaactgacaccgagcgatgtagggaaactgaataggcttgtgatacctaagaagtatgcagtgaagtatatgcctttcataagcgatgatcaaagcgagaaagagacgagtgaaggagtagaagatgtggaggttgtcttttacgacagagcaatgagacaatggaagtttaggtattgttactggagaagtagccagagctttgtcttcaccagaggatggaatggtttcgtgaaggagaagaatctcaaggagaaagatattattgtcttttacacttgcgatgtccccaacaatgtgaagacattagaaggccaaagcaagaccttcttgatgattgatgttcatcacttttcaggcaacggtttcgtggttcccgaggaagtaaacaagacggttcatgagatttctgatgaagagatgaaaacagaaaccctctttacctcgaaggtagaagaagaaaccaaatcagaggagaagaaaggagggtttatgctgtttggtgttaggatccaatagctagctacttggttcttaggttttttatat

SEQ ID NO: 4345 - DNA, 979 bp, Artificial Sequence
  P2095 (35S::G2686)
cagaatctaaaccagaaaatgttttcaaacatcgatcacaaggctgtggcagcactccttcatggccagggatgcgctaacatcctcaagacggtcctcgacaactgtaaagttagctctgtttcaacagaacctctcattaacaccattcttgattccttttcactagctctatcttctgtgaattctcctaatcgtcaaccacaccatgagtcttcttctcgagacatggcaggtcttgtgcctcaaagatcatcaaagaagtaagttaccatttaccaacaaaaagctaaacactcggtgcgtatgttataaacaaagttcatgagtttatactacaacatcgcaggaagatttgcggagtaaaaggtttagagatttacagagatgattcccccaatccccgccttgatgacggcttcacctggaggaaatatggacaaaaaaccatcaaaacctctttgtaccaaaggttagtcaattaggtagactacaaaaacagagcaaatggcatgtacataaaaaaacagagtcaatgctcttctctgttctatggaaagacatgtaattacaagtgtgataatttacaggtgttactatcgttgtgcctatgcaaaagaccaaaactgctatgctacaaagcgggtgcagatgatccaagacagtcctccagtttacagaaccacttatttgggacaacatacatgtaaagcctttggggtgcatgataatacgtatggctctgaaatgataaacttcgaccaagttgtatctgaatcggttatgcgtcaacttgcaacaattggtgaacaagctgttctcatggaggacgaagctaaccatatcatgaaccaagaatatgatattaatgattatttggtggatgatgaagtcttttgggggaatgaatttcctctattttcatcggaagacctgatgttgttttgaaaacgttgatgcttttgattagaaacctttc

SEQ ID NO: 4346 - DNA, 1114 bp, Artificial Sequence
  P2096 (35S::G2587)
tacctcaaactcaaacacaagaaatggtttccaacattgatcacaaggctatggaagcactcctccgtggccaaggatgcgctaacaacctcaagattctccttgaaaacggcgaaataagctcagtttcaacagaaccactcatccacaccattctcgattctttctcacttgctctgtcttttatggattctcctaatcatccaccataccatgaatcctcttctcataacatggcaagtcatatgtcccggagatcatctaagcagtaagttaccaacaaaattctaaactcaaattgtatatgtcgtatgcaaattttcataagttcaaaatcaagtgaagtcgcacatgtttttttttttatgttactttatcatatcttctataaccttcgattcaagtgtctcctatattcttgataattcctagagtacaacatcgcagaaaactttgtgtagcagaaggtttagtgaattacaatcacgattcccggactatgtgccccaatgatggcttcacctggaggaaatatggacaaaaaaccattaaagcctcagcgcacaaaaggttagtcaattaggtaaattagaaaaacagagccaatgctctgttttatgaaagacatgtaaatagagtaccggctatttatttattttaagcagcgatagatataaaagtgctatatttacaggtgttactatcggtgtacctatgcaaaagaccaaaactgcaatgctacaaagcgggtgcagaagatcaaagacaaccctccagtgtacagaaccacttacttgggaaaacatgtgtgtaaagcttttgcagttcatgatgatacatatagttccacgatgattcgattcgaccaagttgttcctgaaccgattatgccgcagctcacaacaattgaccaccaagtaattaccgtggaggaaaactccgcagaacatatcatgaaccaagaatgtgatattaatgattatttggtggatgatgacccattttgggctagtcaatttcccccgtttccatcgagtgacacaatgttcttggaaaacatttctgcttttgattagaaccttatccaggttttgaacaacaaatctatcaagct

SEQ ID NO: 4347 - DNA, 908 bp, Artificial Sequence
  P2102 (35S::G134)
ggcacgaggagagagaaagagatagagagagaaagatgggtagaggaaagatcgagataaagaggatagagaacgcaaacaacagagtggtgacgttctcaaagaggaggaatggattggtgaagaaggctaaagagatcacagttctttgtgatgcaaaagttgccctcataatctttgcaagtaatggtaagatgattgattactgttgtccttccatggatcttggtgctatgttggaccaataccagaagttatctggcaagaaactatgggatgctaagcatgagaaccttagcaatgagattgataggatcaagaaagagaatgatagcttacaactggagctcaggcatttgaagggagaagatatacagtctctcaacttgaaaaatctgatggctgtcgagcacgccattgaacatggcctcgacaaagtccgagaccaccagatggagatccttatatcaaagaggagaaatgagaagatgatggcggaggagcaacggcaactcactttccagctgcaacaacaggagatggctatagcaagcaacgcaagaggaatgatgatgagagatcatgatgggcagtttggatatagagtgcaaccgattcagccaaatcttcaggaaaagattatgtctttggtcatcgattgatcatcgagattttataatctcatcctgatcaactcctatctataatatcgtggtctttagtttgtctttatcaatctgtgtgtcttaatctcgagcaacatatatactcgctatcagactttttacttaagctatatgtgtgttgtttgcttatgacctctatgtattggttgtgttgtgtgcttaaacgtttcgaactaattgatctgtgtgaaacttattattctgtgataagctatttgtgat

SEQ ID NO: 4348 - DNA, 825 bp, Artificial Sequence
  P2103 (35S::G135)
cttcatataatttagttattttaagagaaatgggaaggggtagggttgaattgaagaggatagagaacaagatcaatagacaagtgacattctcgaaaagaagaactggtcttttgaagaaagctcaggagatctctgttctttgtgatgccgaggtttcccttattgtcttctcccataagggcaaattgttcgagtactcctctgaatcttgcatggagaaggtactagaacgctacgagaggtattcttacgccgagagacagctgattgcacctgactctcacgttaatgcacagacgaactggtcaatggagtatagcaggcttaaggccaagattgagcttttggagagaaaccaaaggcattatctgggagaagagttggaaccaatgagcctcaaggatctccaaaatctggagcagcagcttgagactgctcttaagcacattcgctccagaaaaaatcaactcatgaatgagtccctcaaccacctccaaagaaaggagaaggagatacaggaggaaaacagcatgcttaccaaacagataaaggagagggaaaacatcctaaggacaaaacaaacccaatgtgagcagctgaaccgcagcgtcgacgatgtaccacagccacaaccatttcaacacccccatctttacatgatcgctcatcagacttctcctttcctaaatatgggtggtttgtaccaagaagaagaccaaacggcgatgaggaggaacaatctggatctgactcttgaacccatttacaattaccttggctgttacgccgcttgaatagactacatcgatctatatcaatctc

SEQ ID NO: 4349 - DNA, 895 bp, Artificial Sequence
  P2104 (35S::G136)
ggatcaatggaggaaggtgggagtagtcacgacgcagagagtagcaagaaactagggagagggaaaatagagataaagaggatagagaacacaacaaatcgtcaagttactttctgcaaacgacgcaatggtcttctcaagaaagcttatgaactctctgtcttgtgtgatgccgaagttgccctcgtcatcttctccactcgtggccgtctctatgagtacgccaacaacagtgtgaggggtacaattgaaaggtacaagaaagcttgttccgatgccgtcaaccctccttccgtcaccgaagctaatactcagtactatcagcaagaagcctctaagcttcggaggcagattcgagatattcagaattcaaataggcatattgttggggaatcacttggttccttgaacttcaaggaactcaaaaacctagaaggacgtcttgaaaaaggaatcagccgtgtccgctccaaaaagaatgagctgttagtggcagagatagagtatatgcagaagagggaaatggagttgcaacacaataacatgtacctgcgagcaaagatagccgaaggcgccagattgaatccggaccagcaggaatcgagtgtgatacaagggacgacagtttacgaatccggtgtatcttctcatgaccagtcgcagcattataatcggaactatattccggtgaaccttcttgaaccgaatcagcaattctccggccaagaccaacctcctcttcaacttgtgtaactcaaaacatgataacttgtttcttctcctcataacgattaagagagagacgagagagttcattttatatttataacgcgactgtgtattcatagtttaggttctaataatgataataacaaaactgttgtttctttgcttc

SEQ ID NO: 4350 - DNA, 948 bp, Artificial Sequence
  P2105 (35S::G137)
aaagtggaaattaaggtaacaaaaagaaatgggaagaggaagagtagagctgaagaggatagagaacaaaatcaacagacaagtaacgtttgcaaagcgtaggaacggtttgttgaagaaagcttatgaattgtctgttctctgtgatgctgaagttgctctcatcatcttctccaaccgtggaaagctctatgagttttgcagctcctcaaacatgctcaagacacttgatcggtaccagaaatgcagctatggatccattgaagtcaacaacaaacctgccaaagaacttgagaacagctacagagaatatctgaagcttaagggtagatatgagaaccttcaacgtcaacagagaaatcttcttggggaggatttaggacctttgaattcaaaggagttagagcagcttgagcgtcaactggacggctctctcaagcaagttcggtccatcaagacacagtacatgcttgaccagctctcggatcttcaaaataaagagcaaatgttgcttgaaaccaatagagctttggcaatgaagctggatgatatgattggtgtgagaagtcatcatatgggaggaggaggaggatgggaaggtggtgaacagaatgttacctacgcgcatcatcaagctcagtctcagggactataccagcctcttgaatgcaatccaactctgcaaatggggtatgataatccggtatgctcagagcaaataactgcgacaacccaagctcaggcgcagcagggaaacggttacatcccggggtggatgctctgagagtcatgtgctgtgttaaagctcaccaacaaaagatcttttatatatataaaagtatagacacaagactttggatttgtagacataagtggctatatataatggtcctgaggatcttcaagacatttgtatcttttgggaatccttgcttatattaagaattc

SEQ ID NO: 4351 - DNA, 1034 bp, Artificial Sequence
  P2106 (35S::G138)
agagttttcagttgggttttggtttcttggtgagagaagagagaaaaagagaggatgggaagagggaaagttgagctgaagaggatagagaacaagatcaatagacaagttacttttgcaaagagaagaaatggtttgctcaagaaggcttatgagctttctgtcctttgtgatgctgagattgctcttctcattttctctaaccgtggcaagctctacgaattctgcagcagccctagtggtatggcgaggacggttgataagtatagaaaacatagttatgcaacaatggatccaaatcaatcagctaaagacttgcaggataagtatcaagactacttgaagcttaaatcaagagttgagatccttcaacattcacaaaggcatttgctaggtgaagagctatccgagatggatgtgaatgagcttgagcatctcgaacgccaagtagatgcatcactaagacaaataagatctaccaaggctcggtctatgcttgatcaactatctgacctcaaaactaaggaggaaatgttattggaaaccaatagagatcttaggagaaagttggaggacagtgatgcagcacttactcaatcgttttggggaagttctgctgcagaacaacaacaacaacatcaacaacagcaacaaggcatgagctcttatcaatcaaaccctccaattcaggaagcaggtttcttcaagcctctacaaggcaatgtagcattgcaaatgagtcattacaatcacaatcctgcaaatgcaaccaactctgcaacaacatcacagaatgttaatggattcttccctggatggatggtctgaaaacaatacatatctatatatgtacacatatgtgtgttttatagatcaaagatcattgcttgtgtcatttgatttttgccagagaaacatagttcattattacaaaactttgttatataatcaaggctctaatgtcaaacaccagattattacttttttgttctttgttttttggctctcttgaaatataaaatattgttttggga

SEQ ID NO: 4352 - DNA, 2170 bp, Artificial Sequence
  P2109 (35S::G142)
atttatcgtgtacgatactttattccttttatctattcttgaaaaaaagttaccaattcttgagaagaagaagaaatcagaatcaagagaaggagagagaaagatgggaagagggagagtggagatgaagaggatagagaacaagattaatagacaagtgaccttctcaaaaagaagaaacggtttgctgaagaaagcttatgagctttctgttctttgcgatgccgaagttgctctcatcatcttctcaagccgtggcaagctctacgagtttggtagtgttgggtatatatatctttgctcctttgaaccaacttttgtgctatatatattaagattcatccaataaagctatgttttttatatgaaaattgattaataaatgggttcatttgctacttgttacatcgtacgattcaagagtcggatcatgttttgatcttgtggttattcttaatggttgtatcgtttatcctgtggtaattagggttcatcgttatatcgtgtctccctcttggatcctttatcataagctaataggtccttccgtacgttataatttgttgatttcccattcatgaattcctttgattctttaatcttacagatgacaggtttcaaatgggtttaattctagctttaaaaaaaaaaaaaacaaacaaactagggttttcccttttagatcagtgtgtaagatatataacttgagttcttgtcgtaagaagaatctttatttgttgaatcgagctaatgatctcccatttttgttttaattgaatttgtagaattgaaagcacaatcgaacggtataatcgttgttacaactgctctctaagcaataataagcctgaagagactacacaggcaagtgtgtgtacgtactttgaatatatttacaattattgtttctgatgataatgattctagctaactctattttctcaaattctcatgttactatatatatgcatttcatataatctatatggtgcagagttggtgtcaggaggtgacaaagcttaaatccaaatacgaatctcttgttcgtactaacaggtctagtaattaagagttttctataaccccttgaaattaaatcgttattgtcatcttccattatatatgtatagttacaaatctattgttatgggtgttgataattgctaattataaaaggaatttgcttggagaagatcttggagaaatgggtgtgaaggaactgcaagcgctcgagaggcagctcgaagccgctcttaccgcgactcgacagcgcaaggtcacatgatctagactggtcttgtttcattaaaaatatattcataactaaaacattcaactaaaatatgcagacacaagttatgatggaagaaatggaagaccttaggaaaaaggcaagttatataaaaatgtttcataccaaactgcaaaacatatatgcatatcaatcaatctatgtttgaaatggcaggagaggcaactaggagacataaacaaacaactcaagattaaggtttttatttctagacatcgcaaaattatattataacttctcatataattaattatgacatttggatcttaactaaacataaattttcaatagtttgaaacggaaggccatgctttcaaaacctttcaagacttatgggcaaactcggcggcatcggtggccggggatccaaacaattctgaatttccggtagagccttctcatcctaatgtattggattgcaacaccgaaccctttttacaaatagggtaagaatataccatttttcccggcccttacaaataaatggatagaaataagatatgattataagacttgtttggtatttggattaggtttcaacaacattactacgtgcaaggtgaagggtcttcggtatcaaagagtaacgtggcaggtgagactaatttcgtccaaggttgggttctttgactctctgttgattagaccacgatgccacggtcaggccaatttcagctctctacagttgttcttttttcaaattagatttctgggtttttttttcctataagaaaaacttttgcactagatgtttgtcatttaatttccagctcgtgtgaatctatattcgcatgtatgtgctttgaagaatttctcctcttactcctacttgatctaaaacattatttttcttttggg

SEQ ID NO: 4353 - DNA, 905 bp, Artificial Sequence
  P2111 (35S::G146)
acgagagcaaattctcaggatgggaagaggaaagatagaaataaagaggatagagaactcaacaaatcgacaagtgacgttttgcaaaagaagaaatggacttctgaagaaagcctatgagctttcggtcctttgcgatgcagaagttgcgctcattgttttctccactcgtggccgtctctatgaatacgccaataacaacataagatcaaccattgagaggtacaagaaagcttgttctgatagcaccaacactagcactgtccaagaaatcaatgccgcgtactatcaacaagaatctgctaagctgagacaacagatccaaacgattcaaaactccaacaggaatctgatgggagactctttgagttccttaagtgtcaaggaactaaaacaagttgagaatcgccttgagaaagctatctctaggatcaggtccaagaagcatgagttgcttttagttgaaatcgaaaacgcgcagaaaagggagattgagcttgacaatgagaacatctatctaagaactaaggtagcagaagtggagaggtatcaacaacaccatcatcaaatggttagtggttcagagattaatgcaattgaagctttagcctcacgcaattactttgctcatagcattatgactgctggttctggatctggtaatggaggttcttactctgatcccgacaagaaaattcttcatctcggataatctcgtctgcgaaaaaccgagctgcaataactctctgcatgcatctggggattctttgctcagatttatctctacataaaatatgttttggtgcaaaataattcaaagtacaatgaaggtattggtccttcaagactcattgcaatttgtgttgtgtaatgattaagacatactctagtttttattgcttcgt

SEQ ID NO: 4354 - DNA, 861 bp, Artificial Sequence
  P2113 (35S::G151)
ttctctctgttcaattttgggggaaaatgggtcgtggaaaaatcgagataaagaggatcgagaatgcgaatagcagacaagtcactttttccaagaggcgttctgggttacttaagaaagctcgtgagctctctgttctttgtgatgctgaagttgctgtcatcgtcttctctaagtctggcaagctcttcgagtactccagtactggaatgaagcaaacactttccagatacggtaatcaccagagttcttcagcttctaaagcagaggaggattgtgcagaggtggatattttaaaggatcaactttcaaagcttcaagagaaacatttacaactgcagggcaagggcttgaatcctctgacctttaaagagctgcaaagccttgagcagcaactatatcatgcattgattactgtcagagagcgaaaggaacgattgctgactaaccaacttgaagaatcacgcctcaaggaacaacgagcagagttggaaaacgagaccttgcgtagacaggttcaagaactgaggagctttctcccgtcgttcacccactatgttccatcctacatcaaatgctttgctatagatccaaagaacgctctcataaaccacgacagtaaatgcagcctccagaacaccgattcagacacaactttgcaattagggttgccgggagaggcacatgatagaaggacgaatgaaggagaaagagagagcccgtcaagcgattcagtgacaacaaacacgagcagcgaaactgcagaaagaggggatcagtctagtttagcaaattctccacctgaagccaaaagacaaaggttctctgtttagtcctagaaaagtatgggagaaggctact

SEQ ID NO: 4355 - DNA, 372 bp, Artificial Sequence
  P2116 (35S::G173)
agaagaaaccaaacttgtctatgagagaagatacaatgtttaagaaagccctcgagctttcaactctgtgcgatatcgaagtctgtgtcatactttatagtcgtgacggagaactcatcaagacatggccggaggatcaatccaaggttcgagacatggcagagaggtttagcaaactacacgagagagagcgacgcaagaaaagaaccaacctttctctgtttctacgtaagaagatcctcgacaacagtaagctctcggagaaagtcttagagatgaaggattcattagaaagtggtctacgggtactacaagataagcttctgttactacaacccgagaaaaaccagaccgagttaggtcagatccccg

SEQ ID NO: 4356 - DNA, 997 bp, Artificial Sequence
  P2117 (35S::G1384)
atttcaggaaactccgatggcggatctcttcggtggtggccacggcggcgagcttatggaagcacttcaacctttttacaaaagtgcttccacgtctgcttcaaatcctgcgtttgcgtcctcaaacgatgcgtttgcgtctgccccaaacgacctattttcttcttcttcttactataatcctcatgcatctttattcccttcacattccacaacctcttacccggatatttattctggatccatgacctatccatcttcattcgggtcggatcttcaacaacccgaaaactaccaatctcagttccattaccaaaacactatcacttacactcaccaagacaacaacacttgcatgcttaacttcattgagccgagccaaccgggttttatgacccaaccgggtccgagttcgggttcggtttcaaaaccggctaagctctatagaggagtgaggcaaagacattggggaaaatgggtcgcggagatccgtttacccaggaaccgaacccgactttggctcggaacattcgacacggctgaagaagccgcgttggcttatgatcgcgccgcgtttaagcttcgtggtgactcggctcggcttaacttcccagctctccgataccaaaccggctcgtctccgtctgataccggcgaatatggtcctattcaagctgccgtagacgctaaactagaagccatattagctgagccgaagaatcagccgggcaaaacggagaggacgtcgaggaaacgagctaaagccgcggcttcttcagctgagcagccgtcagcgccacaacaacattccgggtcgggtgaaagtgatgggtcgggttcaccgacttcggatgttatggtgcaggagatgtgccaagagccagagatgccatggaatgaaaatttcatgctcggcaagtgtccttcttatgagatagattgggcttcaattttatcgtgaaaaattaggattcaattcatttttattcattttaac

SEQ ID NO: 4357 - DNA, 1080 bp, Artificial Sequence
  P2118 (35S::G1846)
tctgtttgacattttgtcgaacacttggacggcatcacaaaaagctctaaactttctgactaccaatggcggattcgtcttccgacaaggagaagaaggaaaataataagcagcccgtgtatcgtggagtccgtatgaggagctggggaaaatgggtatcggagattcgcgaaccgaggaagaaatcgagaatctggctcgggacttttccgacggcggagatggctatgcgtgctcacgacgtggcggctatgagtatcaaaggaacttcagccattctcaatttccctgagctctctaaacttcttccccgacccgtttcgctcagccctcgtgacgtcagagctgcggcgaccaaagctgctctcatggacttcgatacgacggcgtttcgttcggatactgagactagcgaaacgacgacgtcgaataaaatgtcagagagtagtgagagtaacgaaacggtgtcgttctcatcgtcgtcttggtcctctgttacgagcattgaggaaagtacagtctccgacgatcttgacgagatcgtaaagttaccgagtctaggaacgagcctaaacgagtcgaacgagttcgtgatatttgactcgttggaggatttggtgtacatgcctcggtggttaagcggtacggaagaagaagtttttacgtataataacaatgattcttcgttgaattactcatcagttttcgaatcttggaaacattttccctgagaaaagaaagaagccatattttctctctctttttcgccatttttggttttaagttttttgatgggattctctctgtttttgctatgcgtgagatatctctctttgtggaatagataacttttctgttgaaaatctcctaagtctgtgaaatgaacgacgatggaaatgtaagtgtgtatattagcccgaaataatgactgtatacattcttttttgcaagatcattagaaaaaaataaataggaaatgtggtttgtattagagtatagaattgattaagatcggtttagatcatcaatatcggtttaatgtctgtgaaccagaaccctctcattgtataagaggcttca

SEQ ID NO: 4358 - DNA, 1315 bp, Artificial Sequence
  P2176 (35S::G2382)
ccctccaagatattcctctattaggtgcaaaaatcaggtaaatctctatctgtccgatttgaaaccctagatctgcctttcttctctcttcttttgcttttctgggttttgctcaaagatgggtgacagcgaagatgaaacaggatacccaaaaaagttttactctttgaatcggcaaaaccatccaatgtatagtagaccaatacctaagcgtcacgcgtattacaatgaagaagaagacgaagatgaagtcgaaggagaagaggaagatccacaaggaggatacattcgtggaaatgagaggtttcagaagagacagaaaccaaacaaagtagtttctgggtttgaatttgctggtcctagtgatgctaaagttgcgtatgattggagagagcaagaagcttttgtgttgcttgaagtttggggagataggtttttgcaattgggtagaaggagtttgaggaacgaggattggaatgaagtagctgagaaagtgagtgaggagctaaggatggagaaatctgagacgcaatgtaggagaatgattgatgacttgaagaggaagtatagaaaagagaagattaaggttgagaaatcaggtttaggttcaagtaaatggtcgtttttcaataagttggatatgttgctttgtgtttcgcccaagtcggatttaggtttagcttgtggtgttgattcaggtgagtttgtgtttatgaacactaaggtttatttagataagtctaatgggtttgatgagatgatggatagtcctggtgattctgaagaggaggaggatgaggatgatgaggttgagtacgagaggaagaaggttaatgacgctgcttcgtataagatgttggcggattctgttgagaggtttgggaaggtttatgagaagatggagaagagtaagaaagagcaaatgaaggagttggagaagatgagagctgattttcagagagatttggagttgcagaagaagcagattgttgatagagctcagagtgagattgctaggttacgtgaagaggaggagaatcatcatggtggtggtgatgatgatgagagtgaagatgaagaaatggagaatgattctgatgttaatctcagtgatgagtaagttataaactatgtaggtttgtgttgtttgtagatgcaacaaaatatgttctgtttttttttttggttttagggaattcagaacttaagtcttataagttttgtaatttgtgtttggtctttgcaactttagtcgaggttatttgcagtttatcttgaaacttaaattaatgcataaacatatttccttcttaaa

SEQ ID NO: 4359 - DNA, 891 bp, Artificial Sequence
  P2360 (35S::G1995)
cgcccagtctttttatctctctgactctctctctatggacgaggctaccggagaaacagaaactcaagatttcatgaacgtcgaatccttctctcagcttcctttcattcgccgtcctaaagataagaaccctaaacccattcgtgtcttcggaaaagatttcaccggcagagatttctctattactaccggtcaagaagactacaccgatccttaccagaccaaaaacaaagaagaagaagaggaagaagaccaaaccggagacaacagtacggacaataatagcatcagccacaacaggagattcgagtgtcactattgctttagaaattttcctacttcacaagccctaggtggacaccaaaacgctcacaaacacgaacgtcagcttgccaaacgcggtgtttcctcttacttttatcatcctgacaataacccttacagttaccgtcattacccgtcgtggaccaatggtccgttaaccgcggctaggtcctatggaggattttcttctggtcctaagccgtcggggtattatacacgacccagctatgggagtcagttaggactatggcgtctaccgcctcgcgttcaaggcgtttataactcaaacgcagcgtttactagtaatggctcttcttcttcttctaattcgactttaccgttgttgacccgttctcaaactcaactatcatcgcaagtgggtggctccgctgctcagaacagaatgtcatcgtacggttacggattgagccctaacgtgcaagatcatgtgagtctcgatcttcatctttaaagatttgaaaacaaaataaaactcttattgagtgttatgtaacttagtgcaagaaaaaacaacctaagttattgaatattacgtaatctttaacg

SEQ ID NO: 4360 - DNA, 1314 bp, Artificial Sequence
  P2368 (35S::G2969)
ctccaatggtaaaatctctcattcactaactttctctgcttctctctatctttctctgtgcataccaactctaaagtctctcatcaatggcggctcgaaaactagggtcgttgttacgtcaatactttttctctctatgcttcctcttcctcggttgcttcttcttccctaaagacgcagactataaacaaaagagaagaaagaagaagcttagaagagtttcttcttcttctggttcatctctatcctcttcttggacgtatttaaaacgagttttcttatccacgacaaggatatccaaatcccgtaaccaaacacatcctaacgttactttaacatccgcaagatcatctcaaaactccctcgtcactctcgtccaacccgataccacaaaccaacccgacccggaaacacgtattcatcagcaaaccgaattcgagatctcctcttccgacgagattttcccttgtaactcgtgtggcgagattttcccaaaaatcaatctcctcgagaatcacatcgcgatcaaacacgccgtgtcggagctaatcgccggagaatcaagcacgaacatcgtcaagatcatattcaaatctggttggccggagcaaggtaattacaaatctccggtgatcaatcgaatcttaaaaatccacaacagttcaaagattctcaccagattcgaagagtatcgtgagttcgtgaaagctaaagccgctcggagcaacggcggtggaagacggtgggacgatgaacgttgcgtcgccgacggaaacgaacttttacgattttactgctcgacgtttatgtgtgatttagggcaaaacggtaaatcaaatctctgtggtcatcagtattgtagtatctgtggtatcatcggatctggattctcgccgaagctcgacgggatcgcgacgttggcgacggggtggagaggacacgtggcggttccggaggaggttgaagaagagtttgggtttatgaatgtgaaacgggccatgttggtttgtcgggttgtagcgggtcgggtcgggtgtgatttgattgatgatgatgacgtggataagagtgatggtggagggtatgattctctggttgggcagagtgggaacaagagtggggctctgttgaggatcgacgatgatgagcttttggtttttaatccaagggctgtgcttccttgttttgttattgtgtatactgtgtaaccggatttgtgatcctgtgtgtttttgtttatattttgttacaattgtgaagtgtgaaacgctttaggtttgtttggaaaatggaaaaatctttgtggtgagtaaa

SEQ ID NO: 4361 - DNA, 820 bp, Artificial Sequence
  P2373 (35S::G652)
tcgtcggagagattttgatcagaatgagcggaggaggagacgtgaacatgagtggtggagacagacgcaagggaacggtgaagtggtttgatacacagaaggggtttggtttcatcacacctagcgacggtggtgacgatctcttcgttcaccagtcttccatcagatctgaaggatttcgtagcctcgcagctgaggaatctgttgagttcgacgttgaggttgacaactccggccgtcccaaggctattgaagtgtctggacccgacggtgctcccgttcagggtaacagcggtggtggtggttcatctggtggacgcggtggttttggcggcggtggtggaagaggagggggacgtggtggaggaagctacggaggaggttatggtggaagaggaagcggtggccgtggaggaggtggtggtgataattcttgctttaagtgcggtgaaccaggtcacatggcgagagaatgctctcaaggtggtggaggatacagcggaggcgggggtggtggaaggtacgggtctggcggcggcggaggaggaggtggtggtggcttaagctgctacagctgtggagagtctgggcactttgcaagggattgcactagcggtggtgctcgttgaagcaaaccagactgtgaagaaggggtaaatcagtcatcgatccctcttctccgtgacttctatcaaattattatctatcttttgttattcgactctcttcaatgttgttttcggaatttattaattaggacttgtggttgttatggttatggttccttgtgatttgagaaagaaactggattggttttaaa

SEQ ID NO: 4362 - DNA, 1646 bp, Artificial Sequence; identical to SEQ ID NO: 985
  P2377 (35S::G1446)

SEQ ID NO: 4363 - DNA, 966 bp, Artificial Sequence; identical to SEQ ID NO: 297
  misc_feature (915)..(915): n is a, c, g, or t
  P2379 (35S::G359)

SEQ ID NO: 4364 - DNA, 1846 bp, Artificial Sequence
  P2381 (35S::G2633)
ctccgacaactttctctcttcccttctctcttcctctggttcacatggaacttcaataacattcactactttaaggtttctcatctccgaaaaagtcaggtcttaaatcatcctcttcttttgatcctgttggaaaattctttgatttggtggttatgttgcttagataacctaaaaagttattgtgcagatcattgaagtgactagaaatgtacaagcagcctagacaagagcttgaggcttattattttgagcctaactctgttgagaagcttaggtacttaccggttaacaactctcgtaaacggttttgtacgctcgagccatttcctgactctcctccttataatgctctatctactgctacatatgatgatacatgtggctcttgtgtaacggatgagttgaatgacttcaaacacaagattagggaaatcgaaacggtgatgatggggccggactcgttggacttacttgtcgattgcacggactcatttgattccacggcgagtcaagagattaatggttggagatcaactctagaggctatctcgaggcgggatttaagagctgatcttgtttcatgtgccaaagctatgtcggaaaatgatcttatgatggctcattcaatgatggagaagttgcggcagatggtttcggtttctggtgagcctattcaacggttgggagcttacttattggaaggtctagtggcgcagctagcttcgtcgggcagttctatatacaaagcacttaataggtgtcctgaaccggctagcacagagcttctctcttacatgcacattctctatgaggtttgtccttacttcaagtttggatacatgtcagcaaatggtgctattgctgaggcaatgaaggaagaaaacagagttcacattattgatttccaaatcggtcaagggagtcaatgggtcactcttatccaggcttttgcagctaggcctggtgggcctccgcggattcggataacgggtatcgatgatatgacttcagcgtatgctcgtggaggtggcctaagcattgttggaaatagactcgctaagcttgctaagcagttcaacgttccattcgagtttaactcggtatcggtgtcagtttccgaggttaaacctaaaaacctcggggttcgacctggggaagctctagccgtaaactttgcctttgtgcttcatcatatgccagacgaaagcgtgagcaccgagaatcaccgcgaccggttattgagaatggtgaagagcttatctcccaaggtggtgactcttgtggaacaagagtcaaacacaaacacagccgctttcttcccgaggttcatggagacaatgaactactatgccgcgatgtttgagtcaattgatgtgactctaccaagagatcacaaacagaggattaatgtggagcaacattgtctagcaagagatgtcgtgaacatcatcgcatgtgaaggagctgatcgggtggagcgacacgagctcctaggaaaatggaggtcacggtttgggatggcgggtttcactccttacccgttgagtcccttggtgaattcaaccattaaaagtctgcttaggaactactcagacaagtacaggctagaagaaagagatggagctttgtatcttggttggatgcatcgagatttggttgcctcgtgtgcttggaaatgagacagtgacatttctctagtgtgatggcaattaatgtgtttctacttgtatgcaatttagtcgctcatttgaatcttcaaaacatttgaagaatcttatgtttactactagagaccaagagtgtgcacaattgctcaaatgtcaaagtcaactctttcctcaaa

SEQ ID NO: 4365 - DNA, 1456 bp, Artificial Sequence; identical to SEQ ID NO: 1661
  P2384 (35S::G2741)

SEQ ID NO: 4366 - DNA, 958 bp, Artificial Sequence; identical to SEQ ID NO: 1413
  P2386 (35S::G2146)

SEQ ID NO: 4367 - DNA, 1025 bp, Artificial Sequence; identical to SEQ ID NO: 1671
  P2387 (35S::G2763)

SEQ ID NO: 4368 - DNA, 991 bp, Artificial Sequence
  P2388 (35S::G3054)
ttcttcatctactctttctctctctatctctttccacttcctcttgcttttactcctgggttagggtttagggtttcttggtcgacgtgatgagtcatcggcgagattacggcagtgatgcagttcacgtgagaatcacccacgaccctccgcctgagaattgttttccaaattccggcgacagttccgtctgggccactgaggatgattacagccgtgtctgggccataaactctgatggcgcagagtctccgagcaagaagacacgatcttcctcctcctccgagatcgggaaatcgttcttcaagacgaagctttgcttcaaattccgcgccggaacttgtccctactccgcgagctcttgccactttgctcacagcgcggaggagctccgtcttcctccgccgccgccgcccaattggcaggagacggtgacagaggcttcaagaaacagagaaagctttgcggttagtttaggccctcgtggcaatgttgctcagactctcaagtctccgaattggaagacaaggatttgcaataagtggcagactactggctattgtccttttggttctcactgccattttgctcatggaccttcagagttgcatacatttggcggaggactcgttgaaggagaatgtaagatcggaacatccgccactttggacacaaagcagagaggacaagtagacacagtgactagccttgtttctcctggagtctcatcccaacggacatctagtgctgttacgcagaaacccaacggagtcagaactcaacggaaatggaaaggaccagataaaatcagtcgtgtttatggtgattggatcgacgatattgagtaaagtcactgcattttcactgatttgttgatcaaggtatagcttcttttagacttgtaactgtgtggacatattagcttcctcccttctgtggttgtagattgtgactcactcaacaaagacaaaaactctcatctttttgtttt

SEQ ID NO: 4369 - DNA, 1249 bp, Artificial Sequence
  P2390 (35S::G2743)
ctaactttatagttaaagttatcaattattcgaaaacaaagctggttttttgttttgtcccttaaaccagcatgatcaagaacttaagtaatatgaagaatgacaatcagaaacgtgaaaaatgttgcgagtacatcgaagctctcgaagaagaacgtcgcaagatcaatgttttccaacgcgagcttcctctttgcgtagagctcgtgactcaagcgattgaggcgtataagagggagatatcagggacgtcgacggataacttatacggacagtcggagtgctcagagcagaccaccggagaatgtgggcgcatcttggatctgttcataccaatcaaacactcttcgacctccatagaagaagaggttgatgacaaagatgatgatgatgaagaacaccagtctcatgaaaccgacatagattttgatgacaagaacatgaaatctgaatggctcaagtctgttcagctctggaaccaatccgacgcagttgtttctaataatagacaggatcgctcacaagaaaagacagagacgctggtagagttgataaaaataaacgatgaagcagcgaagaaaaacaacaacataaaatcaccggtgactactagcgatggtggcagtggcggtggcggtggcagaagagggcagagaaagaataggcggtgttggtcgcaagagttacacagacgcttcttgaacgctcttaaacaacttggtggccctcatgtagctacgccgaaacagataagagatataatgaaggttgatgggttaacaaatgatgaagtcaaaagtcatttacagaaatataggctgcatgcaagacggccaagccaaacaacaccgaacaacagaaactctcaaacgcaacatttcgtggtggttggtggaatatgggtcccacagactaaccattcaacggccaacgcagtcaacgccgtcgcatcgggtgagaccaccgggatttatgggcctatggtcagttcgttgccgtccgagtggccgaggcattccaattttggtaggaagatttcggaagatagatcaagatgctctaacaacggattttttcggtgtagctcaccagctatgtcttgttctactcgtacaaagacgaaagatgcaaaaataatatcataaatttaatttttgattatttattaagagaaaaaagttatagacattaatattgtgaagagtgtatatatatagatgttggagcgtgcctctatgttatttttaaa

SEQ ID NO: 4370 - DNA, 961 bp, Artificial Sequence
  P2391 (35S::G3067)
gaaaagaaaaaaacacaaaacctggtgttttttctctcgtcgtcgtttggtcgtgtcctaagacaagaaccggcgaacgaagaacaaactttttgaatctaacatccgaaagaaagagagaaaatgtcgtttacaggaacattggataaatgcaaggcctgtgacaaaaccgtgtacgtgatggatttgttaacattagagggtaatacttatcacaaatcatgtttcagatgcacccattgcaaaggcactctcgtgataagcaattactcatcaatggatggagttctttactgtaagccacacttcgaacagcttttcaaagaatctggcaattacagcaagaattttcaggcaggaaagaccgagaagcccaatgatcatctgactcgaactccaagcaagttatcatcattcttcagtggaacacaagacaaatgtgcgacttgtaagaagacggtttacccacttgagaaagtaacaatggaaggagaaagttaccacaagacttgcttcaggtgcacacacagtggttgtcctttgactcactcttcttacgcttctcttaatggcgtcctctactgtaaagtccacttcaatcagctctttctcgagaaaggcagttacaatcacgtccatcaagccgctgctaaccaccgtcgatccgcctcttctggtggcgcttctcctccttctgatgatcacaaacctgacgacaccgcctcaattcccgaagcaaaagaagatgacgctgcccctgaagctgcaggagaagaggagcctgagccggtcgttgagtcttgaaaatgtcgtggaggaatgatcttatcagttctcaagtttgaagtttttatatgcgtttctgtttaatgaatatataaatacaaattgttgttgtttcttcttgtaaattcttgtaaagttttaaagctctttttggagagaatctgttgtaaacaaa

SEQ ID NO: 4371 - DNA, 900 bp, Artificial Sequence
  P2392 (35S::G2933)
aaaaaacagaatcaataaccttgtccttgattaagcaaaaaatgtgtgcattagtcccttcatttttcacaaacttcggttggccgtcaacgaatcaatacgaaagctattacggtgccggagataacctaaataacggcacatttcttgaattgacggtaccacagacttatgaagtgactcatcatcagaatagcttgggagtatctgtttcgtcagaaggaaatgagatagacaacaatccggttgtggtcaagaagcttaatcacaatgctagtgaacgtgaccgacgcaagaagatcaacactttgttctcatctctccgttcatgtcttccagcttctgatcaatcgaagaagctaagtattcctgaaacggtttcaaagagcttaaagtacataccagagctgcaacagcaagtgaagaggctaatacaaaagaaggaagaaattttggtacgagtatcgggtcaaagagactttgagctttacgataagcagcaaccaaaggcggtcgcgagttatctctcaacggtttctgccactaggcttggtgacaacgaagtgatggtccaagtctcatcgtccaagattcataacttttcgatatcaaatgtgttgggtgggatagaagaagatgggtttgttcttgtggatgtttcatcatcaagatctcaaggagagaggctcttctacactttgcatcttcaagtggagaatatggatgattacaagattaattgcgaagaattaagtgaaaggatgttgtacttgtacgagaaatgtgaaaactcgtttaactaggtgactaattcatataatggtgtgtttatccactagttctcatttctttttagctgtgtccttttctcatatgaatctaacactgatctggaccaaa

SEQ ID NO: 4372 - DNA, 1128 bp, Artificial Sequence; identical to SEQ ID NO: 1695
  P2395 (35S::G2790)

SEQ ID NO: 4373 - DNA, 1035 bp, Artificial Sequence
  P2396 (35S::G370)
caaactcactctccctgatctctctcttccatggacgaaaccaacggacgaagagaaactcacgatttcatgaacgtcaacgttgaatccttctctcagcttcctttcatccgccgtactcctcccaaagaaaaagccgccattattcgtctcttcggccaagagctcgtcggtgataactccgacaacttatccgcagaaccttctgatcatcaaaccactaccaagaacgatgagagctctgagaatatcaaggacaaagacaaagaaaaagataaggacaaagacaaagataacaacaacaacaggagattcgagtgtcactactgcttcagaaacttcccaacttctcaagccctaggtggacatcaaaacgctcacaaacgtgaacgtcaacacgccaaacgcggttccatgacatcataccttcatcatcatcagcctcatgaccctcaccacatctacggcttcctcaacaaccaccaccaccgtcactatccgtcttggacgacggaagctagatcatactacggcggagggggacatcaaacgccgtcgtactactcaaggaatactcttgctcctccttcttctaacccaccgacaatcaacggaagtcctttaggtttgtggcgtgtaccgccttccacgtcaacaaatactattcaaggcgtttactcatcttcaccagcttcagcgtttaggtcgcatgagcaagagactaataaggagcctaataactggccgtacagattgatgaaacccaatgtgcaagatcatgtgagtctcgatcttcatctctgacttcttttattttatttttttatcatccatcattgctgtgatatatgagactcgctgatcggtgaagccaattcttttgagagtgttggagactgaaaaaaagaaaaagaaaacgagaaccggtttggtgtgtagatcatcttgaacctttttgaggttttcacattctgagtttatattaataaagggaataatattttggttaattagtaaaattcgttcatccgttta

SEQ ID NO: 4374 - DNA, 1501 bp, Artificial Sequence
  P2401 (35S::G1983)
aaaaccaaaacacatcacaaacaaaaaaaacaagttagatattatatcatcatggatgtcgtttgtacggaacatcaaatgaggaagccaacggtggagattcctccgagaaagcttcttttatcttccaagagttttccttctgattcttcttcccctcgctcgccgcgtaaacataactggaacaaaagcaacaagattacatctgaacatgaagaagacaacgaagacaacaacagagagaataaagagtactgttatgattctgactctgatgatccttacgcaagtgatcatttccggatgttcgaattcaagatccgtcgttgcactcgtagccgaagccacgattggactgattgtccttttgctcatcccggtgagaaagctcgccgtcgtgaccctcgtcgctttcaatactccggtgaggtttgtcccgagtttcgtcgtggtggtgattgtagccgtggagatgattgtgagtttgctcatggagtcttcgagtgttggctccatcctattcgttaccgtactgaagcttgtaaagacggtaaacactgtaaaaggaaagtctgtttctttgctcattcgccacgtcagcttagggttcttcctccggagaacgtttccggtgtctcagcgtcgccttctcctgcggcgaagaatccatgttgcttgttttgtagcagctctcccacgagcactcttttgggtaatttgtctcatctttctcgatctccgtctctgtctccacctatgtctccggctaataaagccgctgctttttcacggttgaggaaccgcgccgcttctgccgtttccgccgctgcagccgctggttcaatgaactataaagacgttttgagcgagcttgtgaattctttggattccatgagcttagcggaagcgctgcaggcgagttcctcgtcgcccgttacaactccggtttccgctgcggctgccgcgtttgcgtcgtcctgcggtctgagcaatcagcgtctccatctccagcaacaacaaccaagtagccctttgcaatttgctctttcgccttccactccaagttacctaactaactcacctcaggcgaacttcttcagtgatgatttcactcctcgccggagacagatgaacgatttcacggcgatgacggccgttagggagaatactaacattgaggatggttcttgtggtgaccctgatctaggatgggtcaatgatctcttgacttgagggattgacggtggagattcgccgggaggagatctgacttgagaatgtaaatttcggtggaagaattttaatcacattcatgaatcatgggagaataatcggttcgtaacggtttggtcaatgcatggagagattgtttgttcaaatttattttgaagatttttttttttagctaattcagaagtgtcttgtgtattgtcgtttattttttagaattttctttttctgatgggatttttaccaaataatatgttgaacttgtaataaa

SEQ ID NO: 4375 - DNA, 1547 bp, Artificial Sequence
  P2402 (35S::G1276)
ttttgttgttgttgtgaaagctcagagttttgtttgcttttttgttgacttttttgagattgatgctggatctcaatctcgacgtcgactcgaccgagtctactcagaacgaacgagattcgattactgttaaaggggtttctttgaatcagatggatgaatcggtgacgtcgaactcttctgttgttaatgctgaagcttctagctgtatagatggtgaagatgagttgtgctctacacgaacggtcaagtttcaatttgagatactgaaaggaggaggagaagaagaagaagaagatgatgatgaaagaagtgctgtgatgatgactaaggagttttttcctgttgctaaaggcatgaactttatggattcgagcgctcaaagttcaaggagcaccgttgatatttccttccagagggggaaacaaggtggagactttataggtagcgggagcggtggtggcgatgcttcacgggtgatgcagccaccatcacagccggtgaagaaaagcaggagaggtcctaggtctaagagttctcagtatagaggcgtcactttctatcggaggacaggcagatgggaatcgcatatctgggattgcggtaaacaagtttatttaggtggatttgatactgcccatgctgcagctagggcgtatgatcgagctgctgtcaaattccggggtctggaagctgacatcaatttcgttattggcgattatgaagaggatctcaagcagatggcgaatctttccaaagaggaagttgtgcaagtacttcggcgacagagctctggtttctcaaggaataattctagatatcaaggagttgctttgcaaaagattggcgggtggggagctcaaatggagcagcttcatggaaacatgggttgtgacaaggcagccgtacaatggaagggaagggaagctgcttccttaattgagcctcatgcatcccgaatgattcccgaggcagctaatgttaagctcgacctcaacttgggaatctctctttcactaggagatggtccgaagcaaaaagatagggccctccggcttcaccatgtccctaacaattccgtatgtggaaggaacaccatgatggagaaccacatggctgcagcggcatgtgatacgcctttcaatttcttgaagaggggttcagaccatcttaataaccggcatgcccttccttctgcgttcttttcacccatggaaagaacaccagagaaagggcttatgttacgttctcatcaaagcttcccagccaggacatggcaagggcatgatcagtccagtggtgggaccgccgtagcagctacagcaccgccactgttttcaaatgcagcatcatcaggattctcactctcagctacacgccctccttcatccacagctattcatcatccttctcagcccttcgtcaatctgaatcagcccggtctctatgttatccacccatctgattacatatctcagcaccaacacaatctcatgaaccgcccacaaccaccaccatagcttcctccttcctccgcataactcaag

SEQ ID NO: 4376 - DNA, 1011 bp, Artificial Sequence
  P2408 (35S::G2691)
gttcgctgaaacagagaaatctttttcctgaaaaaaacctcatccgatttagcagtttttgatcagagatttttgagtggggtttttttggtgtgttcttggtgtgtttgagaagatatgaagtcctttgtgaaacctgagagagactctttgttgagaacagttcgtattgttttcactgatcctgatgctactgatgattcctcttcctctagcgatgaatggttacctaaacctcgaaaggtaaagcgttttgttcatgagattactttcctccctcaggtctccgagagttctcaggatcgtagcaatgctgtcaaaacccctagaaggaaatctactaggcagtttaagtatcctgtgggagttaggccgaggccatcaggcaaatttgctgctgagattttgaacccattcactaaaactaagaaatggttgggtacttatgaaactcctgcagaagctgagaaggcttatgttgacaagaaggttgagtatgatgcactggcttcttcaggttctgctgtttcctcatcggttgtaacagtgactagccagtgcttgcgttcccctacttctgcttctgtttcttgtgtaagtgctgatgatttgtctaaagaaaagacgtctctgaacaaagatgttgctgcgtctggtgattcaaccaccaaagaagtgttcactactttcgacttttcggatgtgaaaatacctgatctgagattcttagcagcagaagaggattctatggtttctaatgcaaatggtgcagagctagactttgattgtttccttactgactctaacattctgctggatgattactcattgctcgaaaatgatatcaacttcagcaggtttgaaaacagtcttccaagtgagctacctgactgtgatttcactgaaatggaattccagcttgatgatttcaaatttgcctatacagatcatctgacaacaccgcctctcggtttggtttaagagttgttagcttcggtttctgtttcacag

SEQ ID NO: 4377 - DNA, 988 bp, Artificial Sequence
  P2410 (35S::G172)
tttttctctgtgtctatttgtctctccgtaagaaacattatgccttcatctgattccacgatgatgaagaaaggaacaaagcgcaaaatcgaaataaagaaacgagaaaccaaagagcaacgagccgtgacttgctctaaacgccgtcaaactgttttttccaaagccgccgatctctgtcttatctccggtgctaacatcgccgtcttcgtaacctctccctccgatagttccgatgttgtctattccttctccggttactcctctgcctacgaaatcgctgattgttacctaaatcgcaagcctccacccaagattgttaacccggccggatccaaactaggattttggtgggaagaccctgatctctaccattcgtgtgatgatctctctgagttaagcattatcgaggatcgtttacagagaatgaagaagcatgtgatggcttgccttgagaaggaagaaaaatctcaacttgtttctagtttcgaccaaaaccctaatagtacttgttctctcgacgtcgaggattgtgatggatcttcttattcgcaaattgcttctacttttactccaaactctgtcaacgagtattgcagcgatcaaaccttttcttctttccatggcgatcaaaaccctaacctctcgtctccgtcttttgatcaggactgttactcctctctctatcagatctgtggagaatcatcttcacaagttgcttcttttgatcaaaaccctagctccgagatccaaggatttgaaacagaggaagagattaaccaaatcaatctactactacaagaaacacaaacagaggccaatgtcaatttggatgatgagatctgcttttggaatgatctatccaacgatgatgtgtttggtctaaacagctacttcggtctcgataacaccaatgcaatgatcaacttcggagattccgactttagacgtcatgtctgatatgatgtggttgtaatcttcagaactt

SEQ ID NO: 4378 - DNA, 874 bp, Artificial Sequence
  P2412 (35S::G2585)
taataaacccacagagcaataattataagtattactcaaaaaaacaaaaaaagatgaactcttgccaacaaaaggctatggagaagttgcttcacgggcatgggtgcgccaaccagctgctcatcatggaccagaccgagtcagactcgtccatggaaagggaggatttggccaagtccgtcctccattgtttctcagatgcgctctccatcttgatcgatactaatgaccaccaagacgatcaatccaataactcatctcctcaggactcttctcctgtgcttgagagctccaggaaaccacttcacaagaggggaagaaagacatctatggcagagagctcagactaccatagacacgaatcttcaaccccgatctaccacgacggcttcctctggaggaaatacggacaaaagcagatcaaagaatctgagtaccaaaggagttactacaagtgtgcctacaccaaggaccagaactgtgaagcaaagaagcaggttcaaaagatccaacacaatcctccattgtactcaaccacttacttcggccagcacatatgccagcttcatcaagcttatgcaactttccccattgacacatctgacttcgaagagcacgagggatcccacatgatccgattcggtcaccccaatatcagcttctcctcctccacctctaacctccgccaacatcagaatcatcaggatcgcatcaaagatgaatacatgaaaccggtgatagcagaagattggtctccatcccagtggatgtcgtccgaggttgccctcgccgtggaggctttcgagtttaatcctttctggacatctcacgacttatcatcatgacactatatccctcagctctatcatcatac

SEQ ID NO: 4379 - DNA, 2577 bp, Artificial Sequence
  P2414 (35S::G2574)
ggaaaaaaacagacaacaaaaagaaaagaaaatccaaacaagaagaagaagacgaaaatcttctgatatttctgacaatggaggttcttttgaaattaccctcttcagagtctcctcttaaggataaatttggatctgttcaaatccatgaagctaataaggtaaataccaactctatatgtgcatatacaaaattatacatgtatatggaaataatttagatcacaaaaccagaaaactgaccgttcttattctttatcggtgtgttttatgctttaacgtaattcttgtatcctgagatgtctcttccactctataatggcctctctcttttttcttattatcgtaattggtttaaaaagaaaaactcaaaactctaccatgttcattttttttatggaaacgggaagattatattagttatctatctagaaatattgaataattcgttagaattaagaatggaagtatgatgtgttagaaacttagaataaagaacatttttagatttagttgagaaattaatcaacttttttattcaatgatattaatcagggtgatggtgatcatcaagaacttgaatctgccaaggcagagatgagcgaggtgaaggaagagaacgagaagcttaaaggaatgctcgaacgaattgaaagtgattacaaatctctcaagctcagattcttcgacataattcaacaagaaccttcaaacaccgcaactaaaaatcaaaacatggttgatcatcccaagccaacgacgacggatttgagttcttttgaccaagaacgcgagcttgtatcgctttcactagggagaagaagttcttccccaagtgatagcgtccccaaaaaggaagagaaaacggacgcaatcagcgcagaagtcaacgctgacgaagagttgactaaggccggcttgaccttagggatcaataatggcaacggaggtgaaccgaaagagggtttatctatggagaatcgtgcaaattctggctcggaagaagcttgggcgccaggtaaagttacggggaagagaagctctccagcaccagcctccggtggcgatgctgacggtgaggccggtcaacaaaaccatgttaagagagctagagtttgtgttagagcaagatgtgacacaccaacggtacgtcctttaaattatacattaaataagttgatctataacgttaattaaaagatttgattatttatatgtgactaatgttgattcggacatgtttattaattatgttgtatagatgaatgatggttgtcaatggagaaaatatggacaaaagattgcgaaaggaaatccatgtccacgagcatattatcgctgcacggttgcacctggatgtcccgttagaaaacaggtatatttcgtattctatatagtctatttaagaatggaataaaaaatcggtttgaatttttcgtctggttttattttcatttccgtttgagttggatctgattttagttgttaaaatgtatcattcaatttaaactgaacaacataatttaagataaaaatgtatcattcagtttattttattttttgcgtttgcctttgcgtttccatggtattatagaaagtaagaaacatttgtgaccagtgtacaaataaaaagaaacgatctaactatttgtcctcgattatgtatgttttaggtccaaagatgtgcagatgacatgtctatactaatcacaacctatgaaggaacacacagccactctcttccactctcagccaccaccatggcttccaccacatcagccgctgcctccatgctcctctctggctcctcctcctcaccagccgctgaaatgatcggaaataacctctacgacaattcaagattcaacaacaacaacaaatccttctattcacccacccttcactccccattacatcccaccgtcactctagacctcactgctccacaacactcttcctcgtcttcttcttcattgctttctttaaatttcaacaaattctcgaactctttccaaagattcccatctacaagcctaaatttctcttctacttcatcaacatcatcaaacccgtctactctcaacctacccgcgatttggggtaatgggtattcttcttatactccatatccttacaacaacgtccaatttgggacgtccaacctaggaaaaacagtccaaaatagccagtccttaaccgaaaccctaacaaaagcgcttacttccgacccaagtttccactcggtgatcgctgctgccatctcaactatggtcggatcaaatggagaacaacagattgtcggtccacggcattcgattagcaataacattcaacaaaccaacacgacgaataataacaaaggatgtggaggctattttagcagcttattgatgtctaacattatggcgagtaatcaaacgggtgcttctttggatcaaccatcgtcgcaacttcctcccttctctatgttcaagaattcttcttcttcgtcttctacgactaatttcgtgaacaaggaagagaaaagctagtcattgttcttgttttttgttttttgggtgattttttattaggtgt

SEQ ID NO: 4380 - DNA, 1291 bp, Artificial Sequence
  P2416 (35S::G1013)
agtaaatagaaattcaacacacgttactcttaaaagttaaaagaataaagaatccctctctccctctccccctctccccctcaccaccagctcgcataagttttcttgtccccatactcatatggaagaagaaggttatcagtgggcaagaaggtgtggaaacaacgccgttgaagatccttttgtttatgagccacctcttttctttctgcctcaagaccaacatcatatgcatgggctcatgccaaatgaagatttcattgccaacaagttcgtcacatcaacactttactccggtccacgaatccaagatattgcaaacgctctggccttggtcgaacccctgacccacccagtccgagaaatctctaaatcaacgtaagtaattgatatttatttttttaattacaagaatacatctctttgccttatgtttagtatagccctttaataataagtactcatgagttcctttatatttatgtatagagttcctcttttggaaagaagtactttgagcaaggtggataggtacactttaaaggtgaagaacaatagtaatggaatgtgtgatgatggatacaaatggagaaaatatggccaaaaatcaatcaaaaatagccctaacccaaggtacatatatgcattctccgttttagaattgtatatgcatatcgaacttctttggttcggccaaaatgatacgtattaaaatcaacatatggaagttttatttagtatacttagttttcggtcacaagcctaatgttactatatttgtgatatatgtctaggagttattacaagtgcacaaacccaatatgcaatgcaaagaagcaagtggagagatcaattgatgagtctaacacatatatcattacctacgaaggtttccacttccactatacttaccctttcttcctacccgataagacacgtcaatggcccaataaaaaaacgaaaatacataaacataatgctcaagatatgaacaaaaaatctcaaacccaagaagagagcaaagaagcacaattaggtgagctcaccaaccaaaatcatccagtcaataaagcccaagaaaacacaccggcaaatctcgaagagggattgttttttccggttgatcagtgtcggccgcaacaagggcttctagaagatgtggtagctccggcaatgaaaaatattcctaccagggacagtgttttgacagcttcttgataaataaaaaattatttgaaaatattaaaaaaatataaaattaaacttctttatcataaccggagaaagtttt

SEQ ID NO: 4381 - DNA, 1414 bp, Artificial Sequence
  P2418 (35S::G2109)
gtattggttttgaacaggggatgggaagggttaagttgaagattaaaagacttgagagcacaagcaacaggcaagttacatacacgaagagaaaaaatgggattttgaagaaagccaaagagttatcgattttgtgtgatattgatattgtccttcttatgttttcccctaccggaagagctactgctttccatggagaacacagttgcattgaagaggttatttccaagtttgcgcaattaactccacaagaaaggacaaaaaggaaactggagagccttgaagcattgaagaaaacttttaagaaactggatcatgatgtaaatatacatgactttttaggagcaaggaatcaaactattgagggtctaagtaaccaagtagccatttaccaagctcagctaatggagtgtcataggaggttgagttgttggacgaacatcgatagaatagaaaacactgagcacctcgatttattggaagaatcattgaggaaatccattgaaagaatccagattcacaaggaacattacagaaagaaccaactcttgccaatagaatgtgcaacaacacagtttcacagcgggatacagttgcctatggcgatgggaggtaatagtagtatgcaagaagctcactccatgtcttggcttcctgataatgatcaccagcaaacaatcttacctggtgattccagttttcttccccatagagagatggatggttcgattcccgtttactcaagctgcttctttgagtctacgaaaccagaagatcagatatgcagcaacccgggacaacagtttgagcagttagaacaacaaggaaacggttgtttggggttacaacaacttggagaggaatattcatatcctacaccgtttggtactactttgggaatggaagaagatcaagagaaaaagataaaatctgaaatggaattgaacaacttgcaacaacagcaacagcaacaacaacaacaacaacaacaagatccttcaatgtatgatcccatggctaataataatggtggctgctttcagattcctcatgatcagtccatgtttgtcaatgatcatcatcatcatcatcaccaccatcatcaaaattgggttccagattcaatgtttggtcagacttcttacaaccagcaaccgaactaactcaagacatggctcatgtatgtatgatgactggacttatgtctgaccaaggactagtttgagccattgcctacaatgtctaagataaatatatatatgtagacagcgagagagtgtgtgtacatgtttttgtatgtgtgagcttgtgtcatatactcaggggagttttaggcatttgtgtataagagatgttgtctaggaaccgtatattacctttaacaagaatgataagtatatccaatatattaatg

SEQ ID NO: 4382 - DNA, 860 bp, Artificial Sequence
  P2419 (35S::G1932)
aaacgagccaacaaagcaaaacctctttcttctcttctccactttctctctagattctctcatatttcccctcttgagagtctaacaatggcgtcaacgacgtgtgcaagagaggtgcattacagaggagtcagaaagagaccttggggtcgctacgctgctgagatacgagatccttggaagaaaactagggtttggttaggcactttcgacactcccgaagaagctgctcttgcttacgacggcgctgctcgtttcctccgtggtatcaaagccaaaactaacttcccttctcctctctctctcgacctcaaccacctcccttccgctccctcagccgcaaccgccgccgcaaataaccaaccccaccaacaccaacagctctggttcgctgcgcctcctcctgttcctccaagctccgaccatcatcaccaacaccaccgcatttttctccgaaccggtgtgctaaacgacaaaacttcagattactcttctacagaagcgccgctttacttcacctcctcgcctaacacagccacgtcatcgcctggttatcaagtggttgggtttccgatgatgaattcttctccttcccctgttacggtgagacgtggcttagccattgacctcaacgagcctccgccgctttggctttgaaaacaaacgataaagatggatatagcggcgccgttttgcctacttttctatacggcgccgtttgagaccactttcggtggaactactttagtttctttttttagcaaatagtatctttttgttagagttagtagacttgtttttataatttaatccttcttttgttcgttatgtaagagtcggagatcgattgttgttgtgag

SEQ ID NO: 4383 - DNA, 1062 bp, Artificial Sequence
  P2422 (35S::G1423)
ctcaacaaaattgagaaaaatcaatcagaatggtgaaaaaaggtggcacgaagaggaagattgcgattgagacgatacagaagagagattcccttagggttacctgcaccaaacgccgtgaaggtctctatagcaaagcctctcagctttgtcttctctcagacgcacagatcgctatcttagcgactcctccttcttctgaatccaacgtatccttctactctttcggtcactcctctgttgatgccgttgtctctgcttttctctccggacaacgtcctgttccgaaggataacaaagagacgagggaggacgttggtatctgtttgactcgcaataatctagggttaggtttttggtggaacgacgagagccttgccagatcggagaatcctcaagagattagtgaagcgatcgactctatgcggacgctgttgaggaatctcaaggaattgcgtgcggatgaagctttagcctgtaatcaagctttcgttaatgatcgcgaggacctgaagaacaacgacaagtgcgattttgtttcagaccacgaaactcatgatcaaaccctaattcttcagtccgcttctccaatttgttgcatcccagaaaatctcaacgagattactcaagagccaaatcaaaccctaaatattcagtcgagtacttctgcaatttgttgcgtccctgataattcacctgaaaatttcaatgagatcactgaagaacaagatcagattcgctcgatttgtgaaactttttgtgttatggataacaacgctgctttacctgaaatgaacctggattacgatcaagacattggcttcgacacgccttttgagagcgcgctaaatgattggttttcggacaacactactcatcaggagattagtgcaagtattttgaacgctgttgttgatgatcaagtctcggtggatctaactccgttttcttattttcagagatgtttggatggagataatctacgattctctgattgtttcaaagactttgcaaacactatttcagcactttgaagataatttctctgcagttttcaaacta

SEQ ID NO: 4384 - DNA, 937 bp, Artificial Sequence
  Artificial sequence
  P2423 (35S::G2991)
caataaccaaaacccaagtttacaaaacatttcttcttcttgtttttcgaaaccctaaatgttttgagttgtcatggatgtaatagctactacaactactatagtatccgacttggattcacgacaacccgaaatcgaagctccgatccggatccagcccgcgaagcctatttctttctcaaacggcaaacgctgccaccaccatcatcttgcatctgaagcggttgcggttgcgacttataaagaatgtctaaagaatcacgcagcaggtatcggcggtcacgctttagacggatgcggcgagtttatgccgtcaccgtcgtttaactccaatgaccccgcttcactaacgtgcgctgcttgtggttgccaccgtaacttccaccgccgtgaggaggatccatcttctctctctgccatcgtccctgcgatcgaatttcgacctcacaaccgtcaccagcttcctccaccgcctcctcctcatctggcggggattcgtagtccagacgacgatgattcagcttctccaccgccgatctcgtcttcttacatgcttctcgcactctctggaggaagaggaggagctaacacggcggttccaatgtctaggaaacgttttaggacgaagtttagtcagtatcagaaggagaagatgttcgagttctcggagagagttgggtggaggatgccgaaagctgatgacgtggtggttaaggagttttgtcgggagattggagttgataaaagcgttttcaaagtgtggatgcataacaacaagatttcaggacgcagcggcgctagaagagctaacggcggagtagtagtaggaggagtaggagatagtcgtcagagtgttgttccgacaaatgggtcgttttcttcgacgtgaggaaaagaatggaaagcgttgaaaaagcgtcgtcgttttagaggctaa

SEQ ID NO: 4385 - DNA, 925 bp, Artificial Sequence
  P2424 (35S::G2996)
tgagaaacctcctctccccaaaaacgacgtagtttcacatttctcgacttcttgaatggagtttgaagacaacaacaacaacaacgacgaagagcaagaagaggatatgaatcttcatgaggaagaagaagacgacgacgccgtttacgactctcctcctctctctcgtgttctccccaaagcctcgacagaaagtcatgaaaccaccggaactacttccacaggcggtggcggaggattcatggttgttcacggcggtggagggagcaggtttaggttccgtgagtgtctcaagaaccaagcggtgaacataggaggacacgcggtcgatggttgtggtgagtttatgccagctggaatcgaaggtaccatcgacgctctaaaatgcgccgcttgtggctgtcaccgtaacttccaccgcaaggaattaccttacttccatcacgcgccgccacaacatcagcctcctcctcccccgccagggttttaccgtcttccagctccggttagctaccgaccaccaccgtcacaagctcctcctcttcagctcgctcttccccctccacaaagagagagatcagaagatccaatggagacgtcttcagctgaagcaggaggagggattaggaagaggcataggactaagtttacggctgagcaaaaggaaaggatgttagctttagctgagaggattggatggagaattcagagacaagacgatgaagtgattcagagattttgtcaggagactggtgttccgagacaagttcttaaggtttggttacataacaacaaacacactcttggtaagtcgccttcaccacttcatcatcatcaggctcctcctcctccaccaccacagtcttcgtttcatcatgaacaagaccaaccatgaatcttgaatttctttgatcactagggtttt

SEQ ID NO: 4386 - DNA, 1031 bp, Artificial Sequence
  P2425 (35S::G2989)
taagcttaacataaaccctaatattttcttgatttttttcaagaaaataaaaacataaagatgcttgaagttagatcaatggatatgactccaaaatcaccagaacccgaatccgaaactccgacccggatccaaccagctaaaccaatctctttcagtaacggaatcatcaaacgccaccaccaccaccaccacaacaacaacaaagtcacttacaaagaatgtctcaagaaccacgcggcggcgattggtggtcacgcgcttgacggttgcggcgaatttatgccgtctccttcgtcaacaccttccgatccaacttctctcaagtgtgcagcttgtggttgtcaccgtaacttccaccgccgtgaaactgacgattcctccgccgttccaccaccgtctcttcttccatcttcaacaacaaccgccgcaattgagtatcagcctcatcaccgtcatcatcctcctcctccgctagctcctccgttaccacgtagtcctaattcatcttctccgccgcctatctcttcctcctacatgcttttagctctctccggtaataataaaaccgcaccgttctcagatctaaacttcgccgccgcggctaaccatctctccgccacgcctggctcgaggaagcgattcaggacgaagtttagctcaaatcagaaagagaagatgcatgaattcgccgatcgaatcggttggaagattcagaaacgtgacgaagacgaagttcgtgatttttgccgtgagatcggagttgataaaggtgttctcaaagtttggatgcataataacaaaaactccttcaaattctccggcggaggagcaaccaccgtgcagagaaacgataacggtatcggcggcgagaacagtaacgatgatggagttcgcggtttagctaacgacggtgacggtggtggtgggagatttgagagtgatagtggaggagctgatggtggcggaaacgtaaacgcctcgtcgtcttcgtcgtgaagaagaaaacatcatgtcgttttgcagggaaa

SEQ ID NO: 4387 - DNA, 1132 bp, Artificial Sequence
  P2426 (35S::G2990)
aaagctcttaacccaaaaaccctaagtcttttttttcttcaaattattggttatattaatgttttaagctatgatggatatgactcctacaataacaacaacaacaacaccaactcctaaatcacccgaacccgaatccgaaactccgacccggatccaaccggcgaaacccatttcctttagcaacggcatcatcaaacgccaccaccaccaccaccatcctctcctctttacttacaaagaatgtctcaaaaaccacgcggcggctttaggtggtcacgctctcgacggttgcggcgaattcatgccgtctccgtcgtcaatctcctccgatccaacttctctcaaatgtgctgcttgtggctgccaccgtaatttccaccgccgtgatccagataacaacaacgactcttcccaaatccctcctcctccttccaccgccgtagagtatcaacctcaccaccgtcatcatccaccaccaccaccacctcctccaccaccacgtagtcctaactcagcttctcctccaccaatctcttcctcttacatgctcttatctctctccggtactaataacaacaacaacaacttagcttctttctccgatcttaacttctccgccggaaacaaccaccaccaccaccaccaacatactcttcacggatctcgtaaaagattccgaacaaaattcagccagtttcagaaagagaagatgcatgaattcgccgaacgtgttggttggaagatgcaaaaacgtgacgaagacgatgttcgtgatttttgccggcagatcggagttgataaaagtgttctcaaagtttggatgcataacaacaaaaacacctttaaccgccgtgatatcgccggaaacgagatccggcaaatcgataacggcggaggaaaccacactccgattctcgccggcgagattaataaccataacaatggacaccacggtgtcggaggaggaggagagcttcaccagagtgttagtagcggcggtggtggcggaggatttgatagtgatagcggcggagctaacggtggtaacgttaacggatcatcgtcgtcgtgaagttaaagatgagagtgtcaggttaataagaagcttagagtaagcttattcgtatta

SEQ ID NO: 4388 - DNA, 767 bp, Artificial Sequence
  P2427 (35S::G2992)
gctatggatttgtcttccaaaccacaacaacaacttctaaactctcttcccatcgccggagaactaactgtcaccggagaaatgggtgtttgttacaaagagtgtttgaaaaaccacgcggctaatctcggcggccatgctctcgacggttgcggcgagtttatgccgagtcccacggctacttccaccgatccttcttctctccgttgcgctgcttgtggctgccaccgtaacttccaccgccgtgacccttccgagaatctcaacttcctcaccgcgcctccgatttcttctccctccggcactgagtcgccgccgtctcgtcacgtgtcttctcctgttccttgctcttactacacctcagctcctccacatcacgtgattctctctctcagctccggtttccctggaccgtcagatcaagatccaacggtggttaggtcagagaacagttcaagaggagcaatgaggaaacgaacaagaaccaaattcacgccggagcagaagatcaagatgagagccttcgcagagaaagctggttggaaaatcaacggatgtgatgaaaagtcggtgagagagttttgtaacgaagttgggattgagagaggagttcttaaagtgtggatgcataacaacaagtactcacttctcaatggcaagatcagagagatcgaacatggcctgtgtctgaacactcacagcaatgatggtgatgggtcttacatctttcttgaagaaagattcaagattcgggttaaaccgaatta

SEQ ID NO: 4389 - DNA, 1160 bp, Artificial Sequence
  P2431 (35S::G2998)
cgtgtacttgttcatcttatctcctctgtaagtctctgattctcactgccatttagttttcttttttgccttattagtaatctcattatcatgttctttttcaggcataaacttcattgaagaaaaagtcttttttattttgttgatctcttttaattaagatccttttgggttttaatttattaatctccaagaaaaaaaatggatatgagaagccatgaaatgatagagagaagaagagaagacaatggcaacaacaatggtggtgttgttattagtaacatcattagtactaatattgatgataattgcaatggtaataacaacaacactcgtgtctcttgcaactctcaaaccctagatcaccaccaatccaagtctccctcttcgttttccatctccgccgcagctaaacccaccgtaagataccgtgagtgtctaaagaatcatgcggcgagcgtcggcggaagtgttcacgacggatgcggcgagtttatgccgagtggtgaagaaggaacaatcgaagctctcagatgcgctgcttgtgattgtcaccgtaatttccaccggaaagaaatggacggcgttggaagctcggatttgatctctcaccaccgtcatcaccactaccaccataaccaatacggtggaggaggagggagaagacctccgccgccgaatatgatgcttaacccactcatgcttcctccgccaccgaattatcagccgattcaccaccacaagtatggaatgagtcctcccggaggaggaggaatggtgacgccgatgagcgttgcttacggcggtggaggaggaggagctgagtcgtctagtgaagatctgaatctgtacggacaatcaagcggagaaggagctggtgcggcggcgggacaaatggcgttttcgatgtcgtcgtctaagaaaagattcaggacaaagttcacgacggatcagaaggagaggatgatggactttgcggagaagctagggtggaggatgaacaagcaagacgaagaagagcttaagagattctgcggcgagatcggagtgaagagacaagtcttcaaagtttggatgcataacaacaagaacaatgctaagaaaccaccaacaccaacaactactctctaatcagtgatcatatgattaattgagagatt

SEQ ID NO: 4390 - DNA, 1091 bp, Artificial Sequence
  P2434 (35S::G2994)
tccccaaaccaagaaacaatttgcaaagagaaagcaaaaggtttttgaagaagacccaattaaaaaagatggaaattgcaagtcaagaagatcatgatatgcccatcccattaaacactacatttggtggtggtggtagtcatggtcacatgatccatcatcatgatcatcatgctgctaattctgctcctccaactcacaacaacaacaatactactcaaccacctccaatgccgttacatggtaatggtcatggcaacaattatgatcatcatcatcatcaagatcctcatcatgttggttacaacgctatcatcaagaagcctatgataaagtacaaggagtgtctcaagaaccatgcagcagctatgggaggcaatgctactgatgggtgtggagagtttatgccaagtggtgaagatggctccattgaggctctcacttgctcagcttgcaattgccacaggaacttccatagaaaagaagtggaaggcgaactcgcagccaccgccatgtccccttaccaccaacaccctccacaccgaaaactcatgctcaaccaccaaaagatcagatcagctatgccacaccaaatgatcatgcccattggagtctctaactaccggtacatgcataacaactccgagtccgaggactttatggaggaagatggcgtaaccaccgcatctagatcgctaccaaacctgccatacaaccagaagaagaggttcaggacaaagttcacgccggaacagaaggagaagatgcttagttttgctgagaaagttgggtggaaaatacaaaggcaagaagattgtgttgttcaaaggttttgtgaagagattggagtgaagagaagagtgcttaaggtttggatgcacaacaacaagatccatttctccaagaagaacaacattaacctcgaagacaacgacaacgaaaagatcaacaatctcaacaatgttgatctgtccggtaataacgacatgactaagatcgtcccatgatataattaataacgttatttttatatgatctttgataattatttagttatctttatgttagctactagggttttaattttatct

SEQ ID NO: 4391 - DNA, 1236 bp, Artificial Sequence
  P2438 (35S::G2603)
aaagactcagcctttaagtatccccagaagtcgtatgaccttacgtagcttaatccttgagatgcgttcgagaccgcatcgtgtggtccacgaccttgccgccgccgcagctgccgattccacttctgtgtcatcgcaagattatcgctggtcagagattcctgaagagcttcttagggagattctgattcgtgttgaagcggcggacggtggcggatggccgtcacgacgcagcgtggtggcttgtgccggcgtttgtcgtggctggcggctacttatgaacgaaaccgtcgttatccctgagatctcttctaagttgactttccccatctctctcaagcagcctggtccaagggattcactggttcaatgctttatcaaacgtaatcgaattacgcaatcatatcatctctatctcggattaaccaactctttaacggatgatgggaagtttttgcttgctgcgtgtaagttgaagcacacaacttgtacggattacattatctctttacgttctgatgatatgtcgagaagaagccaagcttatgttggcaaagtgagatcgaacttcctaggaacgaaattcactgtctttgatggaaatctgctgccttcaacgggagccgcaaagttgagaaagagccgatcttataatcccgcaaaagtttcagcaaaagttcctcttggaagttatcctgtcgctcatatcacatatgagctgaatgtcttaggatcccggggaccaagaaagatgcaatgtcttatggacacaatacctacaagcacaatggagcctcaaggagtagcttcagaaccatcagagtttcccttactcggtactcggtcaaccttatccaggtctcagtcaaaaccattacgcagtagctcaagccacctgaaagaaacaccattagtgctgagcaacaagacaccacggtggcacgagcagctacgctgctggtgcttgaatttccatggccgtgtcacagtagcgtcagtgaagaactttcagctcgtggcagcaggagctagctgtggcagtggcacgggaatgtcaccggagaggcagagcgagcggattatattgcagtttgggaaagtcgggaaagatatgttcacgatggattatggatacccgatctcagctttccaggcttttgccatttgcttgagcagctttgagactagaatcgcttgtgaatgatttacaagactttgttaagatatcgctatatc

SEQ ID NO: 4392 - DNA, 1494 bp, Artificial Sequence
  P2443 (35S::G1660)
gcttccaagctctcttatcattcactgatttttggttctcgagaaaaaagtgaagatttttgagattctctttcgatggattacgaacgaatcggaaagacccaggttactagtagcggcggcggattttctccggggaagttaaggagtatgcttcttctaggtgttgatagaaagaagaatgaagaagaagaatcaactcctacaatgagatctgggtctaatcaaattgatgaccctagggtttatgggatagctagatcgattagtttgggtcttcaagagtattctgattatgataatgtgaatgagatcaagagtgtttctgcatcatctgtctttgagtttcaaaagactgagaaggaaaaagttaatcaaagaatgcctattagatcattctctaaaccagctccatctaaatgggatgatgctcagaaatggattgctagtcctacggctaaccgaccgaagactggacaggttcaggttccgggttcgaagaaagggcctagctttggtcgtcagtcttctatgaagattgttgaagttgctgaacatagagtggttgaagagcctgatacaaagagaatagatgtaagccaagtgaaaaaggatatgggaaacaagtttggtagctgggaagttgattcgtacactaccgtggattcatatgtcaaaccggttcttatggttgagaactctattgtagaatcagcaactgaagttaatctcagccgtcatgactcgtcagtcgcaactgcgtttgctcaaccgccttcaacggcaaggtctgtgtcaatgagagacatgggaactgaaatgactcctatagcgagccaagaaccttctagaaacgggacaccgattagggcaacaacgccaatacgaagtcctatatcttctgaaccttcaagtccaggcagacaagcatcagcttctcctatgagtaacaaggaactgtcagagaaagagcttcaaatgaaaactaggagagagataatggtgttgggtactcaacttggtaaatttaacattgctgcttgggctagcaaggaggatgaagataaagacgcatccacatcattaaagaccaaagcttctctacaaacttctaaaagtgtttctgaagctcgtgctacagcgtgggaggaagcggaaaaagctaagcacatggctaggttcagacgcgaagagatgaagattcaagcatgggagaatcatcagaaggcgaaatctgaagccgagatgaagaaaaccgaggttaaagttgagaggattaagggacgagcacaagaccggttgatgaagaaactcgctacaatcgagcgcaaagcagaggaaaagcgagcagcggctgaagcaaagaaggatcatcaggcagctaaaacagagaaacaagctgaacaaatccgaagaacaggcaaagtaccttcattgttgttctcttgctttagcttttgttcttaaatccaatcctattgtgaatgtgatgtt

SEQ ID NO: 4393 - DNA, 1049 bp, Artificial Sequence
  P2444 (35S::G2142)
aaacaataaacagtcgaaattctccggcgaagatgagaaccggaaaaggaaatcaagaggaagaagattacggagaagaagactttaactctaaacgtgaaggtccttcttccaacactactgttcatagcaacagagattcaaaggaaaatgataaagctagtgcgatacgttctaaacattcggtcactgagcaacgtagaagaagcaaaatcaatgaaagatttcagatattgagagaactaattcccaacagtgaacaaaaacgtgacactgcttcattccttttagaggtgatagattatgttcagtatttacaagagaaggtgcaaaagtatgaaggatcgtatccaggttggagtcaggaaccaacaaagttgacgccatggaggaataatcattggcgagttcaaagtttggggaaccacccagtagctataaataatggatctggtccagggataccttttcctggaaagtttgaagacaacactgtgacttcgacacctgcaattattgcagaaccgcaaatcccgattgaatctgacaaagcaagagctataaccggcatatcgattgaaagtcaacctgagttagacgacaaaggattaccaccactacaaccaattcttccaatggtacaaggcgaacaagctaatgaatgtcctgcaactagtgatgggctaggccaaagtaatgacctggttattgaaggtggaaccattagcatctctagtgcctactcgcatgagttattgagctcattaacacaagcactccagaatgcaggcattgatctgtcgcaagcaaagctttctgtgcagatcgatcttgggaagcgagccaatcaaggtctaactcatgaagagccatcaagtaagaatccattatcatatgatacgcaaggaagggattcaagcgttgaggaagaatctgaacattctcacaagcggatgaaaacactgtgacatttctctctcaggctccacggcgctggaatatataaatgtattgacagattccttgtatcgtgtacattgttcggcttc

SEQ ID NO: 4394 - DNA, 1176 bp, Artificial Sequence
  P2452 (35S::G2655)
aagtttaatttccctagagtgtctttaccttttgccttgtctccctctcgagacaaaaagagaaagagaaacactttctgtcctctttttttttcctctctttttctctctcgctggaaaccttttcatattcaagtgtaattttaatatttcaagcaattttctagctaattatggccttggaggctgtagtttacccgcaagatccgttctcctacatctcttgcaaagattttccgttttacgacttatactttcaagaagaagaagatcaagatccacaagatactaagaacaacattaagctagggcaaggacaaggacatggttttgcgagtaataattacaacggtagaaccggagattatagtgatgattataattacaacgaagaggatctccaatggccacgagaccttccttatggatctgccgtcgacaccgagagccagcctccaccgtcggatgtggcggcgggaggagggaggaggaaaaggaggaggacgaggagtagcaagaacaaagaagagatcgagaaccagaggatgactcacatcgccgttgaaagaaatcgccggaaacagatgaacgagtacctcgccgttctccggtctctcatgccaccttattatgctcaaaggggagatcaagcatcgatagtaggcggagccattaactacttaaaggagcttgagcatcatttacaatcaatggaacctccggttaagaccgccacagaagacaccggagccggccacgaccagaccaaaacaacctcggctagttcgtcgggaccattctcggatttctttgcatttcctcagtactcgaaccggcctacctctgcggcggcggctgaggggatggcggagatagaggtaacgatggtagagagccatgcgagtctgaaaatacttgcgaaaaagagaccgagacagcttcttaaactggtctcatcgatacagagcctaaggctcactcttctccatctaaacgtcacaactcgagacgactccgtcctctattccatcagcgtcaaggttgaagaagggagccaattgaatacagtagaagatattgcagcagctgtgaatcaaatcctaaggaggatcgaagaagagtcatcctttagctagtattgttgaattttagttatggcacatttagaggagctct

SEQ ID NO: 4395 - DNA, 772 bp, Artificial Sequence
  P2454 (35S::G2661)
catatcatgtaacagttataaaccacgacaatcacaatggatgatttcaatcttcgtagcgaaaaccctaattcatcatccaccacttcctcatcctcttcctctttccaccgtcacaagagcgaaaccggaaacacaaaacggtcaaggtcaacgtccacgttatcgacggaccctcagagcgtggcggctcgcgacagacggcaccgaattagcgaccgtttcaagattttacaaagcatggtccctggtggtgcgaagatggacactgtatctatgcttgacgaagccattagctacgtcaagttcttgaaggctcagatctggtatcaccaaaacatgcttctcttcataaacgaccacgaaactacatcatcttgtacttactctcccggcgctggagaatttggaccgaaactctttggttatgatgacgattatgcccctataatggacacatattcacaaggcgtgccacttacggttgcggactcgaagtatacgccgtggtttggttcggttgatgatgagcaagaacgtgactcgtcctagtcgttgccatatatgcaacattatgtgatttacatatccagaatctaccgtcttccttattctcgcaatacttagtaactatagtttaaggattatattatatgcgtctactatatatatctgagtgtatctaatttagagattgtaatatacatgagtatgagactaattaacctatagtatttgtattgacgtatggataatcacttggaaacacgaa

SEQ ID NO: 4396 - DNA, 1079 bp, Artificial Sequence
  P2456 (35S::G2776)
agaggcaacagcaatgagtatcttatccacaagatggttttctgagcaggaaatagaagaaaatagcataattcaacagtttcacatgaactcaatagtgggagaggtccaagaagctcaatacatttttccacactctttcacgaccaacaatgatccctcttatgatgatttgatcgaaatgaaaccaccaaagatccttgagacaacttacatatcaccttcttctcatcttcctccaaattcaaagccccatcatattcaccgtcattcttcctcaagaattctctctttcgaagattatggttcaaatgatatggaacacgagtactctcccacctacctaaactcaatctttagcccaaaattagaggctcaagtgcaaccacaccagaagagtgatgagtttaatcgaaaagggaccaagagggctcaaccgttttcaagaaaccaatccaatgctcaggatcacataatagccgaaagaaaacgtagagagaagcttactcaaagattcgtagctctttccgctctagttcctggccttaaaaagatggacaaggcttctgtgttgggagatgcattaaagcatataaagtatctccaagaaagagtgggagagttggaggaacagaagaaagaaagaagattggaatcaatggttcttgtgaagaagtctaagctgatcttggacgataataatcaatcattctcttcttcttgtgaagatggcttctcggacttggatcttcccgagatcgaggtaagattctcggatgaagatgttctaatcaagatcctttgcgagaagcaaaagggtcatcttgccaagattatggccgagattgagaaacttcatatcttgataactaattcaagtgtattgaattttggaccaactcttgatatcaccattatagctaagaaggagagtgatttcgacatgacactcatggatgttgtaaagagcttaaggtctgctttgtcgaatttcatatgattgtattaactttcatgcttctcgtcaatttctactgtgggagatcttgttgaacacatggacgaaacataagtggttt

SEQ ID NO: 4397 - DNA, 1352 bp, Artificial Sequence
  P2457 (35S::G2851)
aaaggtgatgaatagaggtgtgttggagagttcgccggttcagcagctgatggcagccggaaaccctaattggtggaacgtaagcggcggcatgaggccaccaccaccgttgatgggtcatcagcaggcgccgttgccaccacatatgactcctaataacaattatctccgaccacggatgatgcccactcccttcccgcacttcttgccatctccggcgacttcttcttcttcctcttcttcttcaccgtctttgcctaataaccctaatctctcttcttggcttgaaagcaatgatctccctcctgagtcttggagccttagccaacttcttttgggtggattgatgatgggagaggaagagagattggagatgatgaaccatcataatcatcatgatgaacaacaacaccatggttttcaagggaagataagattggagaattgggaagaacaagtgttaagccaccaacaagcttccatggtggctgttgacatcaaacaagagggtaacattaacaacaacaatggctatgtcatatcttccccgaactcacctcctaacaaatcttgtgttacaacaactaccacaacaagcctcaatagtaacgacgataacatcaacaacaataataatatgttggatttctctagcaatcacaatggtcttcacttgtcagaagggagacacactcctccggatcgatcctctgagtgtaacagcttagagattggtgggtctactaataagaagccaaggctccaaccttctccttcgtcacaatcaaccctcaaggtgagaaaggagaaactaggaggccgaatcgcagcgcttcatcagctagtatctccatttggaaagactgacacagcctctgtcctgtcggaagctattggatacattagattccttcagagtcaaattgaggctctgagtcatccatactttggtacgactgcctcggggaatatgaggcaccaacaacatttgcaaggagataggagttgcatatttcctgaggaccctggtcagctcgtgaacgatcagtgcatgaagagaagaggagcttcgtcgtcatctacggacaatcaaaatgcaagtgaagagcctaagaaagatctgagaagtcgaggtttatgtcttgtcccaatctcatgcacactccaagtaggcagcgacaacggcgcggactattgggctccagcacttggctccgccggtttccattgagccaatgaaattacgccacgtggaattccagcgttagagaaaaatgatataacatcacgagcagtcagtctactgagaaaacaacaaattgagtttccaaggctgattgctcatgatgcta

SEQ ID NO: 4398 - DNA, 2291 bp, Artificial Sequence
  P2461 (35S::G624)
cactatttctcctttctcagctgctttcaccattttctctttttctcctccatcaatctttctcacggttttctagggttttatatatgctttcctcttcatccatgtcatcgtcttcgttatctgctagattttgcttcaaccacgaatgttttgagttcaaactcgaccattgccgtcctggttggcgtctccgttctggcgatttcgtcgacctctgtgatcgttgcgcctctgcgtatgaacaaggaaagttttgtgacgtatttcaccaaagggcttctggatggaggtgttgtgagtcatgtggaaagcgaattcattgtggatgtattgcgtctgcttctgcttatacgttaatggatgctggaggaattgagtgtttggcttgcgcaagaaaaaagtttgctttgggacccaatttttcgccatcaccgtcctttcttttccagtctccaatttctgagaaattcaaggacttgtcgatcaactggagttcttcaactagatcaaatcagataagctaccagcctcctagttgtttagatccttcagttctgcagtttgattttcgtaatcgtggaggtaataatgaatttagtcaacctgcttctaaagaaagggtcactgcatgtaccatggagaaaaaaaggggaatgaatgacatgatagggaaattaatgagtgaaaactcgaaacattatagagtatctccttttccaaatgtcaatgtatatcacccactgatctcactaaaggagggtccatgtgggacacagcttgcgtttcctgtgccaattacaacaccaattgagaaaactggtcactctagactagatggaagtaatttatggcacacacgtaattcttctccgctaagtcgcttacacaatgacttgaatggtggagcagactcgccattcgaaagcaaaagtcgtaatgtgatggctcatcttgagacgccaggaaaatatcaggtggttccacgattttggcccaaggtttcatataaaaaccaagttctgcagaatcaatcaaaagaatctgaatccgttgtcactcctctctttgagaagatcctgagtgcaactgatactggaaagcggctggtcctgccaaagaaatatgcagaggctttcttgccccaactttcccacaccaaaggtgtgcctctcacagtacaggacccaatgggtaaagagtggagatttcagtttcgcttttggcccagcagcaaaggcagaatatatgttctagagggagtaactccattcatacagaccttgcagttgcaggctggtgatacagtcatattcagtcgattagatccagaaaggaagttaattttgggattcagaaaggcttcgattactcaatcgtctgatcagcaggctgatccggctgatatgcattcaccgtttgaagttaagaagtctgcttatataactaaagaaaccccaggagtagaatgttcctctggtaagaagaaaagcagcatgatgattacaagaagtaaacgtcaaaaagttgaaaagggagacgacaacttgctgaagctaacatgggaagaagctcaaggatttctcctgcctcctcccaacctcactccatctagagttgtgatagaggattacgagtttgaggagtatgaggaggctccaatcatcgggaagcctactgatgttgcaggtttcagatcaacgtgcactgaagttgaaggactgttgatatcaccaacaaccacaaagcacccacgacatagagatggctgtacttgcatcatttgcatacaatccccaagtgggataggtcctaaacacgaccgatgctgttcttgtgcagtctgcgacactaacaaacgccgtaggcgttccctgttgctacggagggaaaagaagcagatggagaaagaagacaatgcgcgcaagttgctcgagcaactgaattctgataatggacttcaccaatctgctaacaacagtgagaatcatgagcgtcatgcttcgcctttgaaagttcaattagatttgaacttcaaaccagaaaaggacgaagaatctctccctggttctaacaaaactaccaagagcgagactctgcctcatgatgacacagtaaagtctagcttcacgtcaccaagctcatcaagtgctcatagccaaaataacaaggaagatgaaggaaaactcaagacaaccacagaaattgcagacaccaccaccacaagctccatgtagattttgcagactcttatagctgcaaggtgaatagattatgatgggaaacaccag

SEQ ID NO: 4399 - DNA, 626 bp, Artificial Sequence
  P2466 (35S::G468)
agagctagagatatgggaagagggagaagttcatcgtcttcttcaatagagagtagcagcaagagcaacccattcggtgcttcgtcaagtactcgaaacctaagcacggacctgagactcggactcagcttcgggacatcctcagggactcaatatttcaacggtggctatgggtactccgttgcagctccggcggtagaggatgcggaatatgtggcggctgtggaggaggaagaagagaatgagtgtaacagtgtagggagcttttacgtgaaagtgaacatggaaggagttccaattggaagaaagatcgatctaatgtctcttaatggctaccgcgacttgatcagaacccttgatttcatgttcaacgcatccattctctgggctgaagaagaagacatgtgcaatgagaagagtcacgtgctaacgtacgcagataaggaaggtgactggatgatggttggagatgttccttgggagatgttcttgtctactgtgagaagactgaagatttcaagagctaattaccactactgatatataagtctacgtacttgttgtgtttaaatcgaagtaatgccaagaaaaaagtttttgcctgatgtaaatcaatggtcggatat

SEQ ID NO: 4400 - DNA, 979 bp, Artificial Sequence
  P2470 (35S::G2747)
ggtgaggaagtcaaaatcttgagagatctgagattgtaagaagatgaatcaagaagataaagagaagcctattgaagaagcttcttcatcaatggagagagaacacatgttcgacaaagtagtaacaccaagcgacgttggcaaactaaaccgactcgtgatccctaagcaacacgcagagagatacttcccattagataactccacaacaaacgacagcaacaaaggtttgcttctaaacttcgaagatcgaagtggaaactcatggaggttccgttactcttactggaacagtagtcaaagctatgtcatgactaaaggttggagccgttttgtcaaagacaagaagcttgatgctggagacatcgtttcttttcagagagattcttgtaataaagacaagctttacatcgattggaggagacgacctaagattcccgatcatcatcatcagcaattcgccggagctatgttccctaggttttacacttttcctcatcctcagatgccgacaaattacgaaactcacaacctttatcatcgatttcatcaacgagatctaggaattggatactatgtgaggtcaatggagaggagtcatccaacggctgtgattgaatctgtgccggtgatgatgcaaaggagagcacaagtggcttcaatggcttcgagaggagagaagcggttaaggctgtttggtgtagatatggagtgcggaggaggaggagggagtgtgaatagtacggaggaagagtcgtcgtcttccggtggtagtataccacgtggcagagtttctatggttggtgctggttctctcctccagttgaggttagtgagcagtgatgatgagtctttagtagcaatggaagctgcaagtcttgaggatcatcacttctttacaaagaaaggaaaaccttctttgtcttttgatttggataggtgatgattatgcatgagattaatcactatttaaaaatgc

SEQ ID NO: 4401 - DNA, 575 bp, Artificial Sequence
  Artificial sequence
  P2472 (35S::G2129)
tttgagatcattttaaattgtcctctcttttattttccggttaagcaccatgatgtctactatttccccggttttctcaaccgaaccgggtctattaacctctgtcctcccagcttttgaaaccagtttcactccatgggacatttcacacctcttctcggtcttcgattcattaatcgatccaaaaccggtttcgacccatgactatggttcagtaaaccagatcggttcagacatgtctccgaccgacaataccgacgagcggaaaaagaaacggaaattatcgaaccgggaatcggctaagcggtcaagagagaagaaacaaaagcacttggaggagatgagtatccagctaaaccaactcaaaattcagaaccaagaattgaagaaccagcttcggtacgttttataccattgtcaacgaacgaagatggaaaatgatcgtctacttatggagcaccgtatactgcatgataagttgttgaacatcagacaagttttgatgtttcgtcaaacctaacgaagctcatcaaactgtgccacttggccttgtaataacagtactgttgttacgg

SEQ ID NO: 4402 - DNA, 2214 bp, Artificial Sequence
  P2473 (35S::G1837)
ccgatttcgagagatcattcaagagggtttaatgggtatcgttgcttccaagggagatagtaatactccattgttgaatctatgtaaggagaggaaggaattgatcaaagcagctagagatgctcgttatcacttagcgagatctcatcttctttactttaaatctcttttagatttcagcaaagctcttaaacagtttcttcataaggatttggttgtgattccgtattccgatgatgattcgtctagtagtgatataatttgttctggatcagattcagactcggatacggattctgattcagattctgattctgattgtatagtctgtgatcaacctcaaacagctccgttgagcaataatgacgatcagagtcagcgaaaacccgtggttggtgatggaacttgcggtgcaagtaacaatggtcaagagggtatggagaagtcaagagaaggtttagggtttgaggggacacagttcgttagtgatccaagtgaagacgagatgaaaagttcgcaacacccttatgatatactcggtttctacaaatccgtgtataacatgcagcagtgcgaaattatcgaactggatcatagagatgatgaggttgagagtgatggatttagagaaattagggagagagaagggattcctgatttggaacctgaaagtgattataatagtctgataaggaagaataaaaagaagaataaaaagaagaagaagaagaagaatgttagagaaagctcttctgttgcaagtgaaattgataagcgagatgttgaagcgaatacttgtaatggtcaagttgcagatgagactgataattctaatgaagcttgtgcgcaagagacagaaaacactccagagattgttacggaagaagtgacgagatcagatgaggaagttgaagtagtggcaagatcagatgaggaagtttctgatgaagcgtatgagtcttcttcttcttgtttttcggaatcttctggttcgggtttgacggatctaaggaaggtagtggaaaggatcaatagtatatgcgggaaagctgcgggtaatagtgaagtctctgagttgcttgaagtaagcagagttgtttatcatcaacctttaggatctcaattcaagggatttgcttcaagagtaattggtagttccgggactacgactcgtgatttggttttaaagcgccgttttcgcttagatgatctcgctgtttcactctctatgacattagagaagctttatatgtgggaaaagaagcttcacgcagaagttacagctgaagaaaagcttagggttgcttatgaaaaagcgtacaagattctgaacaatcttgatcaaaacggagcagaatctagtgagctttacgaggcggaaactttggttaaactccatttatctaaggttaatgtttcggttcgagcggttgaatcgatttcgatgagaattcataagataagagacgaagagctttcgtttcaagtgattgagatcattaacggattcaaaacaatgtggagattcttggcgaaatgtcaccataagcagtttcgagtgattgcgagaagcaagtcttgtgttcacattgttgaaaacggatcgagctccaggaaagccacgcagcaagtcgaaaaacagattagaagatacagagaatctttgaaaggttacattgatgcacacagaggtttcgttaagcttttaaacgaatggcttaaccgaatcatcatggaggacgatgaaaccgagactgaagctcctgagatatttagggtttgcagcgagtggttaagagagattgagaatgtggatacgattaaagtgttgagtgttgttgaagaaatgagattaagatttcaagggttagggtttaagcaagtagaggaagagaaacagaggatgagaacagagagattgtctaaggagttagagaagaagacgaaggagttggaggagattcggggaacgagaggttctagtccgacgtcgaatatggttgaaccggagttgttgtttttgagagagagtgtgacgcaagaaacagaaaaacatgagagattgataagagagttaaacgacgccgtatcgatgagtttgcaagagtgtatggttcctgtctttgaggctttgggagatttttgttttgctaattttaaagcatatcagaacattgtaatcgttaccacataaactctatgattgcgtcaatc

SEQ ID NO: 4403 - DNA, 1145 bp, Artificial Sequence
  P2475 (35S::G2213)
gcaatccctatgaacattcatctttgtttttacagagactatatatgagttcgtcaaaacattcctctgtttttaactattctgctctgtttctatcactgtttcttcaacaaatggatcagaactctcttcatcatctcgattctccaaaaatcgaaaacgagtatgaaccagattcgttatacgacatgttagataagtaagttggaaaccctttgatactttttcttgctaaacaagttatctctcttttctttactgttttttctcattcgtttttggtctacaggttgcctccgcttgattctctcctagatatggaagatttgaaaccaaatgcagggttgcactttcagttccattacaatagctttgaagatttcttcgaaaacattgaagtggataacacaattccatctgatattcacttgttgacacaagagccctacttctcaagtgactcctcttcctcttcaccattggctatccaaaacgacggtctcatttccaacgtgaaagttgaaaaggtaacagttaagaagaagaggaaccttaagaaaaagaggcaagacaaattggagatgtctgagatcaaacaatttttcgataggccgatcatgaaagcggctaaagaactgaacgtgggactcactgtgttgaagaagcgatgcagggaattaggaatttaccggtggcctcaccggaagctcaagagtctaaactctcttataaagaatctcaaggtgcaacaacattaatttattaatagcatttgcttgtgattcacgagtagcgttttaggttttattatattacgttcttgatttcgaaaggttaatagtttgttcatgtttttggtgatagaatgttggaatggaagaggaagtgaagaacttggaggaacataggtttcttattgaacaagaacctgatgcagaactcagtgatggaaccaagaagctaaggcaagcttgtttcaaagccaattataagagaagaaaatcacttggtgatgattattattgatttcattttcttttagactgatgtttttttttaatcttgttgacccaattggtcaatctagattatctagggaatgtttctttaggttttcctcattgaacttgtttatcaattatttt

SEQ ID NO: 4404 - DNA, 1175 bp, Artificial Sequence
  P2480 (35S::G3083)
gggacggaggacccaaaatatgagccaagagacagcgatagcaagcttcaagaaattccaacagtcatggatcgagcagctacgaaaccacctgaaccacctccgctccgcccaaaaccatcaccggaactctgctaccggtgatgaggaacggttaagggaggctgtggacagagtgatggaacactttagagaatatcacagggccaagtgggctgcgacggataaagacgtcatcgaagttatggcttctccttgggcttcagctcttgaacggtcgcttcagtgggtcggtggttggcgaccaaccaccttgttccatctggtttacactgagtcgagtattttatttgagtctcgtatcgttgatatacttcgtggctttcgcaccggtgatctcagtgatctctccccttctcagttcaggttctacacgaacccctaattagctactttgtttactaatcacaactactagtaaagatttttttatctaatttaataaaatatccttaagttacgttgtaatttgattgaagtaatatcgtgatttgcgcgtgttattgtttaccaaaactaatacaggttcactcctacacctagagatatcaaatatgtagattagtttagaacatacgatgtttatttgtttacttttcttaccaaaaatgttttagaaagtgaaaaacacatttgagggataacaataaatttgagagattaaaacacttattttactttcttttttttcaatgtgtaaacaataacatatggactaactaaacatattttgattacttaatatttaatatttagggttccatttgtcaaaggcaggacggtaagtgagctacaatgtgagaccgtgaaggaagagaatgcgataacggaagagttgtcggagtggcaagacgatgcgagtgaccttgtcatggggacatcgtcagatcccgaccagaggatccgacggctagcagaaatcgtccaccgaactgatgatctgcgactgagaacgatcacacgtgtggtggaggtcttgagtccgctccaacaagcggagtttcttgtcgctgcggctgagcttcgtacaggcgttgctggttgggggactagccacgaccgtcgtcgaagttccgaagtttaaagctaactaaaaccggtctaaaggtaatgag

SEQ ID NO: 4405 - DNA, 524 bp, Artificial Sequence
  P2483 (35S::G2628)
ctcataatttcaatcttttagaagggactccatcgcgtaacaataatttcaactcaatgttccaacaaaacttacatgatgaagacgacgtccatgttcaagaccatgtctacaatcatgaccagtaccatcatcaacaaccgaatgttgtgacggatgaagagaagaggttaaggagaatggcgtctaatcgagaatcagcaagaagaacgcggatgcgtgagcggatgatgaaagaggggttgcaaatgcaagtaaaacaactcatggcgtacaatcaattcttgtataacaaatatattagcttgttggagtacaatcaccagatcttgcaagagaattcacagctcaaagagacagtttcatcctttcatgatcaatatactatatcttatggaaaccatgaaggtatacttggaaacaccaatgatttcgatttaaaccaactatcttcgtatcaaccatcttaactggtaagtcgaaaaatattatttttagtggaaaatggttctaatgtaattagc

SEQ ID NO: 4406 - DNA, 2837 bp, Artificial Sequence
  P2490 (35S::G2207)
ctctgacttatgttgcttcattgattttggagatatatccatggaagatagtttccttcaatctgagaacgtggttatggacgctgacttcatggatggattgttactagatggttgttggttagagactacagatggatctgagtttcttaacatagctccttcaacttcttctgttagcccttttgatccaacttccttcatgtggtctccaactcaagatacatcagctctttgcacatcaggagttgtatctcagatgtatggtcaggattgtgtagaaagatctagtcttgatgagtttcaatggaacaaacgatggtggattggaccaggaggtggtggttcttcggttactgagaggttggttcaagcagttgaacacattaaagattacacaacagcgagaggctcacttattcagttatgggttccggttaatagaggcggtaagcgagttttgaccacaaaggaacaaccttttagccatgatccgttgtgtcaaagacttgcaaactatagagagatctctgtgaattatcacttctctgctgagcaagatgattccaaggctttagctggtttgcctgggagggttttcttggggaagcttcctgaatggactcctgatgttaggtttttcaagagcgaggagtatccgagagtacaccatgctcaggactgcgatgtccgtggaacgctggcgattccggtgtttgaacaaggtagtaagatttgcttgggtgttattgaggttgtaatgaccactgagatggttaaactaagacctgagcttgaaagcatttgcagagcacttcaggtttgtgttcttctctaaagctttcagcttttgctatagaaatggttttctgagagtgatgaatgtgtttcctttttgcaggcagttgatcttaggagcaccgagcttccgattccaccttctctaaaggtaatcaaagaaactacatgagttccttatgttcagcttttgggtataaacaagattgtttcttctttattcagggatgtgacttatcctacaaagctgccttacctgaaatccgaaacctcttgagatgtgcttgtgagactcataaactacctttagctcagacatgggtttcttgtcaacagcaaaacaaaagcgggtgccgtcacaacgatgagaactacatccattgcgtatcaaccattgatgatgcttgctacgttggtgatccaacagttcgtgagttccatgaagcttgctctgagcatcacctcttgaaaggccaaggagttgcaggtcaagccttcttgaccaatggaccttgcttttcatctgatgtatctaactacaagaaatcagagtaccctctctctcaccatgctaatatgtacggtttacatggcgcggttgcaattcgcctgcggtgcatccacacgggctctgctgatttcgtcttagagttctttttgcctaaagactgcgatgatctggaggaacagaggaaaatgttgaatgctctttcaactattatggctcatgtgcctagaagcttaaggactgttacagacaaagaactagaagaagagagtgaagtgatagagagggaagagatagtaacgccaaagatagaaaacgcatctgaactccacggaaattccccatggaatgcctctcttgaagaaatccagcggagtaataatactagtaatcctcagaatcttggactggtatttgatggaggagacaaaccaaatgatggttttggcttaaaaagaggttttgactacaccatggattctaatgtcaatgagagcagcactttctctagtggtggtttcagtatgatggccgagaaaaagcgtacaaaagcagataaaaccatcactttggatgttcttcgacagtatttcgctgggagcttgaaagatgcagccaagaatatcggtggtaagcagcatttttttatcttctcgattcaatttatcggaaagtcctgagactgatctcttctttttgcccttttcttgtcttggaaattttcagtttgtccaacgaccttgaagagaatatgcagacagcatggtatacaaagatggccttcaagaaagataaaaaaagtgggacattctctgcagaagatccaacgagtgattgattcggttcaaggtgtttctggtcctcttcccataggctcattctatgcaaatttccccaatttagtctcacagtcacaagaaccatcacaacaagccaagaccacgcctcctcctccgccgccagtgcagcttgcaaagtcccctgtatcctcgtatagtcacagttcaaactctagccaatgttgctccagtgaaacccaactaaacagcggtgcaacaaccgatcctccttcaactgatgtaggaggtgcattgaagaagacgagcagcgaaatcgagcttcaaagctcgagtcttgacgagacaattttgactctctccagtttagaaaacatccctcaaggcaccaacttgttatcatctcaagatgatgactttctgaggattaaagttagctacggagaagagaagatcagattacggatgcggaattcgcgcaggttaagagatctattgtgggagattgggaagcggtttagcatagaggatatgagcaggtatgatctaaagtacttagacgaagacaatgaatgggttttgttgacttgcgacgaagatgtagaagagtgtgtagatgtctgcagaactacaccgagtcataccattaagcttttgcttcaggcttcttctcatcatttccctgaacgttcttcagctactgaatacagtttatggcactgaccttaaatcag

SEQ ID NO: 4407 - DNA, 780 bp, Artificial Sequence
  P2499 (35S::G1988)
caccatcatcattccaaaccaattctctctcacttctttctggtgatcagagagatcgactcaatggtgagcttttgcgagctttgtggtgccgaagctgatctccattgtgccgcggactctgccttcctctgccgttcttgtgacgctaagttccatgcctcaaattttctcttcgctcgtcatttccggcgtgtcatctgcccaaattgcaaatctcttactcaaaatttcgtttctggtcctcttcttccttggcctccacgaacaacatgttgttcagaatcgtcgtcttcttcttgctgctcgtctcttgactgtgtctcaagctccgagctatcgtcaacgacgcgtgacgtaaacagagcgcgagggagggaaaacagagtgaatgccaaggccgttgcggttacggtggcggatggcatttttgtaaattggtgtggtaagttaggactaaacagggatttaacaaacgctgtcgtttcatatgcgtctttggctttggctgtggagacgaggccaagagcgacgaagagagtgttcttagcggcggcgttttggttcggcgttaagaacacgacgacgtggcagaatttaaagaaagtagaagatgtgactggagtttcagctgggatgattcgagcggttgaaagcaaattggcgcgtgcaatgacgcagcagcttagacggtggcgcgtggattcggaggaaggatgggctgaaaacgacaacgtttgagaaatattattgacatgggtcccgcattatgcaaattag

SEQ ID NO: 4408 - DNA, 1033 bp, Artificial Sequence
  P2501 (35S::G1999)
ctccttttgtgccagtttcttcttctactttgatttcttctcatatctctgttttcatgttttgcgcagaaattatgatttcaaagtaccaagaagatgtcaagcagccacgagcttgcgaactttgtctgaacaaacacgcagtttggtactgtgcctccgatgatgctttcttgtgccatgtttgtgatgaatcagtgcattctgcaaaccatgtagcgacaaaacacgagagagtttgtcttagaacaaacgagatatcgaatgatgtgcgtgggggaacaacattaacctcggtttggcacagcgggtttcgaagaaaagcaagaactcctagatctcggtatgagaaaaagccacaacaaaagatagatgatgagagaagaagggaagatcctcgtgttcccgagattggaggcgaagtgatgtttttcataccagaagcaaatgatgatgatatgacttctcttgtgccagagtttgagggattcacagagatgggattcttcttgagcaaccacaatggtactgaagaaacaacgaaacaattcaactttgaagaagaagctgacacaatggaggatctatattacaatggagaagaagaagataaaactgatggagctgaagcatgtcctggacaatatttgatgagctgcaagaaagattacgacaatgtcataacggtttcagaaaagacagaagaaattgaagattgttatgagaataatgcaaggcatagactgaattacgaaaatgttatagcagcttgggataaacaagaatctcctagagatgtaaaaaacaacacaagtagcttccagctagttcctccagggatagaggagaagagagtaagaagtgagagagaagctagagtttggagatacagagataaaaggaagaatcgtttgttcgagaagaagataaggtacgaggttagaaaggttaacgccgacaaaaggccgagaatgaaaggtcgatttgtccgacgatctttagccatcgactcttagggaacagattctctcag

SEQ ID NO: 4409 - DNA, 726 bp, Artificial Sequence
  P2502 (35S::G2432)
cttaatcacaactctctctttaatctctttgtctctctctctctctctctatctctctctcattttaatggcgacccaagattctcaagggattaaactctttggcaaaaccataacattcaacgccaacatcacacagacgataaaaaaagaagagcagcaacaacaacaacagccagagctacaagcaacaacagccgttagatcaccctcatcggatctgacggctgagaagcgtccagacaagatcataccatgtccgagatgcaagagcatggagactaagttttgttacttcaacaactacaacgttaatcaaccaagacacttctgcaaaggttgtcaacgttactggaccgccggtggagctctccggaatgttcccgtcggtgccggtcgtcggaagtcaaaacctcccggacgtgtcggtgggttcgctgagttgcttggagctgcgactggagctgttgatcaggtcgagctagatgctttgctagtggaagagtggagagctgctacggcgtctcacggtggtttccggcatgattttccggtgaagaggctccgttgttacaccgatggtcaatcttgttaattatttttacatttttatttgtttgttttcgggtttgggtttgggtggtttgctataatttaacccgtagaaagaaagaacgtggttaaatttgctttgctttgattaactctggatacgtacaggctagc

SEQ ID NO: 4410 - DNA, 1267 bp, Artificial Sequence
  P2505 (35S::G1998)
gatcttacgtgtgttttactaatcgtgaaacaatatcaacgtcagattcttctctatacacttttctttaagtttacccaatcatcatgtctccaagtatggagccaaagtgtgaccattgtgcaacctcgcaagcattgatttactgcaaatccgatttggctaaactatgcctaaactgcgacgtccatgtacactctgcgaatcctctgtctcacaggcacatacgctctttgatctgcgagaaatgcttctcacagccagccgcaatccgctgtctcgacgagaaggtttcatactgccaaggatgtcattggcacgaaagcaactgttcggagttaggacacagagttcagagcttgaatcctttctctggttgtccttctcctacagattttaacagaatgtggtcttcaattcttgaacctcctgtctccggcttgcttagtccgttcgttggttcttttcccttgaatgatctcaacaataccatgttcgataccgcttattccatggtaccacacaacatcagttacactcagaatttcagtgataatttgtctttcttttccacggaatctaagggatatcctgatatggttcttaaacttgaagaaggagaagaagatctatgtgaagggcttaacttggatgatgcaccattaaactttgacgtaggagatgatattatcggatgttcatcagaagtacacatagaaccggaccatacggtaccaaattgcctattgattgacaagactaacacatccagctttaccggctccaactttactgtagacaaggctctagaggcatcgccaccaggtcagcaaatgaacatcaacactggacttcagcttcctctatcacctgtcttgttcggacaaatccatccatctcttaacatcactggtgaaaacaatgcagctgattaccaggattgtgggatgtctccagggtttataatgagtgaagcgccatgggaaacgaattttgaagttagttgtccacaagcaagaaacgaggctaagttgagatacaaggagaagaaattaaagcgctcttttgggaaacagattcgatatgcatctcgcaaagcaagagctgacacgaggaaaagagtgaaaggaagatttgtgaaagctggtgacagttatgattatgatccatcatcaccgacgacgaacaattgaaatttacaaaaataatgtacagtcttctttcccaaacagacttaaaccatgcttcatgatgatgataaaggttg

SEQ ID NO: 4411 - DNA, 1614 bp, Artificial Sequence
  P2508 (35S::G319)
caagcttgagatctcatatctacaatgcctttctttctttcaaatctatagatctcaaattttacactgttcgtatcttttttttttcttttttttttttgtttttaaattaagtgtaaaaaatgggatcaccattgtgcgagcatttggctaggctttgtcttcaatgtgatttgaagttacactctaagagtagtgtaaacaattacaactattcgcggattccgttgtgtaataattgcgtttcgcagaccgctcttgtagaatcccttgaacaagggttgtgcctatgccaatcatgcttttcaaatcccaatgtaatctcgcgttttcttcttcttcttagaaacgatgctagtgattattcggcatataattttccactggatcttgattcctcttcttcgtcttgttcatcttcttttatcgatcgcaattgggaattttcccttggttccttacctctcaataatgaggactcatcatcatcttttgaaatccttcaaatatttgaagatcatacaaagaattatagtgatcaacaagtgttgacgcttcagcccgattatttggacataattcctaaggtatatacttatttatttttattttgttaaagaggggttttgttcattgttatgagatatatatgtttgcttaactcgttccattgtttcctgtgtgtcacttttacgcaggatagttcatgctcaggcttcaaaagctacgaaactaaagaagatatagagaatgttttgatgaacacttttgatggcgccgaggcagcagtattagacctaaaacaatataaccccgaggaagatttgatcctcacggagctaatcgatgaattagcaagagacaattcagagaccacgccgaccaatgtaaacatcagctttaattctgtcgcatattaattatctttaattatggttgacttatttatatatttttgtttcattgtgtaatagactttaccaacttcagcatctggtatgtcatcggatatacataaagattacaacactgaagctttggctaatgcaagttctcaagattattttataaaccaaatgattggctcaaaagcaaaggaagagaccaatgatcttgcaatactccctaacgctcttgttcaacttgactgtggacaatcgcagttgatacttaccgatgagatgttaccatgggagaatcaaacatttgtacctgttaagggatttagtccgaaagatcgagaagaggccaagaaaagatatttcgaaaagaagaagaaacgcaagtaggtattacacctcattatacttataggtagataactccatgcaagtgtatacgtacttacaagttcaaatttataacaatgcaggtttgggaaacaaattagatatgaatctcgaaaatctacagcagatacgaagaaaagaatgaaaggaagatttacaaaagctggtgctgattatgactatgacccacgagctaatgatattaacaaagggaaaatacaaacatgagctaatgataaccaagctcaattgtgatatccaaataaggaaaataaaaagatggttgcaataatatatatgatgatcatcatcattatggttccat

SEQ ID NO: 4412 - DNA, 1096 bp, Artificial Sequence
  P2513 (35S::G646)
gtttcggctgatctgaggaagttcatctatggatacggctcagtggccacaggagattgtagtgaagcccttggaagaaatagtaacaaacacatgcccaaagccgcaaccgcaaccgcttcaaccgcagcagccaccgtcggtgggtggagagaggaaggcaaggccagaaaaggatcaagctgtaaactgtccgagatgtaactcaaccaacacaaagttttgttactacaacaattatagtttgacgcagccaagatacttctgcaaaggttgtagaaggtattggaccgaaggcggttcgcttaggaacattcctgttggcggtggctcaagaaagaacaagagatctcactcttcttcttctgatattagtaacaatcactcggattctacacaaccagctacaaagaagcatctctctgatcatcaccaccacctcatgagcatgtctcaacaaggtttgaccggtcaaaaccctaaattccttgagacgacccaacaagatctcaatttaggtttttcaccacatgggatgattaggaccaacttcactgacctcatccacaacattggcaacaacaccaacaagagcaacaacaataacaatccattgattgtttcttcatgttctgccatggctacttcttctctggatctcataagaaacaatagtaacaatgggaattcttcaaattcttccttcatgggatttccagttcataatcaagatccagcatcaggagggttttcaatgcaagatcattacaagccttgcaacacaaacaccacactgctagggttttcattagatcatcatcataataatggatttcatggagggtttcaaggaggagaagaaggtggagaaggtggtgatgatgtgaatggaaggcacttgtttccttttgaggatttgaaattgccagtttcttcttcatcagcaacaattaatgtcgacattaatgaacatcagaagcgaggaagcggtagtgatgcagctgctacgtctggtgggtattggactgggatgttgagtggaggatcatggtgctaattaatttctcggtttggttgatgaagatagtactattag

SEQ ID NO: 4413 - DNA, 807 bp, Artificial Sequence
  P2519 (35S::G2930)
ccatcggtggtaggaaagagcacaagcctcttttttgttcctcttgccgtcgtatatatatgtcttctcaaccgaatcatcagacttcaatatcaagtttactccatgatcgcttgcatatccctcctgcagaaacaatcgttgagaaagagtctgcagagaaggacacttgtcaatcacaaagaaaaaggaaagaaccagttttgcatgaggttgatggctcaagtagtggtgcagcaaagaaacaagaccataacgctaaggagcgtttaaggaggatgagacttcatgcctcttacctcactcttggcactcttcttcctgaccattcttcttcttcttcaaagaagaaatggtctgcaccatctataatcgataatgtaatcacttacattcccaagctacagaatgaagttggagagctaactctaagaaagcagaagcttgtggagttagagagacgaggtccttctattcgagcaatctcggttcttgaattgggggaatcaggttatgaggctgttgtacagatatgcttgaagaaagaaaacgaagatgagttctccaacttgcttcatgtaatggaggtgcaaggtttgagtgttttaagtgcttctacttctcaagtttgccgagagcaaagggtggtttgctacaacttccatgtcaagatggatgagaagccatgtgaaggtgatgactacatcacagtgttaaagaacaacatcatttcttcgcttcgtgacaacacaaagtgcaaatgatatatagtgaggtatagaatcaacagaatatctttgatgatgc

SEQ ID NO: 4414 - DNA, 557 bp, Artificial Sequence
  P2520 (35S::G3021)
ctcccttgtagactttcatttgcagcaaaaatagtttctcatatggagaggcaaatcataaacaggaagaaacgagtgttttctcttgaaccaaacaagaaccctagtgcagttttcacgagaaaatacacaagccacttggttcctgcactcaagaagctcaacatgaacaagaactcttcaaaacaaaccgtgaagcatgaagtagatatggctttggctttgtctgctcaagaatttgcatggagccgtttcttgctgcagaagctatcgtcctcatcgaatccaaccactaccactagttcttcttccgatggaattcggattcttgaaagacccgataaagaaggcggaaacgaagaaggagggatagaggagagactgagggaattgaagaagcttttgccaggtggggaagagatgaatgtggaagaaatgttgagtgagattggtaactacattaaatgtcttgagttgcagacgattgctctcaagtccattgttcaagatagtacttgacttttagtttaagtgtataatttatagtttgtttcatg

SEQ ID NO: 4415 - DNA, 1926 bp, Artificial Sequence
  P2528 (35S::G3044)
gtgtagaaagttgagtttcatgtgatcaaaattggggctttactacttttaagagaatgagtgacaaagacgagtttgccgcaaagaagaaggatttggtcaatacgccagtggatttgtatcctccggagaatccaatgttgggtccttctccgatgatggattcattcagagaaactctttggcatgatggtggtttcaatgtccacacagatgcagacacttcctttagaggtaataataatattgatatacctcttgaaatgggttggaatatggctcagttccctgcagattcaggattcattgagcgtgctgcaaagttttctttttttggatgtggtgaaatgatgatgaaccaacaacaatcatctcttggagttccagattcaactggcttgtttcttcaagatacacagattcctagtggatccaaactagataatggtcctcttactgatgcatctaagttagtgaaagagagatcgattaataatgtatcagaggattctcaatctagtggaggtaatggtcatgatgatgctaagtgtgggcaaacatcttccaaggggtttagtagtaagaagaggaaaagaattgggaaggtatagagatttgtagcactccttttgtattttgtgttttttggtctttcgttgataatatttctgttggtaggattgtgaagaagaagaagataaaaagcaaaaggatgagcaaagtccaacttcaaatgcgaacaagacaaacagtgagaagcaaccttctgattctttaaaggatgggtatattcacatgagggcacgaagaggccaggctactaatagtcacagtcttgctgaaagagtaggaacaatatttttttgaagttgaatagaaagcaaatttcttttgttgttgtatttgaatttggttaaacttgttatcgtaggtaagaagagaaaaaatcagtgaaaggatgaagttcttgcaagatcttgtgccaggttgcgacaaggtaagtccttttctttttagatgttgatgtctacatgtagaagaatggaagctgaagctgttttcttttcatataaatgggacattgcatttattgtgtaggtgactggtaaggcagttatgctcgatgaaatcattaactatgtgcaatcacttcaatgccaaatcgaggtttccctttgtttgctttgggaatttcctattttcttagtgtctgttcttgagacttcatttaattagcaacctcactttgtgttagttacttcttccatgcatttcagtttttatcgatgaaactttcggctgtgaatcctgtgctcgattttaacctcgaaagcctccttgcaaaagatgtaacatatgttgaaacccttctctttcttatcatttgacgagtaacttcattgatatgatgttgatgtcttctatatattcatgcaggctcttcaatcatctgcaccgacatttccccacaacatgtcgatgctttatcctcctgtatcgtatctctctcaaacaggattcatgcaaccgaacatttcctcaatgtcgctattgagtggaggattaaaacggcaggtacatatatttggttgcgcattgtactccaacaataaacatatctttgcagaatcatttctttctcttgcattcatctaatattgttagtgagttttgaacaggaaacacatggatatgaaagtgatcaccacaatcttgtccacatgaaccatgaaaccggcactgcacctgatcatgaagatacaacaggtgaaagtaaaagccctataagtttcatacttttgtaaccagatacttgaaactcgctaaagcttttcatgtttatctgatcttacagctgacatgaaggtggagccgtagatgtttcttcttcactttgtactcagctttagctgctgatatagtgcg

SEQ ID NO: 4416 - DNA, 1375 bp, Artificial Sequence
  P2531 (35S::G2791)
gaacaaatgaaacggccagtaaattaaaaaaatagaaatcaaatttttttgaaaagaataaaaacaggggagggaacagaggaagaaaccagaagaagagaagaagagatggaaaatggaaatggagaaggaaaaggagaattcataaaccaaaacaatgacttcttccttgattccatgtcaatgctctcctctctccctccttgttgggatccatctcttcctcctcctcctcctccgccacaatctcttttccacgctctagccgtcgacgcccccttccccgaccagttccatcatcctcaggtaccaaaactattatcttacatcataactcaccaaaactaagaatgtttctgatccttttctgtgttgttgttgttgtttgtcaatgcaggagtcaggaggtccaacaatgggtagccaagaagggttacagccacaaggtacagtgtcgaccacgagcgcacctgttgttcgtcaaaagccaagagttcgagccaggagaggccaagccaccgatcctcacagtatcgctgagagggtatctcattgttcacttcctccatatccttcttctcttatcttgtgtttctgattgtatggttttgtacagcttagaagggaacgcatcgcagagcgtatgaagtctctccaagaactggttcccaacaccaacaaggtattcactactttcctaatttatgaatcttgtttggatttgcataataaccgaattggttgatggtgagatgcagacggataaggcatcaatgttggacgagatcatcgagtatgttaggttccttcagcttcaagtcaaagtactaagcatgagcagattgggaggtgcaggatcagttggtccacgcctcaatggtctctccgcagaggtcagtttcttagtcccttatggctttcaacatatgtatagtggcatcaccaatcatcatcaatcgtcatggtttttggtaatgtaggcaggaggacggctcaatgccctcactgcaccgtgcaatggcttaaatgggaatggaaacgctacaggatcgtccaatgagagcctaaggtcaacagaacaaagagtggcgaaactgatggaggaagacatgggatcagcaatgcaataccttcaagggaaggggctttgcttaatgccaatatctctcgcaaccgcgatatcatcatcaactactcactctcgtggatccctctttaaccccatctccagtgctgtagcagcagaggattcaaatgtaacagcaactgcagttgctgcacctgaagcctcgtctactatggatgatgtatctgcttccaaggcctgaaccatagaatactcatgtgtttcgttttctcagtttaagtcaaacgc

SEQ ID NO: 4417 - DNA, 1050 bp, Artificial Sequence
  P2532 (35S::G2766)
cctaagcatcagattagcttttgtagggtttttcttttccggtttcatgtaccctcctaattcctctaagtccaccgctcatgacggcggcggcgatgccgacaccaatcaatatgactcagccgctggagctacccgtgatttctcctctcttggccctcaaacccaccatcatccgccaccgcagcggcagcagcagcatcagcagaatcccaacctcgtcggccattatttaccgggcgagccatcttccatcggattcgattccaacgcttcttcttcgtcttctttgttccgacacagaagctctccggctggattctacgaccaacatcttcccactgatcccaacggtttttctctaggacggccaaacggaggctacggcggaggaggagagcaagggccgtcgaggttgaagtcggagctgagattctctagtgggagtagtagccatcaagaacataattctctaccgcgaatctcggaggttgaagcggctgcagcggctagaaacggtgtcgcatcaagtagtatgagttttggaaataatcgtactaacaattgggacaactcgtcttctcatatcagtttcaccattgatcaacccggaaaacggtccaagaactccgactttttcaccttagaaactcagtatagcatgccgcaaacaactctggaaatggcgacaatggagaacttgatgaacatcccagaggactcggtgccttgtagggctagagccaagcgcggcttcgcgactcacccacgcagcattgctgaaagggagagaagaacgaggataagcgggaagctgaagaagctacaagaacttgtgcctaatatggacaagcaaacgagctacgcagatatgttggatttggctgttgagcatatcaaaggtcttcagcaccaagtagagtcactggaaaagggaatggagagatgtacttgtggggcatgcaagaagcgatgatgaatgatattgttccaagtatgatgcaataaagtatagaagaaaaggagatcacttacgaaccaaattctaag

SEQ ID NO: 4418 - DNA, 1115 bp, Artificial Sequence
  P2541 (35S::G2865)
cattacagcaaaccaaactatttgactaaagatgaaaacaacacctctcccgaggctgcattatttagtaagtcttctttgtttttttctttcttccaagattaaagaagacagacccaattatgtaagggcagtctctcctataaacctaactagttcattggaaaaaacaagagagaaaaaaaaacgattactgctgagatctaccatttctaaacctcaacccatgaatccttctaacaatcctaaaaagacaaggcaccagagtcatatgcctcaagaaagagatgaaacgaagaaggagaagaagcttctccaccgcaacatcgaacgacaaagaagacaagaaatggcgatccttttcgcctctcttcgtagtcagctacctctaaaatacatcaaggtacatatattttactccaatagtctcattgaagtcccaatcttcctatcaagttcattgatgggagatttttgttctctagggttttagttttctcaggctctttcttcgcagggaaagagagccatgtcagatcatgtaaacggagcagtaagtttcatcaaagacacgcaaacaaggataaaagatctctccgcaagaagagacgagctaaagcgagagattggtgaccctactagtctaactggatccggatccggatctggatcaagtagatcggaaccagctagtgtcatggtgcaaccgtgtgtgagcggcttcgaggtggttgtgagcagcttagcatcaggtctcgaggcttggccactctcaagagttcttgaagttcttcacgggcaaggacttgaagtcatcagctctttaacagcacgagtcaacgagaggctcatgtacactatacaagtcgaggtacggttacatatttggagttattgtagagttttttagtgtaagcttatctattgtgtaaatatgcttattcttatgtatccatatatatgatatatccacaggtaaatagctttgattgcttcgacttagcttggttgcagcagaagctaattgagcagttagtactttccacgactaggcactgaaaaaactaacatttgtcataagaatatgttcattgaatgatgcttttgtcccaatc

SEQ ID NO: 4419 - DNA, 1450 bp, Artificial Sequence
  P2546 (35S::G2859)
gaaactcagaaatggcgaatctctcttctgattttcagacatttacaatggatgatcccataagacaactagcagaactgagcaacacgcttcatcatttccaaacatttcctcctcctttctcttcttctctcgattctcttttctttcataatcaattccctgatcattttcccggaaaatctctcgagaataattttcatcaagggatattcttcccttctaatatccaaaacaacgaagagtcttcttcacaattcgataccaagaagagaaaatcattaatggaagctgtttctacgtcggagaacagtgtctctgatcaaactctctctacctcttctgctcaagtttccataaatggaaatatttcgacaaaaaatgtattttattaacctagaaaccctaatttcacacacatatattagagtactctcagtttctatgaattaatctaactttgtttttctcttttttcttattgatatcacagaattcttcaaggagagggaagaggtcgaagaatagagaagaagagaaagagagagaagttgttcatgttagagctagaagaggccaagccactgatagccacagcatagcagaacgggtaaaattgattttctctatacaaattatagtgtacataaataatataaatgaaaactatgagtaaaaaaattaaaattaactttcaggttcgacgagggaaaataaacgagagattgaaatgcttgcaagatatagtccccggatgttataaggtgattatattttgcttagactttaagaaaatatattattagttcttttattgaatatatatttggtgatgcagacaatgggaatggctactatgcttgatgagataattaattacgtccagtccttacaaaatcaagtcgaggtataacaataacaattaatttctcttaagttataggtcatctaaccaattccattcgtttcaataattatactaatttactttcttttttatgtgaactcagtttttatctatgaagcttacagcagcaagttcgtattatgactttaactcggagactgatgctgtggaatccatgcaggtacagaatctagaattataacttttaattaaaattttctcgtaagactggtgatgtttgctatgatttatttatttcttaatttaactatatggtttgatgtgattataattagatgatttaaatatcgatttttaattggaatattaaaatgcgcagaaggcaaaggcacgtgaggcagtggagatgggtcaagggagggatgggagttctgtcttccattcatcatcgtggaccctttgacttttgttttttgctctcctttttttgtctttctaattttcttcctttttttggatttaaaaagatacttttaaagattaatttcaagaaatctcgatgccatatgatatgtatacttg

SEQ ID NO: 4420 - DNA, 1276 bp, Artificial Sequence
  P2553 (35S::G2846)
ccttcgtatagcaacgatctagtagaaagcttatactaaaactttctgattctcttaatatggcggaggagtttaaagctacggcatcgatttgtggtggcggaggtggcgcgtggtggaactcgccaaggagcgttatgtctccttcggatcatttcttgtcaccatgcttcggagcggctatcacttccaatgattttagctcgcaagagaatcatctcaaatctaggatgacttgtacggacaacaacaacatcgttttcgggcagcgagaggcggattctgacagtggaggaagtaccgtgacgatggactcgacgttgcagatgatgggtctagggttttcctcaaattgttcttcagattggaaccaaaccattttacaagaagacttaaactcaagcttcataaggagctcacaagatcaagatcatggccaaggattcttatccacaactacttcaccttatatacttaatccagcttgttcttcatctccatcaacttcttcgtcctcaagcttgatacgaaccttttacgatcccgaaccaagtccatacaactttgtctccaccacaagtggttcaatcaacgatcctcaactttcttgggctaataagacaaatcctcatcatcaagtagcttatggactaattaacagcttctctaacaacgcaaactctcgacccttttggaattcttcatcaaccactaacttaaacaacacgacgccgagcaattttgtaaccactccgcagataatatctactcgtttggaggacaaaaccaagaatctgaagacaagagctcagagtgagtctttgaagagagcaaaggataatgaatctgcggcgaagaaaccgagagtcaccacgccttcaccgttgccaactttcaaggtgagaaaagagaatctaagggaccagataacttcattacaacaactagtttcacctttcggaaagacagatactgcatctgttctccaagaagctatagagtacatcaagttccttcacgaccaagtcactgttctaagcactccatacatgaaacaaggtgcctcgaaccaacaacaacagcagatatctggtaaatcgaagagtcaagatgaaaatgagaatcacgaactaagaggacatggtctatgtctcgtcccaatatcaagcacgtttccggtggctaacgaaacaacagccgatttttggacaccaacgtttgggggcaacaatttcaggtgattaaagagagagggttgtggttgtcaagacggatg

SEQ ID NO: 4421 - DNA, 1304 bp, Artificial Sequence
  P2554 (35S::G2783)
ctacggtcagagattcaaaagagttctttctctctatcttattctccgatcatcatgatgcagcagccaccacccggaggtatccttccacatcacgctcctcctccttctgcgcaacaacagtacggttaccaacaaccttacgggattgctggagctgctccaccaccaccacagatgtggaatcctcaagcggcggcgccgccatcagttcagcctacgaccgctgacgagatccggactctttggatcggggacttacagtattggatggatgagaatttcctctacggttgctttgctcataccggagagatggtttctgctaaagtgattcgtaacaagcaaaccggtcaagttgaaggatacggtttcattgaattcgcatctcatgctgctgctgaaagagttctacaaacattcaacaacgctcctatcccgagctttcctgatcagctctttagactgaactgggcatcattgagttcaggagataaacgagacgattcaccggactacacgatatttgtcggtgatctggctgctgatgttacggattatatcttacttgagacgttcagagcctcttatccgtcagtgaagggtgcaaaggttgttattgacagagtcactggacgtacaaaaggatatgggtttgttaggttttctgatgaaagtgaacagatccgtgctatgacggagatgaatggcgttccttgttctactagacctatgagaattggtcccgctgctagcaagaaaggtgtaactggtcaaagagattcataccagagctctgctgcaggggtaacaactgataatgatccaaataacacaactgtttttgttggtggattagatgcatctgtcacggatgatcatctgaagaatgtctttagccaatatggtgagattgtgcatgtgaaaatacccgctggaaagcgctgtggattcgttcagttttccgagaagagctgtgcagaggaagctcttagaatgctgaatggagtgcaattaggcggaacaaccgtcaggctctcatggggccgaagtccttcgaacaaacagtcgggggatccgagccagttttactacggtgggtatggacaaggacaggagcagtatgggtacacgatgcctcaagaccctaatgcatattacggaggctactctggtggaggatacagcggtggttaccagcagacaccacaggcaggacagcaaccaccacaacagccaccacagcagcaacaagtcgggtttagctactaaccccgagagtattgcttgagttaatgtcactc

SEQ ID NO: 4422 - DNA, 2796 bp, Artificial Sequence
  P2558 (35S::G2854)
gcatctacgacagtcgtaccttttgctaggttatcgtcgtcatgatgcagcagccacctccagcttccaacggtgctgcaacagggccagggcagattccttccgaccaacaagcttacctccagcagcagcagtcgtggatgatgcagcaccagcagcaacaacaaggtcagccgcctgcaggatggaatcagcagtctgcaccgtcttctggtcaaccacagcagcagcagtatggtggtggtggatctcagaatccaggatcagctggtgagatccggtccctgtggatcggtgacttgcagccatggatggatgagaactatctcatgaacgtctttggtcttactggcgaggtaattttgaaaatcctgttgatttctgtttttagtctctcgtttttcttctacaagtattgaaagtttcatcctttgtggttgcaggctacagcagctaaagttattcgcaataaacagaacggatattcagaaggttatggctttattgagtttgtgaaccatgctacagctgagaggaatttacagacttacaatggtgctccgatgccgagcagtgagcaggccttcaggttgaactgggctcagcttggagctggagagagacgccaggctgaagggcctgagcacacagtttttgttggagacttggcacctgatgttaccgaccacatgcttactgaaacgtttaaagctgtgtattcctctgtcaagggagctaaagttgtgaatgataggactactggacggtccaagggttatggatttgtcaggtttgcggatgaaagtgagcagattcgtgccatgactgaaatgaatggtcaatactgctcatcaaggcctatgcgtactggtcctgctgccaacaagaagcctcttacaatgcaaccaggtatgttttgatattaaggagcctgatatctgatcacttatgaataagttgagtgatgatatgactcactttgtcttacactgtctatgttagttgattgtcttttctttggggtactcctttactgctatctttctgattactggagaatctgtctacccttttctcccgcttcttgcctttcagctcttcaaagaatttaatatcgcaaaacatcctaaaacttataagaaaaaaactcatgttgtctttaagcaggagaacaagaggctctctttcgggggcctggaactgatttcagctgaaaatgattccaccttgcgtggcctcatttaggtcagttggttatgttttcagaagaagttaattacaaagcttttactccatttgcaaattattttccagtttcttacttatcaagcataagtctttccttttaatttttagccctatcttttatttcttttcatgttacatagttcattactcttcgctttattttgtccagtttgaatccttaaagagtgttttgatatctttttcatacctctcaattcatctttttccagtagttagtgctgcaatttttttccttctttcagttacgttgtgcctctaaatttatacttgcaaccttttttagtgttacatttcgtctttcggaaaagttgattacaatggtaagactgtcagaccttggaaggaatttaggttacttgtgataccctagagaatttaggtccgattctctaatttctcgaagttggatcttgcaggcacttcccctagtatatctttaatgtgcttttttgtattaattagcaactaacttcagaatcactttacctttatcttcgagctgtaacctatgtatggcatttgctttatatgttgataattttgggtcttgatttggataagttctgctactgctattgtcgtgtgtgtgcgtttgtgttagtgtctgtgtccttgcactgtcagcttaattaaataaatagatgtttgaggtttttttccttaccttctcttgactgttttattgcagcttcatatcagaacactcaaggaaattcaggagaaagtgatccaactaacacaacagtgcgtaacttgttttggtttccctaagccttttttttctttgacgttgcctaagcctttttctctgtgggatatattgttgaaattgaagcgttatgttctctattccagatttttgttggagctgtggatcaaagtgtaacagaagatgatttgaagtcagtttttggtcaatttggtgaactagttcatgtgaaaatacccgcaggaaaacgttgcggatttgttcaatacgccaataggtaaatgtgaacttggagacgaacttcatctttacttattttgagaatgttttttcacatatttaatctgtctgtatgcttcagggcatgtgctgagcaagcactttctgtgttgaacggaacacaacttgggggacaaagcattcgtctttcatggggtcgcagtccttccaacaaacaggtttgtatctgttagacaatgcaccaagcttactacgctttcatatacgttatgtgatctgatgacttgttgatccacgaatttcacagactcaacctgatcaagcccagtatggtggtggtggaggatactatgggtatcctcctcaaggatatgaagcatacggatatgcacctcctcctcaggaccctaacgcctactacggtggttatgctgggggcggctatggaaactaccagcagcctggtggataccagcagcaacagcaggtaacattctttggtttttatctgaatatcttcgaatgaaaagtatctatgttttctgtttttttgcgagataactgattcttcttcactc

SEQ ID NO: 4423 - DNA, 2347 bp, Artificial Sequence
  P2559 (35S::G2777)
aaaatgtgtattatctagggatttacttctctaacatatagtttatgtttttaattttgatggtacgtgaagcaggtagtcacttgaaaacccatgattttcttcaaccgttagaatgtgttggtgctaaagaagacgtaagtaggattaactctaccactacagcgtccgagaagccaccgccccctgctccacctccaccgttgcagcacgtgcttcccggtggtatagggacttatacgattagccccattccttacttccatcatcatcatcagagaattcctaagccggagttgtcaccaccaatgatgttcaatgctaatgagagaaacgttttggatgagaattctaactctaattgcagctcgtacgccgctgcatcaagcgggttcactctgtgggatgaatctgcttctgggaagaagggacagacaaggaaggagaatagtgttggggagagagtaaacatgagaggtaacaagaaaacttgaatcgtgatgtttatttagactagttttaaagtagtatttagaaatcaatggaatgatgaaatataagtttttttgaatgtgtagctgatgttgcagcaactgtgggacaatggccagtggcggagagacggtcccagtctttgacaaacaaccatatgagcggtttcagttctctctcttcctctcagttagtctcatatcttctcttttttatataactcggtctatggactttaaagagtgatcaactaaagttttactttggttgcagagggtctgtgcttaagagccagagcttcatggacatgataaggtcagcaaaaggaagttcacaggaagatgatttagatgatgaagaagattttatcatgaagaaagaaagctcctcgactagccagagccatagaggtttgtattgtccgagattccacctatatgatatctaaagtctaaacagtaacagcttaggatctgattgattgcttctttacagtggatttgagggtaaaagcagatgtgagaggctctcctaacgatcaaaagctgaacacacctaggtctaaacattctgctacagagcaacggagaaggagcaagatcaatgataggtaagtcctgaatatgtagcaaaagccaccagaattggttatatagcttagcagagtggagatactaatcaaacattgttaatggatccctctgcagatttcagatgttgagacaactaatacctaacagcgaccaaaagcgggataaggcctccttcttactagaggtataactatactcttttggccgaaaattttgtgacagtaagattcaatcacatctgctcctaatctccaatttttttttttgacaacttcatacaggttatcgagtatattcaattcttacaagagaaagcagacaagtatgtgacctcttaccaaggatggaatcacgaacctgcgaagctattgaattgggtaaatataatctcacattttccgaccatacttcatttttattccccgggttggaaactgaaaacaaacaaaccatgtaatgttaacccgtgtgatccatttacattatagcagagtaacaacaaccaacagctagtacctgaaggagttgcttttgctccaaaattggaagaagagaaaaacaacattccggtttcggtccttgcaactgcacaaggtgttgttattgatcatccaacaaccgcgacgacctctccatttccattgtcgattcaaagcaacagttttttctctcctgtgattgcgggtaatcccgtaccccagttccacgcaagagtcgcatcatcagaggctgtagagccaagtccgagttcccggagtcaaaaagaagaagaagatgaggaagttcttgagggtaacatcagaatttcaagtgtttactcacaagggtaaaactaaaaaactctcttttgaattttgatcttgcaacagttaagtaaaagtaaaaaattattaaccttttatacatttacttttgtgtgtggagcagattagtgaaaacactgagagaagcattggagaattcaggagtggacttaacgaaagcaagcatctccgttgaaatcgagctcgctaaacaatcctcgtcttcttccttcaaggtatctttttctttacttacgtttgattcaattcaaacacattttcatgagttggatcttgatagtttatagttttgttcacatctcgataggatcatgaagttcgtgaaccggtttctcgaaccagaaacgacaatgtcaagcaaactcggaaaccaaaacggctcaagacgggacagtagaagttataaaaacaaaacccaaacacacaatccggtaaaag

SEQ ID NO: 4424 - DNA, 2789 bp, Artificial Sequence
  P2581 (35S::G549)
gttgtatatatagaagttgctcgagtggtcatttttacaataaagcaatctgctcaaaagagtaaagaaagagagaaaaagagagtgatagagagagagagaaaaatagattatggatcctgaaggtttcacgagtggcttattccggtggaacccaacgagagcattggttcaagcaccacctccggttccacctccgctgcagcaacagccggtgacaccgcagacggctgcttttgggatgcgacttggtggtttagagggactattcggtccgtacggtatacgtttctacacggcggcgaagatagcggagttaggttttacggcgagcacgcttgtgggtatgaaggacgaggagcttgaagagatgatgaatagtctctctcatatctttcgttgggagcttcttgttggtgaacggtacggtatcaaagctgccgttagagctgaacggagacgattgcaagaagaggaggaagaggaatcttctagacgccgtcatttgctactctccgccgctggtgattccggtactcatcacgctcttgatgctctctcccaagaaggtacaataattatgaatacatatagaaatatcaaatatcgcacgttttataaatatgtgtatatattgttctcaacatttctatgcccgactttcaagaaaaagtatgtatatgttcacgtgactaatatagataactaatttatgaatcttaccatatgtatagtagttgctacataattttatgtttaagctttttttttggttaaatatattggttaagcttttgttacataatacaagataatatatgtcatatttaatttatatgttggatatatttacttgtatgatattgatttagagctactgtgtgtatagagtatgcagtcatagtctgatatttattaaatagacctagtgcaagaagtacgaggattaatgtcatgtacaggaattcaaagagtatatacgcctaaacttgaataattttttgtgattgtgacaatttatatgtagatgattggacagggttatctgaggaaccggtgcagcaacaagaccagactgatgcggcggggaataacggcggaggaggaagtggttactgggacgcaggtcaaggaaagatgaagaagcaacagcagcagagacggagaaagaaaccaatgctgacgtcagtggaaaccgacgaagacgtcaacgaaggtgaggatgacgacgggatggataacggcaacggaggtagtggtttggggacagagagacagagggagcatccgtttatcgtaacggagcctggggaagtggcacgtggcaaaaagaacggcttagattatctgttccacttgtacgaacaatgccgtgagttccttcttcaggtccagacaattgctaaagaccgtggcgaaaaatgccccaccaaggtatcttttgatttatcttctaagaactaatcctgaccgttcattatcttgaaatttatgtttcaaacaaaagtttaaaaaatggtgtcggaagttatggggtatggtaggggaactatagctataatcatggacagctgttctaaaagcaagtttgacaaatcacgatttctcagggttttcaattttttatttttttttgctatgtctcgcaacaaaatttaggttctaatttattaaatttttcattttgttttcatactgtcttcagcataaatatagttagatttcaatttcaattttgacagtaaacgtacgacaacgtgtcgagttagggaaaggacatagttgtttctttgtttttggctataacgacatgagatagttagatacgatatacaaatttttgcatgcattcacacatagtacacatagatattattagactttttgacaattaatagggatatttgttgtatgtatatattattatatctagttacagtctattgctcggcggataatagagggtcctctttcctctagtgatgatagtacagaatccatgagctctgtgccattgcttgtacagacgcacgttactaagaaaatctaatttatttgttttctttctaaatttgttattggttccaatattttgattattgtgttgtttttatcaaaaacctttttgttatctaattttttgggtttagttaagtgtcaagtctaacaagggttataaaaaatatctaacaactacggttataattttggtaggcatttttttttaatcattgtttaccgaattaaaaccaaacttattaggtttcatttttcctactatatatctcatgataaatgatttgtttgattatattgatgttggggaaaatgtgtaaataggtgacgaaccaagtattcaggtacgcgaagaaatcaggagcgagttacataaacaagcctaaaatgcgacactacgttcactgttacgctctccactgcctagacgaagaagcttcaaatgctctcagaagagcgtttaaagaacgcggtgagaacgttggctcatggcgtcaggcttgttacaagccacttgtgaacatcgcttgtcgtcatggctgggatatagacgccgtctttaacgctcatcctcgtctctctatttggtatgttccaacaaagctgcgtcagctttgccatttggagcggaacaatgcggttgctgcggctgcggctttagttggcggtattagctgtaccggatcgtcgacgtctggacgtggtggatgcggcggcgacgacttgcgtttctagtttggtttgggtagttgtggtttgtttagtcgttatcc

SEQ ID NO: 4425 - DNA, 3579 bp, Artificial Sequence
  P2584 (35S::G2455)
gttccttctttgatctcattgggataactaaaagtttcaagaagagaaacatatcattgaagagagaacccacacaaaaaaaaatgtctgtagatttctcatctgagcgtgtttgctatgtccactgcagcttctgcaccacgattttagcggtaatctccctctcctctttatattgtaaatctttctcaaaagaaagagtgttaatttggtacttactctgagctagatccccttttctctaacttaaatcaaactgttatataagatatatattatttacctatcaaagatggttggtgatatatctatatgtgtattgcatgatgaattttgcatctagttcatagatcaacatatatcttttctgtgattaattattgatgaagatatatataccggaaagtttcttaaatttcagaaaccctaaatcttattccttttttttcttctataacgcgtgatgagatacctaaaagaagcaaaagaagttcggtagttgaaacataaattttagtgctcaaacaaagtaaactcaaaggaaacagctcctgatcagatttagggctctatgagtaggttttaagtctacaaagataacttcttctttccctatttttactatttaaagaatttttatttttattttcgttttaaggacattttttcttcttctctttacaagtaaatccttcattttttactcttgtatattcatattttctttggtgttagttccctaagtttcaacagccattaatattttctgtaaaaggaatttggtagatagcatccatgtgatgcagtctcaaaattaaactttcactagggtcttccacctttatagtctgacttcatactatctaatcttttgatatgtataactgtagtatgtgacacatgtattatacttatatcatatcaatcatagatctttcatctacaagcgtggtccatgtaaaaatgtttacatcacatcaccagctgattattttaaaatcattttttgggttctccaaaattctctttttatgtttctcacagtgtgctgaagctattttattacatgtatatgattttaaaatttacttaaaacttcactaattatctccagctttatctaacggttttatgtgacatttaataatatccacagttcttccgtacatttttgatatgtgtgtatcagtgatatacgtctatctatatgtgtgtgtatataaattattgatctatgatccatataattaagtaatcatgagaaactaactagctaggttatgtagcttaatggtttagcgtttagacaaattaaaaaaaaaaaagtttatcatgagaaactcttgtacactgatattattcataaacgttatactacatatacataaataatggagatgtcgcacgagtctgattaggaacaaaaagggccatatttaataaaaatgttagaggtcttcttgcacaaaatagggtgtgtattgtagtggaaagtacaaaagatttgttctacccagttccagcaacaatttcttgatctatacaaaagctgcaaactgttaaatcatggccgatcttgaccacttaggattggatcctttctctctctctctctctctcgctcacacacaaaaatataagacgattataataaaaagatggtaccatcacatatgaaggactttatgggctgttgttaaggtcacgtcgttttctaacatgactgtcttctccttacaagcttcatcaaccattcttcatctctttactatcttttatcatgttgccttgaggtcttgtgtgtcagacatagaattcatcagaacccaccaaacagaaaaatacatattcttttatatatgttaaatttgatcatttgtttgttcgaatattagttgtggtaatacttctataaggttactattttctatttcatgtgataaaaatctataggactatctttacataggaaataggaaatctacaattaaccaaaaacaaggtgtgctatagcctataatggagtagtacttaacattctctctcaagagctctcgttacattagagaccagccactcgaattataaaatagtgataaaacaagacaattaacgtgtcccttataatgatcaagacatgtatgaatgattaggtaagtgtaccatacgcaagtttgttcacacttgtgacggtgagatgtggccattgtaccaatttgctatccctcaacattggagtttcacttcatcaaacctcagctcctcccattcaccaagatcttcaggtatcatattatattcattagtccttcaacatttttattattcccatttagaaatctggcttatatagtttttgaaatcatgaagcctcatagacagcacacaacctctctggtgacaaggaaagattgtgcatcgtcttctaggagcaccaacaattttatcggaaaacattgatcgtgaggctcctagaatgcctcctattcgccgtatgtctctctatttacctcttgcattccgtacatagtatttaaagtttgtgtaatatatgcaatcaccaagctaagtgagtccataattttcttttattttcatgtggcagcaccggagaaaagacaacgtgttccttcggccctacaacagatttcatcaagtaagtgttaatcctttgatgaaatatactaattaactctttcgctacaactttaataaactaaattgttaattagggaggaaatccaaaggattaagggcttgcaatccagagattagccaccgtgaggcattttagcactgctgctaaaaaatgtaagcttccttctttaccattctttttcacaaggtagattgttgctaagatagctcaaaaaaaaaaaaaatccttatcgtagcttcatcgacgatgtcagaattatatagaattaggaagaagatgcaaaaaaaaatgaaaaaaaaaaataactaaagttataaagtcttttaatactgtatttttagattcaataactctgtaaaatgtatttcttaactatttaaaaaataaaataaattattatctttttaaataacctaacaagtaaataaataaaaaatgatatacgaacacatgattggatagtagttttttttgtttgcaataattagtaccaactaattgaaataactgtggtgggagaattctagggcttggtcactctctttgaaaatataagtgtgtatgtataccaataagatagtggttctactatttataattggtggaatgtttatatatcacagtattagatgttttttaaaaataaatttgcctttcaatttttgggtgtagtgggcacattttcctcacattcactttggattaaagctggatggcaacaagaaaggcaagcaattagaccagtcagttgcaggccaaaagtctaatggctattactaaagcctttatatatatacacacatatatacacttatacgtatatatatgtgtatagatatatatgcgtgtgtatgatttatgtttatctttgtacgtacgcattaatgaatgtgtaagcagagagctgatgatggaaagag

SEQ ID NO: 4426 - DNA, 1614 bp, Artificial Sequence
  P2589 (35S::G2898)
gcgaacgaaagttcgattccgagaaagtgagagaaaatgacgaagagagctcccaagtcagggcctttgtctccgtcgtgcagcggaggctctagtcggtaagttttgtgtctggctttgataggttacagaacaagtttggctttttacacctggttttgctttgatttctctgtttagggtttaagggttctgcttagtctctctggttattactgattaagtggttagatagggaattggatatgaaagttgtgaactttatgctatccaatggcaaatgggtgagaagaagagcaaggaaagaggatgttagttagatttttgttaattgtgttgtaaaatcttggcaggaacttagagttggctgtgaagtcaagtgaaggtgcaaggaggtctacaagactgagacttcagcctttgagaaagccaaagacaagccccaagaagaaacccgttaaactccaaacgaagatgcccaagaaacctgccactgctttcttctttttcctgtaggtactctctctcatatgattccaaattgttatctaaatatttaagctcagctggacttccttaagtcttctcttaagtagaaatttgtgtgcattttgccattggtctttaggatgcgattatttatgttgttatgtgttctggttactttagaaaacatacgaagaaacacttgttgtattcattttcctcttgcctcatattgtcttatctttttggctccaaagggatgatttccggaagcaatatcaagaggagaatccagatgtcaagtccatgcgcgaggttgtagaatattactttgttggttttgtatgtcaaagtaaaacatggtggctattatgttcactttgattcttttgctaaagttgttttgttcttcattctgtacagattgggaagacatgtggagagaaatggaaaacaatgacttacgaggtaacatttgggtttcgcttttctgtcccagttagtctattgtctctatcttctaaaagtctcctctataatgttattcaaatcatagtcaaatgtatgatatctgacattgggatgactcacaaaagcaatgaaataggtttcatgttagcatatatagtggttggatagatatgttctaaaatgagtcaggtgttgccagtcttgttctttttggcgaacaatatctcattttattcttcttacctagatatctttggttgagaccttgacggaagtttcttactcctagattgtttgttcctcaactgttttgtaggaaaaggtaaagtattatgatatagctactgagaagagggaagaatttcaccgagcaatgacagaatataccaagagaatggtaccaccgttttcttcatttttccttgtttttgcttaatatttattcacatcagtgggttcttcatttttccttgtttttgcttaatatttattcacatcagtgtcccactgatgcggtgataaaacattagtctgagcttttcattttactattttgcaggaatcaggtgcccacgatgaatcagagaccgactcagactattctgaatagattactttttagtttctaccacattagaaacattgttctaagccttc

SEQ ID NO: 4427 - DNA, 2883 bp, Artificial Sequence
  P2596 (35S::G2372)
cttcattcgctgacttcgtttacactgaaaacaaatacctatgtcaccgccgtcggcaaccgccggtgacatcaaccaccgtgaagtagacccgacgatctggcgcgcttgtgctggagcctccgtccagatccctgtccttcactctagggtttactactttccacaaggtcacgttgagcactgttgccctctcctctctactcttccttcctccacctcgccggttccatgtatcatcacttcaattcagttgctcgccgatccggtcaccgacgaggtctttgctcaccttattcttcaaccgatgacgcagcagcagtttactccgactaattattcacgattcggcagattcgatggcgatgttgatgataacaacaaggtgactaccttcgccaaaattctcacgccttctgatgctaacaatggaggtggcttctccgttcctcgtttctgtgctgattccgtcttccctctgcttaattttcaaatcgatccaccggttcagaagctctacgtcactgatatccatggagctgtttgggatttcaggcatatctatcgcggtacaccgaggcgtcacttgctaacaacgggatggagtaagttcgtcaatagcaagaagctcatcgctggagattcggtggtgtttatgagaaaatctgcagatgagatgttcatcggcgttaggagaactccgatctcaagcagcgacggaggaagtagctattacggaggagatgagtataacggttactacagtcagagtagcgttgccaaggaagatgatgggagtccgaagaagacgtttaggagatctgggaatggtaagttgactgctgaggctgtgacggatgcgatcaatagagcgtctcagggattaccatttgaggtggtgttttatccggctgctggatggtctgagtttgttgtgagagctgaagatgttgagtcttcaatgtctatgtattggactcctgggactcgagtcaagatggctatggagactgaagattcttctcggatcacatggtttcaaggcatcgtttcctctacttatcaggagaccggtccatggcgtggatctccatggaagcagcttcaggtatatgatgtttttgaaatggtctttgctcttcttatctctataatgttgcgttaatggaacaattcagaatcgatcttgtatctgttgtgtgcaagcctttcatgagtagtttaagtctcatcctggttattcaaatgtcaattgggttttgaatgttgttttgattgctgtgttgttgttttgaaggtaaatattggaaacaggataagttaattcatacgaaaatgaatgttctctctcagattcatcttctataagatggaattgaaactggaagatttggcttagtattgtttgtgttgagcgtccgtgatgtagagttgcttttcattatccttctttggccacgcattgtacattgtgtttgttaaactagagttcctctgattagtcttatgagatactccttttttgccaatatattctacttcctctgattagttcctttgtttttaacttgcgtagatcacatgggatgaacctgagattctgcaaaacgtgaagagggtgaatccatggcaagtggaaattgctgcacatgcaactcaactgcatacccctttccctccagcaaagaggttgaagtatccacaacccggaggagggttcttgagtggagatgatggagaaatcctttatcctcaaagtggactgtctagtgcagcagcacctgatccaagtccttctatgttctcgtattctacatttcctgctggcatgcagggagccaggcaatatgattttgggtctttcaatccaaccggattcattggaggaaatcctccccagctattcaccaataacttcttaagtccgcttcctgatttgggaaaagtgtcgactgagatgatgaactttggcagtccgccatcagataacttatcgcctaatagcaacaccactaatctgtcctctggaaatgacctggttggaaaccgaggccccctttcaaagaaagttaactcgattcagttgtttggcaagatcattaccgtggaggagcattctgagagcggtcctgcagagtctggcttgtgtgaagaggatggcagcaaagagtccagcgacaatgagacacagttgtccttatcacatgctcctccaagcgtgcctaaacattccaacagcaacgcaggttctagctcccaaggtatattccgatctctctcaagtacaataatcaattgaatcagttgctataagcttttattactgttttgcacaaggcaatttctcttcctttcccatgaactatattatgtagagtaggaaacacaatcatgatttctgatatgacttgactgatgatgatacttgtgaaaactatctatatatctcttcagtaatcagtcgccttgaggtaattggaatttggaacttgaacattacttggattttaacttttcaatagcataagctttcctgtttcatcatatatgtttcactatacttggtatgcttttattactgctgatatttactattcctgctattttttttgggtctcgttaacggtaataaggacacagaattggctcttttatccatctgaactagacattactgtacaagtagatgaagaattatgtggttccattacaaatttgatttgcagaaagcttgaagctgctgcttatagacgattataatgttggaagatcctgaagcttggaatgatttgtacttttcttctggttgtgtgtgttttgacaggttaaaaagtgaaagaaagtggtggatctttgctggaatctccaagtcctaagtagtag

SEQ ID NO: 4428 - DNA, 2117 bp, Artificial Sequence
  P2597 (35S::G2567)
cgctattttgttcagatctgccactgtttcagcaaaaacggtcacaaaaaatatgataaatgtgatgaatccaatgaaaggtggaacagagaaaggtttagatcctcagctatggcatgcatgtgctggtggtatggttcgtatgcctcctatgaactctaaagtcttttactttcctcaaggtcacgccgaaaacgcttacgattgtgtcgatttcggtaatctccctattcctcccatggttttgtgtcgtgttttagccattaagtatatggctgatgctgaatctgacgaggttttcgctaaactgagattgattcctttgaaagatgatgagtatgttgatcacgagtatggtgatggtgaagatagtaacggtttcgagagtaatagtgagaaaacgccttcgtttgctaagactttgactcagtctgatgctaataacggtgggggtttctctgttcctcgttattgcgctgagacgattttcccgaggttggattataacgccgagccgccggttcagaccattcttgctaaggatgttcatggtgatgtttggaagttcagacatatttatagagggacgcctcggcgtcaccttcttacaaccggatggagtaattttgtaaaccagaagaagcttgtggcgggagattcgattgtcttcatgagagcggagaatggagatctttgtgtaggtattaggagggctaagagaggagggataggtaatggacccgaatattcagcgggttggaatccgatcggtggaagttgcggctactcttctctgttaagggaagatgaaagcaatagtttgaggagaagtaattgttcccttgcggataggaaggggaaagtgacggctgaatctgttatagaagcagccactcttgctattagcggaagaccgtttgaggttgtgtactatccgagagctagcacttcagagttttgtgtcaaggcattagatgctcgagctgccatgcggattccgtggtgctcaggtatgaggtttaagatggcttttgagacagaggattcgtctcggataagttggtttatggggactgtttcagctgttaatgtctctgatcctatccgttggcctaactctccttggcggcttctacaggtggcgtgggatgagccagatttactccaaaacgtgaagcgagttaacccgtggttggtggaattggtatcaaacgtacatccgatcccgcttacttcgttttcgccaccgaggaaaaagatgcggctacctcagcatccagattacaacaatctgatcaattcgattccagtaccttcattcccaagcaatccccttattagatcaagcccgttaagctctgttctggacaatgttcccgtgggtttacagggagccaggcataatgctcatcagtactacgggttatcatcttcggatcttcaccattactacttgaatagaccacctcctcctcctcctccatcctctctccaactttctccttctctcggtctccgaaacatcgataccaaaaacgaaaaaggattttgctttttgacaatgggaacaacaccatgcaatgataccaaatctaaaaagtcccatattgtattgttcggcaagcttatactacccgaggaacagctatcagaaaaaggctcaacggataccgcaaacatagagaaaacgcagatttcatcaggcgggtcgaaccaaaacggcgttgcgggaagggagttttcttcgtcagatgaaggatcaccttgctctaagaaagttcatgatgcatcaggtttggaaacagggcattgtaaagtgtttatggagtcagacgatgtaggtcgaaccttagacctatcggttcttggttcatacgaagaattgagtcggaaactctctgacatgtttggaatcaaaaagtctgagatgttaagctctgttctctatagggatgcatcaggagccatcaaatacgcaggaaacgaacctttcagtgagttcttgaagacagctcgaagattgacaattctgacggaacaaggaagtgagagcgttgtagtataacttggcagagtgttttgttggagcttggaagtcaaaactcaacgattgaatc

SEQ ID NO: 4429 - DNA, 2451 bp, Artificial Sequence
  P2599 (35S::G2885)
gaagagaggagacttgcaaacgtattgcatcaaatatggagtttggaagcactgaagatggaaggcatgacaagtttcctgtaggaatgagggttcttgctgtggatgacaatccaacctgccttcggaaactcgaagagttgctgcttcgttgcaagtatcatggtactacatattctttgcttttgtttttttttacctgtctgcttcggaattggggtgcatggtcaatgatgtttgattgattacgccagtgacaaagacaatggagtcgaggaaagctctggaaatgctgagagaaaacagcaacatgtttgatctggtgataagcgatgtagagatgccagacacggatggttttaagttgcttgaaattggtcttgaaatggaccttcctgtcatcagtacgtctcctaccattgtttttcatatcaactctagcccttattgtaacctgcttcattgtctcagtgttgtcagctcatagcgactatgacagcgttatgaaaggtattatacatggcgcttgcgattatctggtcaagcctgttggactcaaggagcttcagaatatatggcatcatgttgtgaagaagaacattaaatcttacgcaaaactgctcccaccttctgaatctgattccgtcccaagcgccagcaggaaacggaaagacaaagtcaatgacagtggtgatgaagatgacagtgacagagaagaggatgatggtgaggggagtgaacaggatggtgacgggtcaggtacgcggaagaagccacgtgttgtttggtctcaggagcttcaccagaagtttgtcagtgccgttcagcaattgggcctcgacagtgagtttccccatagacctctttaaacctttccttatgtgtgatgtccactcttgtttctcctatagagttattttgatgctttcatgtgtgggatcctcttttcatttctccttgtgttcatcacagaggctgttcccaaaaaaatacttgatctcatgagtatagaaggtctcactagggaaaacgtagccagtcatttgcaggtactaattccccattctctcttgcatttttccccttctttcgcaaatataatcttggatggttagacttgttttattctctggttttggttgcagaagtacagactgtacttgaaaaagatagacgaaggtcagcagcaaaatatgaccccagatgcatttggaacaagagattcatcttactttcagatggctcaacttgatggacttagagattttactgccgcaagacaaattccaagctcaggactcttatcgcgttcccatctcaccaaactccaaccccctatgtattcatcgataaatctccaaggaatgaactcctccagcttcatccaacaggggcatcaccagaactcaagcaattcagctaatccgtttggaacatatcacagtactctgtcaccaagaatccagaacgtgaatctgtttcagcgaacttcatctccactagaacccctccagtttcctagaagcaagtcatacattggagattttaaaggcttaggggacagagctattggcggtagcttcctagatacttgtatgccatttggtagctctagcacctctttaccaagtgcttccaccaatcctctaatgttgcaagcaaactatacacaacccctgcatatagcctcagatggaattcagccttgcatcgagggaactccgtccaactctgcctccccaaacatcagtttccaaggcttatctagatttcctggtcatagctggcaagggaatttgaacacaaccagattcccaccgagttccttaccactaaatcttgctttcttgccggatcaagtgacatgtgcagggaacaatctgggagattgtacttctttggtttctgcagagaatcctggtggagagatgcagtgtgatcctcaattacttggcggcttcatgcagaacgtgaatccgttaggcggacagaaatgggagcaacagaactgcaccatgctgaacaatccattcggtaacattgagtatcctctacccgcagataacatggttttcagagacaacaattcaaccagaagcaaaggcttggatgagtcactgatgaacccaatagacaacagtcaagagtatgttggaaaagctactacaatgctggatccagagatgaagtcgggaaagccagagaatgacaaccagcatgatgtattcgatgacataatgaatgagatgatgaaacaggtaacgcggttgttttcttgattggattaaaagcttttgtagtttgtagaaaatgaaagtgaatgtgtttgttgcaggaggagaataacggaatggtgccagtggctactagatttggctttgattcatttcctccaccttagctagtcatctctttctctaccagttgcattaagtttctccacttgagacc

SEQ ID NO: 4430 - DNA, 841 bp, Artificial Sequence
  P2603 (35S::G2650)
cccaacgacttcgtcaagcttaccagtttttctgtatcgacagaggacatgggaataaaaaaagaagatcagaaaagttccttgtccttgttgacgcaacgatggaataatccgaggatcgtgcgagtctcccgagcatttggaggcaaagatagacacagcaaagtgtgcacagttcgtggtctccgagacaggaggataaggttgtcggtgatgacagcgatccaagtctacgaccttcaagaacgattagggctgagtcagcctagcaaagtcattgattggctcttagaagttgccaaaaacgacgtcgatttgcttcctcctttgcaattcccacctggttttcaccaacttaaccctaatctcaccggccttggagaatcttttcccggggtcttcgatcttggaagaacacagagagaagctttggatcttgagaaaaggaaatgggttaatcttgatcatgtgtttgatcacatcgatcatcacaaccatttctcgaattcaatccagagcaacaagctttatttccctacaattacttcgtctagcagctcttatcactacaaccttggacatctccaacagtcactactagaccaatctggtaacgtcactgtcgcattttctaataactataataataataatctcaatcctccggcggcggaaactatgagttctctattcccaacaaggtacccttcgtttctcggtggtggtcaacttcaactctttagtagcacaagctcacaaccagaccatatcgagtagttccagctgcagattatttttagacgatctttaacaagttgaagaattcaagtcatgtgacatg

SEQ ID NO: 4431 - DNA, 1228 bp, Artificial Sequence
  P2616 (35S::G1823)
cagttctctagggttttcaatactcacaccaaagcttaatgccgatcaacgatcagtttcctagtgggttaagaatactcgttgtagacgatgatacttcatgcttgttcattctcgagaaaatgcttctccgtctcatgtaccaagttacaatttgctcacaagctgatgttgcgttaaccattctaagagaaagaaaagacagttttgatttggtgctaagtgatgttcatatgcctggtatgaatggttacaatcttcttcaacaagttggtcttcttgaaatggatcttcctgtcattatgatgtctgttgatggaagaacaactacagtcatgactggaatcaaccatggagcttgtgattatctaatcaaacctattcgtcctgaagagcttaagaacatttggcaacatgttgttagaaggaaatgtgtgatgaagaaagagcttcgaagttctcaagctttagaggataacaagaacagtggtagcctcgagactgttgttgtttcggttagtgaatgctcagaggaaagtttgatgaaatgtaggaataagaagaagaagaagaagagaagtgttgatagagatgataatgaagatgatcttcttcttgatcctggaaactcgaagaagtcacgcgttgtttggtctattgaattgcatcaacaattcgttaatgccgtaaacaaacttggaattgacaaagctgtaccaaagcggattctcgagttgatgaatgttcctggtttaagcagagaaaacgtggctagtcatttacagaagttccgattgtatttgaagagattaagcggtgaagcttcgcagagtaatgactctgagtctaccaaaagatatgaaaacattcaagctctggtttcctcaggacaattacatccacagacattagctgcattgtttggtcaaccaatagacaatcatcactctgctagttttggagtttggattcctaatgacaatcttggtagatctcaaaatgaacacttctcggttgatgtatcatccgcttctaaccgtcctgtttctgtggcggttcatggtctatcttcctcagcaaatttcagacagagaggtgacgttaacaacaacagaatcagacaagggtatggatcaaatgtcaatgaagaatcttggatcttggaaagatcttcaagacaaagatagtgaccaatatggatacgcttaagaagagaaggctctgcaac

SEQ ID NO: 4432 - DNA, 2501 bp, Artificial Sequence
  P2617 (35S::G1451)
gtttggtttcttgaagttgaattagacatgaagctgtcaacatctggattgggtcaacagggtcatgaaggagagaagtgtctgaattctgagctatggcatgcttgtgctggaccattagtctctcttccatcatctggtagtcgagttgtttactttccacagggtcacagtgaacaggtagctgctacaactaataaggaagttgatggtcacatacccaattacccaagcctaccaccacaattgatatgccagctccataatgttacaatgcatgcagatgttgagacggatgaagtctatgctcaaatgacacttcaaccattgacaccggaggagcagaaggaaacatttgtaccgattgagttggggataccgagtaagcaacctagtaattatttttgtaagactctcacagctagtgataccagtacacatggagggttttctgttcctagacgtgctgctgagaaagtgtttcctccattggattacacactgcagccaccagctcaagaactgattgcaagggatctccatgatgttgaatggaagtttaggcatatctttcggggacagcccaaacggcatctcctaactactggatggagtgtctttgtcagtgccaagcgactagtagctggagattctgtcattttcatcaggaatgaaaagaatcaactctttttgggaattcgtcatgccactcggccgcagactattgtaccatcatctgttttatctagtgatagcatgcatattggactccttgctgctgctgcacatgcttctgcaactaatagctgtttcactgttttctttcatccaagggctagccaatctgagtttgtgatacaactttccaagtacattaaagccgtttttcacacgcgtatttcagttgggatgcgctttcgcatgctcttcgagacagaagagtcgagtgtccgcaggtacatgggtactataactggtattagtgatctagattctgttcgttggccaaactctcattggcgatctgtgaaggttggttgggatgaatcgactgcaggggagagacagccaagggtttctttatgggagattgagcctctgactacctttcctatgtatccatctctttttcctctcagactaaaacgtccatggcatgctggcacatcatctttgcctgatggaaggggtgatttgggaagtggtctaacatggctaagagggggaggtggagagcagcaaggtttgcttcctctaaattatccatctgttggtttgtttccatggatgcaacaaaggctggatctcagtcaaatggggactgataataatcagcaataccaagcaatgttagctgctgggttgcagaacatcggcggtggagatcctttaagacagcagtttgtacagctgcaagagcctcaccaccaatatcttcaacaatcagcttcccataattctgatttgatgcttcagcagcaacagcagcaacaagcgtcacgccatctcatgcatgctcaaacacagattatgagtgagaatcttccgcagcagaatatgcgacaagaagttagtaaccaaccagctggacagcagcaacagctacagcaaccggaccaaaatgcatatcttaatgctttcaaaatgcaaaatggccatcttcaacagtggcagcagcaatcagagatgccatctccctcgttcatgaagtcagattttactgactcaagcaacaaatttgcaacaactgctagtccggcttctggagatggcaatcttttgaatttttctataaccggtcagtctgtactccctgagcagttaacaacagagggctggtctccaaaagcatccaacactttttctgaaccgttgtcacttccacaagcctatcctgggaagagtcttgctctagaacccggaaatccgcagaatccctctcttttcggtgttgatcccgactctggactcttcctccccagtacggttccccgctttgcttcttcatcaggagatgctgaagcttcccctatgtcactaacagattcaggatttcagaattccttatatagctgcatgcaagacacaactcatgagttattgcatggagctggacagattaactcgtccaaccaaaccaagaactttgtaaaggtttataaatctggttcggttgggcgttcattagacatctcccgattcagcagctaccacgagctgcgagaagagttagggaagatgtttgctatcgaagggttgttggaagacccccttagatcaggctggcagcttgtattcgttgacaaggaaaatgatattcttctccttggtgatgacccatgggagtcatttgtgaataacgtttggtacataaagatactatcaccagaagatgtgcatcaaatgggagatcatggagaaggcagtggtgggttattcccgcaaaacccgacccatctctagaagctgcttcggtgttagtctcatcatgctacaacgcg

SEQ ID NO: 4433 - DNA, 2090 bp, Artificial Sequence; identical to SEQ ID NO: 1025
  P2619 (35S::G1493)

SEQ ID NO: 4434 - DNA, 2790 bp, Artificial Sequence
  P2621 (35S::G446)
gcctagttagtgttgagtgtgggagagacaaaacagaacattgaaaaatctctctgtatgatggcttcattgtcttgtgttgaagacaagatgaaaacaagttgtttggttaatggtggaggaactataacaacaacaacatctcaatctaccttgcttgaagagatgaagctgttgaaagaccagtcaggtacaagaaagccggtaataaactcggagctatggcacgcttgtgcaggccctttggtgtgtctccctcaagttgggagcttagtgtattacttctcacaaggtcatagcgagcaggttgctgtttcaaccagaagatcagcaacaacacaagttcctaattatccgaaccttccatctcagttgatgtgtcaagtccataatgttactcttcatgctgacaaagacagtgacgaaatctatgctcagatgagtcttcaacctgttcactctgagagagatgtgttccctgtaccagactttggaatgctgagaggaagtaagcacccgactgagtttttctgcaaaacacttactgcaagtgacacaagcacacatggaggtttctcagtgccacgtagagctgcagagaagctatttccaccattggactactcagcacagccgccaacgcaagagcttgtagttcgagatcttcatgagaatacttggacatttcgccatatctaccgagggcaaccaaagagacatctcctaactacaggatggagtttgttcgttggatcgaagagattgagagctggggattctgttttgttcatcagggatgagaagtcacaacttatggtcggtgttaggcgtgccaatcgccaacaaacagcacttccttcatcagttctctcagcggatagtatgcacatcggtgttcttgctgctgctgctcacgcaaccgccaaccgtactccttttttgatattctataatccaagagcttgtccagcagagttcgtgatccctctagctaagtaccgtaaggcgatatgcgggtctcagctctcagttggtatgagatttggaatgatgtttgaaactgaagattccgggaaacgaaggtacatgggaactattgttggaatcagcgatttggatccgttgagatggcctggttctaagtggcgtaaccttcaggtagaatgggatgagcctggatgtaatgataaacctactcgggtcagtccatgggatatcgaaacacctgaaagtctcttcatttttccttctctgacctcaggactcaaacgtcagctccatccatcttactttgctggtgaaactgaatggggtagcttgataaaacggccacttatacgtgttcctgattccgcgaatgggattatgccatatgcatctttccctagtatggcttcggagcagcttatgaaaatgatgatgaggcctcacaacaaccaaaatgtaccatctttcatgtctgagatgcagcagaatattgtaatggggaatggaggtttgctaggagatatgaagatgcagcaacccctgatgatgaaccagaaatctgagatggtgcagccacaaaacaagctaacagtgaacccatctgcttctaatacgagtggccaagaacagaatctttcacagagtatgagtgctcctgctaaacctgagaactctacactctctggttgcagctctggtagagtccaacatggacttgagcagtcaatggaacaggcaagccaggttactacatccacagtgtgtaatgaggaaaaggttaatcagctacttcagaaaccgggtgcttcgtcgcctgtacaagctgatcaatgtcttgacattactcatcagatttaccaaccacagtctgatccaataaatggattctctttcctggaaactgatgagctgacatcacaagtctcttccttccagtctcttgccggatcatacaagcaaccattcattctatcctcccaggattcttcagctgttgtgttaccggattccacaaactcaccgctgtttcatgatgtgtgggacactcagttgaacggtctcaagtttgaccagttcagtcccttgatgcagcaggacctttatgctagtcagaatatctgtatgagtaatagcacaaccagtaacattctagatcctccactctcaaacacagtccttgatgacttctgtgccatcaaagacactgatttccagaaccacccttctggttgtttggttggaaacaacaacactagctttgctcaagatgtccagtcgcagatcacatcagctagctttgcagactcacaggccttctctcgccaagattttccagataattctggaggcactggtacatcttcaagcaatgttgattttgatgattgtagtctgcggcaaaatagtaaaggctcatcatggcagaaaattgcgacaccccgcgtccgaacctacactaaggttcaaaaaaccgggtcagtcgggagatcaattgatgtcacaagctttaaagactacgaggagctaaaatctgctatcgaatgcatgtttggattggaaggactactaactcacccacaaagctcgggttggaagcttgtatatgttgattatgagagtgatgttctgcttgtaggagatgatccatgggaagagtttgtgggatgcgtaaggtgcataaggatattgtcgccaactgaggtccagcagatgagtgaagaagggatgaagcttttgaacagcgcaggcattaacgatcttaagacttctgtttcataaatgtaacaatataaaaatgatctc

SEQ ID NO: 4435 - DNA, 1743 bp, Artificial Sequence
  P2623 (35S::G2184)
gagggatcggttttgatttgttacgtagatggcggattcttcacccgattcgtgtttcaaaggaggcaaatttagtgctccagggtttcgatttcatccaactgatgaagagcttgtgatgtattatttgaagaggaagatttgtaggaagaggcttagagttaatgttatcggtgttgttgatgtttacaaaatggatcctgaggaattgcctggtcaatcaatgttgaagacgggagatagacagtggttctatttcactccaaggagtaggaagtatccaaacgcagctaggtctaatagaggaactgaaaatgggtattggaaggctacagggaaggatcgagtcattgagtataattctagatcggtgggacttaaaaagactcttgttttctatagaggccgggctcctagtggtgagcggactgattgggtgatgcatgagtatacgatggatgaagatgaactagggagatgtaagaaccctcaggagtactatgctctttataagttgttcaagaaaagtggggctggtcctaagaatggtgaacagtatggtgctccgtttcaagaagaggaatgggttgatgatgataatgaagatgtgaatgctattgctgtagctgtgccagagcaacctgtggttcgttatgaggatgctcgtcgtgtggatgagaggagactttttaatcctgttattcttcagttagaggatatcgatgagcttctcaatggaatccctaatgcacctggtgttcctcaaagatgtattcctcaggtgaatagtgaagaagagctgcagagtacgttggtgaataattctgctagagagttcttgccaaacggtcagcaatacaacaggccctcaagttttgactcattagagaccgctgaggtcacctcagctcctctggtgtttgagaaggaagatttcattgaaatggatgatcttcttctgatccctgaattcggagcttcttcaactgagaaagccgcacagttctcgaaccatggtgaattcgacgattttaatgagtttgaccaattgttccatgacgtttccatgtctttggatatggaacctattgatcagggaacttctgcaaatctgtcttctctgagtgattctgctaactacacatcagaccaaaaacagcaactcctttatcaacagttccaggaccagactcccgagaaccagctgaacaacatcatggatcctagtacaactctcaatcaaatcactagcgatatttggttcgaggatgatcaggccattctatttgatcaacaacaatccttttctggagcatttgcttcaccctcatcaggtgtgatgcctgattccaccaatcctactatgagtgtgaatgcccaaggccatgaaatccaaaatggtggtggaacaacaagccagttctcatcggctttgtgggcattaatggactcaataccttcaacgccagcctctgcgtgtgagggtccccttaaccgaacctttgtacgtatgtctagcttcagccgtatgaggttcaatggaaaggctaatggaacgccagtgagtactaccatagcaaagaagggtattagaaacagaggttttcttctattatcaatcgtgggtgctttgtgtgccatcttctgggtgttggtagccacagttcgagtctcaggtagaagtcttctcttgaaagactagtggtggttctcttgaactcttaactactggtaagttagaag

SEQ ID NO: 4436 - DNA, 1264 bp, Artificial Sequence
  P2633 (35S::G2967)
caacaaaccccgtgtatttcgcgcctaaatggaagacgaacatcaagatctccataaacccattaatggagctttgcgagacctcaagattactcggtcacagaaagaaacagaaaagtctacgaaccaacagcaagatgttacttgttactatggtctaagggaaaactcgaagaagaaaacccaggaatctccggaaccaatgaagaagattttgtttcgatgcgaagaatgtggaaaagggtttcggtacgagaaatattttaagaatcatcgctcgatgatgcatttatcgccgaacgagaaggtttgtgaagaatccttgatgactctgtctcgtagccttgggtttgtgaagaagaagaaaagatcaagacttggtaggtctgggaagactttatttactacgtttcttgaaccgagttctatttttgatgcgactgatgaagaattagaagtggcggattgtttgattctattgtctaagagtgctcccaaggttgtagacgaattgaaaagtctttctgaggcagtacgtgttactcctgaaacacctgaaagtagctatgatttgggttgtttgctcaacaagaaaccgagaaaaggtggtgaattggaatctggggttttaagtaatgagcaaagacttatggaagaagggtttagtagttatggaacatcgaaagaaccagctagcttcttgagagacgaaaacagattggatcagcagaaacggagaaaagatggtgaatttgaatccggacttttgagtaatgagcaaagactgctagaagaagagattactactcctgtgacattcaaaggtccagcgagttccttgagacacaagtgtgctttggatcgaaatggaggtgaatttggtcctgagtttttgagtaatgagcaaacactgatggaagaaacatggaaagaaccagtgagtttcttagaagataagcatgaatttgatcagcggaaaatgcgagaagctggcgactttgaatctaggttttacagaattgagcttggagtaggagctatggagtgtacttcttcagatactgatatgctcacgcaatctgataagaagaacgttgagcatcgatgcaggttgtgcaacaagatattctcgtcttatcaagctctagggggtcatcagacgtttcatcggatgagcaaatgtaagaacaagaagaatggcatagaggaatcagttgaacccaggatgactctgtgagatgctcagtgagaagtgtagcatccg

SEQ ID NO: 4437 - DNA, 1068 bp, Artificial Sequence
  P2635 (35S::G2972)
ctatgagctttgtttcaattttcaggtttttgtcggcgaaatgtctcagagacttcatggttgcaaaacatgcgggagaaagtttggaactttaaaaggtgtgtatggtcaccagaggatgcattctggtaatcacaatagaatcgaagatgagaatggtttggaaaggatttggggtcttaagaagaagtctagggtttgctctgtttcagcttttgatcgattcaaaggatcttcttttatggctgagattgagaaacatgaggtgattgaagctgcattgaacttggttatgttgtgtcaaggagtttatgactttgcttctatcagtaatttgcctctaggtgatggtttcatggatttagagcttaaaccttgtcctttgagaaggaaactacagaaaaaatctcgctccagttataaatgcagtatatgtgagaagagttttgtgtgttctcaagctcttggtagtcaccagagacttcacagatggaaactagtgcctaaacctgagtacattgaagatgatagttcactgttagactcatcagaagctaagaagattgtttcaaaaccatcaagctttgaacatgctcaggaggagaagatcttacaatgtgttgagccgaaactagagttccacgaacagcttgctcactcgggtttcgacaagtttgatacttgcagtaaaatcaggttcagtgcattaccttctcctccagaagctaagaagattgtttcacaaccaccaagctttgaagtctctgtggatgaaaagatcttatatcgtgctgagccaaaactaaacttcagcgaaccgcttgctcactcgtgtttcgacaattctagtagctatagaagcataatatgtggcaagagttttgtgtgttcacaagcattaggtggtcaccaaacacttcacagatcgattaaaggccaattagcgggtactgaagatggtaattcactctctgtgactgactcagaagctagcaagattgttgcacaaccatcaagctacaagtctcaggggatataaaaatgtcagtgctttgatgtttccaagtc

SEQ ID NO: 4438 - DNA, 494 bp, Artificial Sequence
  P2641 (35S::G1993)
ctccctcgcgcgatatcatatacaaatgaatagaaaatacttggatcgtcgatcatattcatggtccggatcacaagcaagaccatacatatgcgaattttgcgagagaggtttttccaacgcacaagctttaggagggcacatgaacatccacagaaaagacagggcaaaacttcgacaagcgaacctaaaagaagaagacagtgaagatgccatttgcaccacttcgagaaatcggtttgggcaagagcttattgagttacctttcttcgttgatacggtcggtccaagaagaaaaggagaagatgataaaagcgaaaaaggtttaggagatgaagaaaagaaaaatatgaggatacttcaaaaggctttatctcaaagtgcagacgtgatagatcttgagctccgtctaggattagatccttataaaaaaacaacaagtacaagtacgtaactaataactatatatgtgaatactttaatccccaagtttg

SEQ ID NO: 4439 - DNA, 609 bp, Artificial Sequence; identical to SEQ ID NO: 1307
  P2643 (35S::G1985)

SEQ ID NO: 4440 - DNA, 549 bp, Artificial Sequence
  P2644 (35S::G2604)
gagattgagagaagagatttatccaaaaaaatattgcaattcttcttggagtgaataatgccagtccctcttgcaccatatccaacacctccggcaccggcactggctccgtcgtacaacactcctccggcaaatggaagtacaagtgggcagagccagttagtgtgttcaggttgcagaaaccttctgatgtatcccgtcggagcaacctccgtctgttgcgccgtctgtaacgccgtcacggccgttcctccgcccggaacggagatggcacagttggtatgtggaggatgtcatacactcttaatgtacattcgtggagctacaagtgttcaatgttcttgttgtcacactgttaatctcgccctcgaagcaaaccaagtagcgcatgtgaattgcggaaactgcatgatgctactaatgtatcaatatggagcaagatcagtgaaatgtgccgtttgtaactttgtcacatctgttgggggttcaacgagcacgactgattcgaagtttaacaattaaaacttggatctatctacctatcaatac

SEQ ID NO: 4441 - DNA, 1499 bp, Artificial Sequence
  P2647 (35S::G1968)
gcatctgtcaagctttctttgaagataaatttgaggtaaaaatcaaactaatggcttctctcactttttgtttctacttcttcttatgatcttttgtctttgttttgatcagatggagcagttcaaagagaggaagtttgtttgtaagttctgtagcaagaggtttccttgtgggaaatcacttggaggtcacatcagaactcacatgaatgagaattcagctgattcagatgaagatgaggctgataagctcaagatgattgatgaaaatggtggtcaatctagttatggtctgagagagaatcctaaaaagaacaagaggtttgtggatcacagacagattatggctctgaaacagcagcagcagcagcaacaacttcaagagctgcgtcgttgcagagaatgtggtaaaggttttgtttcttctaaagctctttgtggtcacatggcttgtcactctgagagagagaagattgttatggatagtcaatctgatactgaggcttcttcctctcctatcagaagaagatccaagagagttgttgtgaaacctcaccacaaagctgcttttgtagttggtggtaatggtattatgaatcaatctatttcagcttcttctgatgcttctgagattgagcctgaacaggaggaaatggcaaggtctttgatgatgctttcgagggattctagttttaagaaaggacataactctttggctgagtcatctgacaacaactctgtgattcttgagactaagtcatcttcaggtgagcaggttaagatgttcaatgtgaagaatgttgaagagttatgtaagaagaacaaacttgtagttgataaccagatgaggtctggtgaagaaaatggtgatgttcattatgattcagataattctgactctggctacttcaggaatggaccaaagaagttggactcagatgtttctgttgatgggttctttaggaacaaaacaataatgggatctggatccggattcaacagctccccaacaaaacaagatagggacatgaacagattcaggaaggaatggtataaggaaggagggtcagggtcaggatcaggatcaggtcgttcttctacaaagtatgatctgaggaaaagcaaaagaggttttccttctcatggtcgtaagaaaatcaagtatgagttcactgaatctgtctatgacagtggtgagcatagcttggaaactgactcttgtgcggacacaaacagaactatcaagattcatagtaagtctccaatggttaagaaagcaaacggtgcaaagaagaaaagcaaaggtcacgagtgtccgatttgcttcagggtgttcaaatcaggacaagctttaggaggtcacaagagatcacatttcattgggaatcaagaacacaggactttggtgattcaacatcaagtagctcatgagatgcatacactcatcgatctcaatcttcctgctcctattgatgaatgatcttactaaaaccgaaacc

SEQ ID NO: 4442 - DNA, 989 bp, Artificial Sequence
  P2649 (35S::G3059)
ccaattttctcgaattgtcaccgggaaaaatggaaaacaaaatcgcgccgtttagttacagcggaagctccgccggaaattcatccagtggcggcgtcgtttcgtcgtctctctactctgatcaactctacaagtcgactcgcaacataatgcaacagcgtcaagatatggtgaatcgcgaggcgttgtgttacacgcgtctccatgaggcttcgcttgaagcagaagcgcttcgtctagagaacactgaactccgatcgatgaatcttcgtctcaagaatgagctcaacagtctcatcagatcttcgatccagaaccgatttgatcatcgatctccgcttcggatgcttagcaatctttcgatcggaggtaatgacgccgacgaagtggagaatcagaaccgtacggttaatcgcgatgacgtcaatgataagagtccgacgagtgttatggagaatgaggatctgaatcgctcttcgcttccaaagagcatctctgtgagatctaatggctactctaaggcaagtcagggaggtggtggtgcggctgctcaaagtggaaaacctcgtggaaccgtcactaagcctgggacttgtggtcaagtcagtactacgcagaaggtgtatgtgcgaggaggagggaagaaagaagatcaggaggaagagatagaagtggaggtgtacaatcaagggatgacaaagacagagctgtgcaacaaatggcaagagacagggacatgcccatatggtgaccattgccagttcgctcacggcattaaggaactccgtccagtgatccgccatccccgttacaagactgaggtttgcagaatggttcttgctggtgataactgtccttatggtcaccgttgccacttccgccactcactatctgagcaggagaagctcgttgctgctggtttcaaacccaagtcatccctcaagctgatcacatgacctgaccctggtttcaagtcctccttcaagctg

SEQ ID NO: 4443 - DNA, 577 bp, Artificial Sequence; identical to SEQ ID NO: 305
  P2654 (35S::G366)

SEQ ID NO: 4444 - DNA, 2130 bp, Artificial Sequence
  Artificial sequence
  P2656 (35S::G2888)
cttcctccaataccaccatcgttaaacaaaaaaaaaaaaaaaagaaagatcatccaatgatacattacgaacaaaacaacaaccttcagaaccttccatcttcatcttccaacgatcttcttcttggcatcaatggagctgacgcaacccataagagaaaacggagacccgcagggacaccaggttcttaatatttcctcttttacgttttgaatttttcttattgtctactaggttttctataatctttttggattagttttctattaagttccaaaaagtgttgttgatattactctgtcaagatttctttttcatttctaatgttgggttgccaataatttagcacaagattttttatttttgagattgttttttaccatataatttagaaaatcattttttatcttctgtatcggagctaacagatccagatgcagaggtggtatctttgtcaccaagaacgttactagaatcagatcggtacgtgtgtgagatctgcaaccaagggtttcagagagatcagaatctacagatgcatagaagacgacataaagtgccatggaagcttctgaagagagacaagaaggatgaggaagtgaggaagagagtctacgtgtgtcctgagccaacatgtctccaccatgacccgtgccacgctcttggagatctggtcggaatcaaaaagcacttccgccgtaaacacagtgtccacaagcaatgggtttgcgagagatgctccaaaggctatgcagttcaatctgactacaaagcccatctcaagacctgcggttcacgcggtcactcctgcgactgtggccgcgttttctccaggttctttctcatatatcatcatctctaactgtgtgtatatctataaaaaaaagttttgttaacttagtcgatgttttgtggaaaaccctagctattctatcggctctatactgaggattagtttctcttgggttctccaaatcttttaattttctttgaaattttatttatacaatttaactttctaggtaagattataattggaaatatggaatccttaaactaaaccaaagaatgttttataggatggtgtgtaatgttgttacattacaggtatattttatctataaggcatatagatttgtttttttttaatgtgcatatatagattttgacacagcctaccaatagaagctcagcttgactgttgccagattattttaatttacatatgaagtcacgttgatacccattatggatttccattaccaacactttgttctattttgttaatacacaaactaaaaagtcttataatcacataatacctttccaaagatatctaagtccataactcaattttctattattgctttttcatttgattacgtacgtacaccatcaaacactattgtgttttgttttcaattcttttggttatccactactagctcattcttaattcttctcttgttcttttttcagggttgagagtttcatagagcatcaagatacttgcaccatccggcaacctcaacccaccaaccaccgtcatctacagcagcacacgatgggccttgacgctccatcaagaaccacttcgacagcaagcttcggccctttattgcatggacttcctttgttaagacctccacgaccgtccaatcaacattcaccagcttttgcttaccctttcaatgcttcatcagctcctttcgaaagcctcgaacttcaactatccataggaatggcaagaacatcagcacaagcgaggcacaacgaaaagagagagacgagtttaacaaaggagagagcgaacgaggaggcaaggaaggcagaggaaacgagacaagaagcgaaaaggcagatagagatggcagaaaaggattttgagaaagctaagagaataagggaagaagcaaaaaccgagttggagaaggctcacgttgttagagaagaagcaatcaagaggattaatgcaacaatgatggagatcacttgccactcttgcaagcaactatttcagctgcctgttacggctgatgagagtacgtcgtctcttgttatgagttacgtttcctcggcgacaactgaaggagaatgcgagtgatccaatgcatcttcatatatatatcc

SEQ ID NO: 4445 - DNA, 2255 bp, Artificial Sequence
  P2657 (35S::G3061)
tttttttttttttgtctcttcttacatatgaatcaagacatgatgattccacataatcatgaccgcctctcattctctagctttgtccatgaccaagagcacatcacccctaatccttaccctaactctcagcctgcagcctccactaaaacacccaagaaaaagagaaaccttccaggaaatccaggcatgtgtatatataattttatatgttctccatgggtctttaataaagctctagcttgatgtgttttcatcaaaatcaataatctttttccaagtatagatcctttgtgttttcttttttctttcttgatactgttttatttttattggttctaattttgtttctaacaacaacaacaaaaaacagatccaaatgcagaagtcatctctctatctccaaaatccctcatggcgacaaatcggttcttttgtgaaatttgtaacaaggggtttcagagagaacagaaccttcagctccacaaaagaggccacaacctgccatggaagctgaagcagaaaacgaacaagaatcaggtgaagaagaaagtttatatatgccctgagaagagttgcgtccatcatgatccagctcgagccctaggagaccttactggaataaagaagcactttagcaggaaacatggagagaagaagtggaaatgcgataagtgttccaagaagtatgctgtgatatccgattggaaagctcataacaagatttgtggtagcagagagtttagatgtgattgtggtactcttttctccaggtcattactactctttctacgtcttcgtctgcagcattatcgtttgccttaacatgttcatatatcaaacatttttaaaaattgtaacaacggaaaaaacgttttcaaatcttcaggtttgcatttatttgaagtgtttgataaaaatataaatataaacgtaaaacacaaaacatatttgaattatatttgaaacaaaccgggtcttataattggacatcgaaacagatgcatgcatacataaaagcatgatattgcctatgctagaaaaataaaaagttattgagtttactttatgtatagcgagtacgttggtctttggctcgtagcttgtcatttggataccactaccgttaattatttcttggcttctctgtgtcttggtccagtttgtagttttatagagacaccaatatcgaggagaaaaaaggctgcatgactaggacatgatgtggtcatgtctccatagccttgagtcttttttttttcaccttactacacatatcgattataagcttgcatcgaataaagagttgcatatataccatatacaagaagacctattttaatttaatttatatgttaccaattagcctatattaacatagttactttattgaatgatttggttgattgtaccaggaaggacagtttcatctcacatagatccttctgtgatgtcttagctgaagaaagttctaaattcttctcagttccttcaccattagccgccaattcgaccatcgccactgtcactgataccaacaatccaattctcattcaatcacaattggatcaatcttccacaggtacggccgatcttaacgtcaacaacaatcacaccaccctatttggacaaaagttcaccaactccaacccaacccaacaacaacccaatgctttggcgttgtcctcaccaccatcacctcgtagtacatctgattcggttcataatctatggaagttacaagaagaggaatgtgcacaccagtggttactcaatgaatatatgaacaataacaaaaacatattccataagggaatattcaagaatcaagaagatgagataaagaagggaaatatctacagcggctcaaacccaaccgatggaaacatagcatccttgttctcgtataatcaagaagcagtgaatatggcttcattttcggcaacaacattgcttcaaaaggtagctcaaacgggaacaccatcaagctccgaaactagcaccaccatgtttgggcaaatgacttcctccatcttcaacaatacgatgctaaactcctattgtttaacggcgaagaataatgaagaagagttgaccagagactttcttggtgtgggaagtagtgaggaccaacaacgtctacatcgtcatcgcttcccatcaagcgtgccattgacggcgaaccatgatattcccaagttggccgcaaccattgtaggcaggaagcaaccatagacatggcgtcatctgattct

SEQ ID NO: 4446 - DNA, 856 bp, Artificial Sequence
  P2663 (35S::G1832)
ctgtcttctctctagtaagagactcaataataatgtcgaacacttcaaactccgatcccaattccgatatcccatttgcttcctccaatgtaactcttcctagttacaatcaaaacccaagaagaaaacgtactaaactcaccaacaacgaagtcggttcttcttcgtcttctccaaggcctaaaccggtcacgcaaccggaccctgatgcttcacaaatcgcacgaccatgtactgaatgtggtaaacaattcgggtcactgaaggcactctttggacacatgagatgtcaccctgaacgtcagtggcgtggcatcaaccctccttctaacttcaaacgtaggatcaactcaaacgctgcgtcatcatcctcgagttgggatccatctgaggaagagcataacatagcctcctgtttactaatgatggctaatggtgatgtcccaacccgttcaagtgaagttgaggaacggtttgagtgtgatggttgtaagaaagtgtttgggtcacatcaagcgttaggcggacatagagcaacacataaagacgtcaaaggatgtttcgccaataaaaacataaccgaagatcctcctcctccacctcctcaagagatcgttgatcaagataagggcaagagtgtgaagttggtctcggggatgaatcatcgatgtaacatctgttctagagtgttctccagtggtcaagcgttaggaggtcacatgagatgtcattgggagaaagatcaggaagagaaccaagtcaggggcattgatcttaatgttcctgcggcgacatcttcagacacaacgttaggttgttccttggatcttaggttaggactttgatatatgataac

SEQ ID NO: 4447 - DNA, 1383 bp, Artificial Sequence
  P2668 (35S::G2832)
cttctctgtatcagttttgtcggtttatgcagcactcgtcttcattcatagattttgatttgaggtaaactaaactcatcagatattaaaaatgggttctttacttctttcgatttcgtgtgtaaaggagaaacctttattgattctttcttgcttgtttgctgtttgatcatttgtctaagagaagaaggtcaaattttcaaatggaggaagggaaagagaattcgtttttgtgcaagtactgttacaagacgtttccttctgggaaagcactcggtggtcacattagaattcatacgaacgagaattcagttggttacaatggcaataagaagaagaggttggtggatcagagaaagatgatggctcagaaacataagcaacaacaacaagttggttgcagagaatgtggtagagtgttcgtttctttgaaagctcttagaggtcacatggcttgtcacggtgaggtaaagaagatgttgatggatgataatagccaatctgatactgaaagtgagacttcctcagctcctatgaggaaaagatccaagagggtggtcatgaaacaatcaaattctgaatctttgagtaatgggagctcgtcttttggttctgagattgaccaagaacgtagggatggggcttataatttgatgatgttgtcgagtgattctagtagtttcaagaaaagacgtaacatggtgatgaattctcttggtgagtcatctgacaacaactctgcgattgttgagaataagtcatcttcaggggatgagtttaagatcatgaatgtgaagaatgcagtagatgaccaatggagatctgctgatgatgatggagttagtctctgtgattcagatggctctgattctgattacttcatgaatggtccaagtaagtcggagtcagacatttctgttgacaggaacactggatttggatctggattcaacaactcattgatcaggttcaggaatagtaatgagggaggaacaaagtatgagctgagcaaaagcaagagagccttgttttcttatgaaactgattcatgtgcagacacaaacagcaagattcatcataggttcaaagatagcaaatcctcaatggttaagaaagaaggtggtgagaaggtgaagagcaaaggtcatgagtgcccaatttgcttcaggatgttcaaatcaggccaagctttaggtggtcacaagagatcacattccattgcaaaccacgcagctgaaatgcgtaaccaaatcgatctctatcttcctgtttcggatactgatgaatgaatcagaacctgagaactatagttctctctgatagtatttcatccccactttttgtttgttttctttgctccacattttagaactagatcaaaag

SEQ ID NO: 4448 - DNA, 1209 bp, Artificial Sequence
  P2675 (35S::G2640)
gttatgggtggtggttgttgtcttggtgaatggcggggtttttctcgctagacggtggtggaggaggaggcggaggtggaggtaacaaccaagaagatcaccggagcaacacaaatcctcctccgcctgtatcagaagcttggctctggtatagaaaccctaacgttaacgcaaacgcaaacacaaacgttaacgcaaacgctccttcttcgtcaaacgctgctttaggaacacttgagttatggcaaaaccacaatcagcaagagatcatgtttcagcatcagcaacatcagcaaaggttggatctttactcttccgccgcaggtttaggtgttggaccaagtaatcataaccaattcgatatctccggcgaaacttcaaccgccggcgccggaagagctgcggcgatgatgatgattcgtagtggtggtagcggaggaggaagtggtggtgtgagctgtcaagactgtgggaatcaagcgaagaaagattgttctcacatgaggtgtagaacttgttgtaaaagccgtggcttcgagtgttctactcacgtgagaagcacgtgggtccctgctgctaaacgccgtgagagacaacagcaattagctacggtccagcctcaaactcagctgcctcgcggtgagagcgttcctaaacgccaccgtgaaaatttaccggcaacttcatcgtctcttgtctgcactcgcataccttctcattcagggctagaagttggcaatttcccggcggaggtgagttcatcggcggtgtttaggtgcgtgcgtgtgagctcagtagaagatggagaagaagagtttgcttaccaaacagctgtaagcattggtggtcacattttcaaaggcattttatacgacctcggtcctggaagtagtggtggcggaggctacaacgttgttgccgccggtgagagctcctctggtggtggtggagctcaacagctgaatctcataacagctggctctgtaaccgttgctaccgcttcttcctctactccaaacctcggtggtattggcagctcatcagccgcggcagccacgtacattgatccagccgctctttatccaactccgatcaatacattcatggccggtacacaattctttcccaacccaagatcatgaggaaaatctgacataaaagcaacataactcttttgaattcttagaatagaattagggtttataaacg

SEQ ID NO: 4449 - DNA, 2434 bp, Artificial Sequence
  P2702 (35S::G2981)
gaattctccagtagcgcggtagttagttttaggtggaagaagaatgacaactactgggtctaattctaatcacaaccaccatgaaagcaataataacaacaataaccctagtactaggtcttggggcacggcggtttcaggtcaatctgtgtctactagcggcagtatgggctctccgtcgagccggagtgagcaaaccatcaccgttgttacatctactagcgacactacttttcaacgcctgaataatttggacattcaaggtgatgatgctggttctcaaggagcttctgggtatgtaaaccacctcaattctgtgatttttatattaaaaggctttgatgtgtttattgtgatgtttggtttagcgatttttagggttttcattctattgcaatggctgcttttatgagcttaatgaatatatgaaactgaaccagtagatgtaagtatgatgtgtggatcatacttttacaagcttgaatttggctctcctgatatgtattagtctaaaatctactaataatctgcatatttgaatactcatctttcctatccttattgggacaaaagatactgtttaggccattgtctttgtgcgttaatttttgtgtggaagttgttacatgtgttctgtgtagtttagttgatcatataatctatttacagtgttaagaagaagaagaggggacagcgtgcggctggtccagataagactggaagaggactacgtcaatttagtatgaaaggtcttatctctttctctgcccctattatgctttcatctaaatgcctttcaagtttctagctatgaattgtgtggataatgcctcttaagattggttatacatttaactgatattatgttcgtctggccttcctttcagtttgtgaaaaggtggaaagcaaaggaaggacaacttacaatgaggtacggtagtttcctttttaaacaaaaagcttcacagtatttatgctttgcaagatccattcacttctgtttatgttatatgatgatactgatttattgtgcttaccagtgtgattaaacacttgtcaagatcacatatgggaatatcaatttgtctcatgattagtactgcaaacgtgtagctctgtaatacggtatctaacaggtgatagtactttcaggttgcagacgagcttgttgctgaatttgcacttccaaataacgatggaacatcccctgatcaggtatgcgtttcttcgatagtttctaccctggaacgtgtgcaatactcgttgtgaactctgatgaaattatatcatgtgaaaacgttttaccagcaacagtatgatgagaaaaacataagacgaagagtatatgatgctttaaacgtcctcatggctatggatataatatccaaggataaaaaagaaattcaatggagaggtcttcctcggacaagcttaagcgacattgaagaattaaaggtttcaaccacatattctatgtgcagatgttccatagcttgtttagagaattttcctgaatttgaattattttgttttgcagaacgaacgactctcacttaggaacagaattgagaagaaaactgcatattcccaagaactggaagaacaagtaatgaacatcatcgatactctcggcttatctgcttcctgttacttttatcatagattcttacatggtccttctatcatctctgtgtatgtctgaaagtatgtaggccttcagaatctgatacagagaaatgagcacttatatagctcaggaaatgctcccagtggcggtgttgctcttccttttatccttgtccaggtaaacttcaccaacagcttcgtatgatcttagattgatccacaaggaaacctcagaaaaatgaaaaaatcacctgattgttgttgtttctctgcaccagactcgtcctcacgcaacagtagaagtggagatatcagaagatatgcagctcgtgcattttgatttcaacaggtaaaatccaaacaccagatttgatctcttttcagctaatatatctatggaaccgattactgacactgtgacaactgttttcactatttgcagcactccatttgagctccacgacgacaattttgtcctcaagactatgaagttttgtgatcaaccgccgcaacaaccaaacggtcggaacaacagccagctggtttgtcacaatttcacgccagaaaaccctaacaaaggccccagcacaggtccaacaccgcagctggatatgtacgagactcatcttcaatcgcaacaacatcagcagcattctcagctacaaatcattcctatgcctgagactaacaacgttacttccagcgctgatactgctccagtgaaatccccgtctcttccagggataatgaactccagcatgaagccggagaattgaaacacgtatgaaggccccttgtacaatttctg

SEQ ID NO: 4450 - DNA, 1980 bp, Artificial Sequence
  P2703 (35S::G2982)
caactaattgatttgatttcgtgtagctaactttgttaattggtaaattgtgtagagaaggatgagtatggagatggagttgtttgtcactccagagaagcagaggcaacatccttcagtgagcgttgagaaaactccagtgagaaggaaattgattgttgatgatgattctgaaattgggtcagtgttaattattcttcttactcacaaagtctctggtttttttacttggagctaaaatgtctgtattgaatttgtgtttaaaagatcagagaagaaagggcaatcaagaacttctggaggcgggcttcgtcaattcagtgttatgggtcagtgatatatctctcttagctcaaacatgcctgaagtgaaagtattgttgttttgctgattttgatttaacttcacacagtttgtcagaagttggaagccaagaagataactacttacaaggaggtattactctctttgttccattaaggaattggtgatgtaatcaatgagttttcagtttaagacgcattagaattgatctttatatgaacaagtattcacttcaagaagcaatcctctaagttagttgttgagcattgtctcaaattcttcttctaatcaggagtcttgcccttatatagaggcattgtatcagaaaatgtgaaaatctacgtttgagactgtggctcttgtgattccaggttgcagacgaaattatttcagattttgccacaattaagcaaaacgcagagaagcctttgaatgaaaatgaggtatagcgagatggaaagctcatatcatctgtcttgagttatttggaaaaaaaaaaagctataacaacattctcttatgttcaatcagtacaatgagaagaacataaggcggagagtctacgatgcgctcaatgtgttcatggcgttggatattattgcaagggataaaaaggaaatccggtggaaaggacttcctattacctgcaaaaaggatgtggaagaagtcaaggtttagcttccaagcttttcctttcagttatctcatctatgtaattgctctctctcttcgtcttctctactaatctctctacctctatttgcagatggatcgtaataaagttatgagcagtgtgcaaaagaaggctgcttttcttaaagagttgagagaaaaggtgatcttctttctgtttgatggaaaatttaaatacaagactctcttagaatttgagatcttgttatgcatgtcaatagatgacaaaagttattgatattgcaggttttctagaatccatagatacgtcgtgtattgaatcattttatgttgtcttaatgaaatgttaaaccgtctttctacgttttgcttataatgttactcaaatgttgttatcatcaggtctcaagtcttgagagtcttatgtcgagaaatcaagagatggttgtgaagactcaaggcccagcagaaggatttaccttaccattcattctacttgaggtacttcaaaaatctctttctcgtccgtagtttctatttcatgtttttcgatatcctaatctatttccatctctatagacaaaccctcacgcagtagtcgaaatcgagatttctgaagatatgcaacttgtacacctcgacttcaataggtaaaaataaacaacatttcttctcaaaatcaaaatcagttctgctatctcttaaatcggaattgaaatcttcgtaaattttgttgtgagcagcacacctttctcggtccatgatgatgcttacattttgaaactgatgcaagaacagaagcaagaacagaacagagtatcttcttcttcatctacacatcaccaatctcaacatagctccgctcattcttcatccagttcttgcattgcttctggaacctcaggcccggtttgctggaactcgggatccattgatactcgctgaccgagcttctattcccaaattcttcaagaagaagaagtaatgatctaattggtatac

SEQ ID NO: 4451 - DNA, 927 bp, Artificial Sequence
  P2704 (35S::G1472)
gacatcactcacttctaactgtcagcaaagttttacaaaacaaattatgaacaaccaatctatgtcttcttcaagctcctcctccccacacaaacatgatcaaaaactcaaaagtgcccttgtggccgtggaggagaaggagacaataaacaatccgaaacaaaggtctcctcaagagattgtgtctgaaaggacaaaccttgagatgcctagtttcagattaagttttttccgaaagaaaagagataccgtgctaatacatcctcccaaggataacaagatcagccacacctgtcgtttctgcaagaggaatttcaaaagctgttttgccctaggcggtcacatgaagtgccacaaaaaggaacgagaattggagaagcagcgaaagataatcgaggatgcgatgctttgtgatagtactcctttcaccttgcaaaggcttcctgttggcccttgtaagtatggccaaggtggtagctcacatgctttatcaactgatggtattaatcttgatctaactcttggtccatccaagtccacaggaggcagcaacaatagcactaataacaacactaactcatcgttccatgggaatctaatgactcccgtgggtccttgtgtgcctagatacagtttggttgctggaaaccaggttgattcaagcaatatacatgttcctgcttatccaaccaccgatctttgttatgatttttttgctttacaagagcatggttcgggctctagtcactcaaaaagtctcatctcaaaggggaaaaacaaagtcatggtgcctgaagatgatgaggatatcgggatgataaggtggttgcccaagaaaaaaagatcaagaggagagtagtaatttatctatgtccctttgtgtttttcagttttctgttttctattgaggcctatgttcacctcttc

SEQ ID NO: 4452 - DNA, 964 bp, Artificial Sequence
  P2712 (35S::G3074)
gcgttttctcattcgacgatttctggatttggggatttcaaaaccatgaggaagaagctcgatactcggttcccagctgctcgtattaaaaagattatgcaagctgatgaggatgttggcaagatagctttggcagtgcctgtcttagtctcaaaatctttggagttgttcttgcaagacctttgtgatcgtacatatgaaattacccttgaaagaggtgccaagactgtgagctcattgcacctaaaacattgtgtggaaagatataacgtgtttgattttctgagggaagttgtgagtaaggtgcctgactatggccattcccaagggcaaggacatggtgatgttaccatggatgatcgcagcatctccaagagaaggaagcccatcagcgatgaagtgaatgacagtgacgaggaatataagaaaagcaaaacgcaagagatagggagtgctaagaccagtggcaggggtggtagaggaagagggcgaggaagaggtcgtggtggacgagctgcaaaagcagccgaaagagagggtctcaaccgcgagatggaagtagaagccgccaattctggacagccaccaccagaagacaatgtcaagatgcatgcgtcagagtcatcaccacaagaggatgagaagaaaggcatcgacggcacagcagcatcgaacgaagacaccaagcaacaccttcaaagtcccaaagaaggcattgactttgatctcaacgctgaatccctcgacctaaacgagaccaaactggcaccagccacaggcacaaccacaaccacaactgcagcaacagactctgaggagtattcgggctggcctatgatggacataagcaaaatggatccagcacagcttgctagtctgggtaagaggatagacgaggatgaggaagattatgacgaagaaggctaagtcataacagcactataggatatatagagtagcagcg

SEQ ID NO: 4453 - DNA, 1145 bp, Artificial Sequence
  P2714 (35S::G314)
cagaacggtgcgtttcatattgataaggtactatcaatatgtctcgtctctttctctttctttgtttcttttgctattattcacaaaaactctctttcgcattgattattattcccattgcttgtttgtcttcatcttcttcctcctctgttctttcaaggggatccaaatatgaacacaacccaaattctaaacccgacccgacccatttggcccagtttctcttcgtccaaatctcttagcggtgatgctaactgcatggagcagcttctcctccattgcgcaaacgccatcgaatcaaacgacgccacgttggctcaacagatcatttgggtgctcaacaacctcgcttcacccgacggcgactcaactcaactcaaagactcgctgcctctttcctccgcgcgttaatatcacgcaccgcctccaaaagccctgcgtttgcgtttctatcactggctgctacagcttccatatcccagaaaacgctacaccggttctccgtcatagagctcgctgagttcgtcgacttgacgccatggcaccgtttcggattcatagccgccaacgccgcaatcctcgacgccgtagaaggttactcatccgttcacatcgttgacttaagtttgactcactgcatgcaaatccctactcttatagactccatggcaaacaaactccacaaaaaaccgcctccgcttctcaaactcaccgtcattgcttccgacgctgaatttcatccgccgccgttgctcggaatctcctacgaagagctaggttcaaagctagtaaacttcgcaaccacacgtaacgttgcaatggagtttagaatcatatcttcttcttactccgacggcctctcctcccttatcgaacaactaagaatcgacccattcgtcttcaacgaagctctcgtcgttaactgccacatgatgcttcactatatccccgacgaaatattaacttcgaatctccgatcagttttcttgaaagaacttcgagatctaaacccaacgatcgtaacccttatcgacgaagactcggatttcacgtcgactaactttatctccaggtttatcttttttcggttctatttcaaaatttaaaccctaaacactaatgtttgacctgatgagtaaaatgtg

SEQ ID NO: 4454 - DNA, 1278 bp, Artificial Sequence
  P2716 (35S::G224)
ccctaatcccgatgatgatttacgtagttcccgatctacttgaagaaattttccttggattgcctttaaaatcaatcctcagattcaaaaccgtctcaaaacaatggagatcaatcctggaatcgaagagtttcgcggagaggcgtttgaacgttgagaagaaggagaaaattctggctgttggagaccggactgagttgggattcgaaggtgaggaagagatccagatggtctatttacactgcgatattgacgccacacgaccctctctgacatgtgagggtttggtgtgtatcccagcaccaggttggatcaacgttttgaacccatcgaccagacaactccggagatttccttgtagccctaatcatcacgtgccctctgatcgtattcgttttcagttcagagacgaactatacctcacttcctttccggggaattgggagatgggatttggtagagacaaatttaatggtagctataaagtggtgaggatgtgttttagtcctgtggaaaaatgcgaggttcttgatgttgaaactggggaatggagtgaactgaatccacctcctaacgatattgacgtgggaaggaagtcagtgtgtgtgaatgggtcaatctactggttaaaaaatgtttagcgtttcggaatcctagccttggatcttcacacactagagttccacaatgtttccgttccatctacgtgttgcaccatgagtgcccagatggtgaaccttgatgaccgtctagccataactaaaacaaacggtgcgccagaatgggagctagagatactgagcctgatggatgtagacaaagaaatatggagcaagacttactccataactttagccagtatcattattaaccacccatgggagtctagttggttcacggtgttgacggtttctaagctagggaatcttgtcttttgtgacaatcacaagcggttgtttaaatataataccgagacaaatgagatttgctgtctctcctcagatatttctgttatatctccttatctcgaggatttggtaccacttcgtttggactcaggacatgatcatcgggattacaaaatcaggacatctagttgcggattgttttcgaagcatccggaggcagggttattcaaggagatcatcacttttcggtttgtgtttgccactctagttctagttggttatcagtattatagatcattaaaattcaagtaggtggattcttctctatgtgttttaccctcttggcatgtaacttgcaaagcaagtacgg

SEQ ID NO: 4455 - DNA, 1836 bp, Artificial Sequence
  P2720 (35S::G852)
gacatttgggaacgttgtagttgcagctgaatggtggaacaaactgtggttagagaacatatcaaagcgagagtcatgtcattagtgaggtctgcagagccatcctcatataggaacccgaagctttacacgttgaatgagaatggtaataacaatggtgtcagttctgctcaaatctttgatccagataggtcaaagaatccttgtctgactgatgattcttacccaagccaaagttatgagaagtactttcttgattcgccaactgatgagtttgttcaacatcctattggctctggtgcctcggttagctcatttggctctttagactcatttccttatcagtcaagaccagttcttggatgttccatggaatttcagttaccgttggattcaacctctacttcatctacaaggcttttgggagattaccaagcggtttcttacagtccgagcatggatgtagtggaggagtttgatgatgagcaaatgagatcaaagattcaagagcttgaaagagcgcttctcggcgatgaagatgataaaatggttggaatagataacctcatggagattgacagcgaatggtcgtaccaaaacgaaagcgaacagcatcaagactcgcccaaagaatcatcgtctgcagattccaactctcatgtaagtagcaaagaagtggtgtctcaagccactccaaagcaaatcttgatatcttgtgctcgtgcgctatctgaaggaaaattagaagaagctttgtcaatggtaaatgagctgaggcagatagtttctatccaaggagacccttctcagagaatcgcagcttacatggtggaaggtctagctgcaagaatggccgcttcaggaaaattcatctacagagcattgaaatgcaaagagcctccttcggatgagaggcttgcagctatgcaagtcctgtttgaagtctgcccttgtttcaagttcgggtttttagcagctaatggtgcgatacttgaagcaatcaaaggtgaagaagaagttcacataatcgatttcgatataaaccaagggaaccaatacatgacactgatacgaagcattgctgagttgcctggtaaacgacctcgcctgaggttaacaggaattgatgaccctgaatcagtccaacgctccattggagggctaagaatcatcggtctaagactcgagcaactcgcagaggataatggagtatccttcaaattcaaagcaatgccttcaaagacttcgattgtctctccatcaacactcggttgcaaaccaggagaaaccttaatagtgaactttgcattccaacttcaccacatgcctgacgagagtgtcacaacagtaaaccagcgggacgagctacttcacatggtcaaaagcttaaacccaaagcttgtcacggtcgttgaacaagacgtgaacacaaacacttcaccgttctttcccagattcatagaggcttacgaatactactcagcagttttcgagtctctagacatgacacttccaagagaaagccaagagaggatgaatgtagaaagacagtgtctcgctagagacatagtcaacattgttgcttgcgaaggagaagaacggatagagagatacgaggctgcgggaaaatggagagcaaggatgatgatggctggattcaatccaaaaccaatgagtgctaaagtaaccaacaatatacaaaacctgataaagcaacaatattgcaataagtacaagcttaaagaagaaatgggtgagctccatttttgctgggaggagaaaagcttaatcgttgcttcagcttggaggtaagataagtgacaagagcatatagtc

SEQ ID NO: 4456 - DNA, 2703 bp, Artificial Sequence
  P2726 (35S::G1535)
cttccaagtgatgttgacaatgggagaaggtaatgtgatgacttcaaacaacagatttgcttcgccgccgcagcagccgtcttcttcttctccgggaacaatccaaaaccctaatttcaatttcatacctttcaactcatattcatccattatcccgaaggaagagcatgggatgatgagtatgatgatgatgatgggagatggaacagtagaggaaatgatggaaaacgggtcggcgggtgggtcattcgggtcaggtagtgaacaagcagaagatccaaagtttggaaacgaatctgatgtcaatgagcttcatgacgatgaacaacctcctccggctaagaagaaacgttatcacagacacactaatcgtcagatccaagaaatggaagcgttgtttaaagaaaaccctcatccagacgacaaacaaagaaagagattaagtgctgaacttggtcttaagcctcgacaagtcaagttttggttccaaaataggcgtacccaaatgaaggcacaacaagacagaaatgagaatgtgatgttaagggcagagaacgataatcttaagtcggagaattgtcatcttcaggcggagctacggtgcctctcttgtccttcttgcggcggccccaccgtccttggcgacattcctttcaacgagatccacattgagaactgtcgcctccgtgaagagcttgatcgtctgtgctgcattgcctcgagatacactggccgtccgatgcaatctatgccaccatctcagccattgatcaatccttctccgatgcttccacatcatcaaccttcattggagctagacatgagtgtatacgctgggaactttccagaacaatcttgtacagacatgatgatgcttcctccacaagatacagcttgtttcttcccagatcaaactgccaacaataacaacaacaacaacatgttacttgcggatgaagaaaaggttatcgctatggaattcgctgtctcttgtgttcaagaacttactaaaatgtgtgacacagaagagcctttgtggattaagaagaaatcagacaagattggcggcgaaattttgtgtcttaacgaggaagagtacatgaggttgttcccatggccgatggagaatcaaaacaacaaaggagattttcttagagaagcttcaaaggcgaatgcagtcgttatcatgaacagcataacactagttgacgcctttctaaacgctgataaatggtcagagatgttctgttcaatcgtggctagggcgaaaactgttcagataatttcatcaggagtttctggagctagtggttctctccttctgatgtttgcagagttacaggtactatctcctctggttccaactagagaagcttattttcttcggtatgtggaacaaaacgcagaaaccggaaattgggcaatcgtggatttcccgatcgatagcttccatgaccaaatgcagccaatgaatactattactcatgagtataagagaaaaccttcaggctgcatcattcaggacatgcctaatggatactcacaagtcaagtgggtggagcatgttgaagtagacgagaaacatgtgcacgagacttttgctgagtatgtgaaaagcggaatggcttttggagctaaccgttggctcgacgtgttgcagagacaatgcgagaggatcgctagtctaatggctagaaacataactgatcttggagtaatttcatctgcagaagcaaggaggaacataatgaggttatcacagagacttgtgaaaacattctgtgtgaatataagcactgcatatggacagtcttggaccgctttgtctgagacaactaaggacaccgtgaggatcacgacaaggaaaatgtgtgaacctggtcagccaacaggagttgttctttgtgctgtctcaaccacttggcttccattttctcaccatcaagtctttgatcttatccgtgatcaacatcaccaatctctggtaaacaaaaactagagtcttctctctgttcttgatgccaaaaccctaagatttttcgattttttccctgcagctagaggttttgttcaatggtaattcacctcatgaagttgctcatatcgcaaatggttcacatcctggaaattgcatctctcttcttcgaatcaatgtaagtttcaaaccttcattaaaaccctaattcaaagatttcaattttttccgaataaattagggtttttgcaggtcgcaagcaactcatggcataatgttgagctgatgcttcaagaaagctgcattgataactccggtagcttaatcgtctactccaccgtcgacgttgactcaattcagcaggcgatgaacggtgaagattcttccaatattccgattttacccctcggattctccattgtccccgtgaatcctcccgagggtatttccgtcaattcgcattctccgccgtcgtgtcttctcaccgtcgggattcaggtcttggcgagtaacgtcccaacagcgaaaccaaatctctccaccgtcaccaccatcaataaccatctctgcgccaccgttaatcagatcacttctgccctcagcaacaccattacgccggtgattgcatcttccgctgacgtgtccaatcaagaagtcagctagttgaccgaattacccctaaacctccttttgctttttctatctcagagtcagagcagtcccatgtc

SEQ ID NO: 4457 - DNA, 2110 bp, Artificial Sequence
  P2727 (35S::G1539)
cttgctatatcgctgtctctctcccttctcctctataaacatacatataaattaagtacacaccaaaatgtggacgatgggttacaacgaaggaggcgcagattccttcaacggaggaagaaagcttcgtcctctcatcccacgtctcacttcttgccccaccgccgccgtaaacaccaactccgaccaccgctttaatatgggtatctctttctctctctctcgtcaatttttggtgaaactttccagtctctctttcccttgtttctaatgctcattttcttgctttggttacgattttcacagcagtggtgacgatgacggcggagcagaacaagagggagctgatgatgctaaactcagaacctcaacatccaccggtaatggtgagctcacggtggaatccgacaccagatcagttaagggttcttgaagagctttaccgacaaggaactagaactccttctgccgaccacatccaacaaatcaccgcacagctacgacggtacgggaagatagaaggcaaaaacgttttctattggttccaaaaccacaaagcccgagaacgccagaaacgacggcgacaaatggaaactggccacgaagaaacggtcctttcaacagcaagtcttgtctcaaaccacggattcgacaagaaagatcctccaggtaagggaccataacagaacttggggattaacattcaaacaataaaagtctttttggattagaatgtctttttgggttgatttcatttcaaaattgacggtttgaaaattcatgtctggaattttgcaggttacaaggttgaacaggtcaagaactggatatgttcggtcggatgcgacacgcaaccagaggtatatatctctatttatacatatatttgtttctaaattgatattattttatgatatgtattatgtatatatgttgctcatattctgtgtttataatggtcttggggtttctattacatgaaagggagtgtaattaaggattgagggtttacatatataattagcatatgattacaaatagaatctgctagctaagaataagtgaattcctttttggaagtttgggtaagttattgaaagaaaaaaacaaaaggcagagagatgaggcggtggaaaagaccaagaagttaatttatggggaacttcaaaataagtatttttgtagcatatgcaaaaatacgtatattcttagcatataattatggttttattttgtttgaatattagtagtatctttttaaaaagattattgaattcatccaaaaagctgcagagactttcctttctgtcggcacagctgctacgtacgatcgatcctttagctctgtgtcttcttgtttttgctgaatttccataaattaatgtgctttttcactccaaacacatgcttgaaaagacccttttgaccctggtctttaacggtctcattcttcttcacccctgtccctatctggaattttgttttaagcataaagtttgtcgctttgccaaattttgacttatttgttaccaatttttacattttccgatgctaatttgactaatttcaacacatcttgaatgttctttcttttgcataattagaaaccttcccgtgattatcatctggaggagccagcgaatatacgggtggagcacaatgctcgttgtggaggagacgagagacgaagctttttagggataaacaccacgtggcagatgatgcagttgccacctagtttctactcttcttcacatcatcatcatcaacgtaacctcattctcaattcacctactgtttcctccaacatgtccaacagcaacaatgctgtctctgcttctaaagatacggtcacggtttcacctgtatttctacgtacgagagaagcaacgaacacagagacttgtcatcgaaatggtgatgataataaagatcaagaacaacatgaagattgctccaacggtgaattggatcatcaagaacagacacttgagctgtttccactgagaaaagaagggttttgtagcgatggtgagaaagacaagaacattagtggcattcactgtttctatgagtttctgccattgaagaactaaacctaattgaagtc

SEQ ID NO: 4458 - DNA, 869 bp, Artificial Sequence
  P2728 (35S::G1549)
cttgaaagtgattgttgtaagcagagatagacaaaagaggtaaaaaaaaagaagaagagaagatggaatattggagcagctccttcatcgatggcgcgtcttcttccagcttcatctctcctttctataactttgaccatttttcaggtaacatgcatccatagtactaggttttagtagagctagtttatatgcttaatgcttaatcattcactcaactgtatgtcgctttacaagtctctctctgtcttgtattgaatttgtaggaaaccaagacaacagatgtttaggtacaatgatgggtgcacaacaagatatacttcatgttcctctagcaatggtagagagtggctatggagaagaaagcaacagttttaatggacaggagaagaaaaaaaagaagatgacgagcgagcagctaaagttcctcgagagaagtttccaagaagagataaagctgaatccggacaggaagatgaagctgaatccggacaggaagatgaagctgtccaaagaactggggctgcagccgagacagattgcggtttggttccagaacaggaaagccaggtggaagaacaaacaacttgagcatctctatgaatcactaagacaagagtttgatattgtctctagagaaaaggaattgctacaagaagaggtaattactccagtgatcaatactaacttaataaataagctttcgagttacaatccattgagttactttcactttgtttcaacagctaatacaactgaaatcaatgataagagaggatagttcatgcaagaagaaacaaacctgggaaaaagcctgcagctgaggcaatagtatataagttccacttcagttatatctccaaaatggc

SEQ ID NO: 4459 - DNA, 2281 bp, Artificial Sequence
  P2732 (35S::G1593)
gaattgcaagttttgttgcttaattgtcagaataatggctgctttctttcttggagaatctgaaatgagagaacactcttctgatctttttatgatgactctgaatccgtttcgcgagcagacaacgaccactaatgctcatgacgatcacttctacaacttgtgctttggttcccaacaatatagacctcgagatgaagtaggtcatatagaacaaggaaattcttccatctccactttttcaaacggaggagtcttcagggctttggctccgatctacttgaaagcggctcaagaattactcaatgagattgtcaatgttggaaacggtagccacggcgcaaaacaagagcgaccggtgagtaaagagtccacgatttatggagttgaggacatcaatggtggctataagcctggcgtagctgctttgcaaatgaagaaagcaaaactcatctccatgggtgaaatggtaacttatttatacctacctatataatatgtgatacacaaataataataataagatctttgtatatacaaaccaaccatggtgatatatataatggcaataaactttctgttactttgagatcgggactcaagttcagtccatatatttggttattgcatgttaagtatttgatactttataaaggtttcaaagattggtaaattgatttgggaaatgaatttggtaaattatacacaggtggaacagagatacaagcaataccatgaccaaatgcagactataatctcatcgtttgagcaagctgcgggtttaggctcagcaaactcatacacacatatggcgttacaaacaatatcaaagcagtttcgtgctgtaaaagacatgataagtttgcaaatcaagcaaataaacaagctcttgggacaaaaggaatttgacgagcagcttaagaagttgggaaagatggcacatcaccattcaaatgcttggagaccgcagagaggtttgcccgaaaaagctgtttccgttctacgctcttggctctttgagcattttcttcatccgtaagtaacgttttcttctatctttaattcttgttacgattattgtcgatatatcagaatgatgggaccttgaagcaaagggaactaactaaggatatggaagctaggatcattacttagttttgtatagacatgcatgctaatgatttagttgtgtcttgttttggtttgtatagatatccgagggatttggataaggtaatgcttgccaaacagactggccttactaagagtcaggtaattgatttcgattatcagaagttggacatacttaagtttcttaatgttagatgtctcatacatagtacatatacaatttcatgacatcatctaacaccgactatcaagaataaataatctacaggtaaaaccgaatatatatatagattcaaacaaattttattccgatcaaaaaaatatttttagaaagatatctctttatttctatttttttttcttttcgagtctgaaaacaaaaacgtacccaagaattctaagaaaagcaggtaaaccaaatatattttggtaaatttatttagatagatgatgtatatttattttattataattattttaatgaaaatagcgatgatagcatacgagaaatatcatatatgtgatcctttgtaaagtaaatcaaatttattttggttaaattagtaattatatatattatggaatactttcttttagcacccatgattatatataatcaaaataagtattgttaatagtatcttgtgtaaaatggatgtaggtgtcaaattggttcattaatgctcgagttcgaatgtggaagccactggtggaggaactttattcggaagaaatggatattgaagaaagcagaaaaggaagtgaccggtatagtaccaaaggttcatcttcaaagcagccgtacaataatacaacttcaaatgaatcttcgaacacgatcctacccgcctttcgtcaaggattcactgaaactgaaacccctaggcaaaattcatcctcaagttgcagcgtagtcatgaggttcacgaagcaacacatgaatcaagcgaacttcatcaatttcaacggagggttcgaaaactatcacacaatggatggaaacagcgtctccctttccctcggcctgcctcattcttgtgaccaaacctttaataacattcattttgagtcaacaagtcatggaactgagaactcggccatatattcatcttcaacttatcaaatcatggattagaaataattagtgggg

SEQ ID NO: 4460 - DNA, 1440 bp, Artificial Sequence
  P2744 (35S::G2467)
gatcattagacttctagcattagcattgctaacaagatggacccgtcgtcaagctccagagcacggtcaatgccaccgccggtgcctatggagggattgcaggaagcagggccttctccttttctaacaaagacgttcgagatggttggtgatccaaacacaaaccacattgtgtcttggaacaggggaggcatcagttttgtcgtgtgggatccacattccttctcggccactattctgcctctatacttcaagcacaacaacttctccagctttgtcagacaacttaacacttatgtgagtatctctgtttctccactaaacgaccttactgtattttttgttttttttttcactatagtgttcccttaatcttatgtcttggaggaactcaacaatgccttcggcctttaattactgcaaaaggttaaacaatgtgtctatttgtgaattacttgttcactggatagtttagtactaagtaattatgctcaataataataatggctggtgaaacaagctagctagtagtgaaagagaagaagtttcttcgcaagttctggaaacctttatttataacaaaataaaaaagttctggaaacttttatccatatcaacctgcaataaaatattcaattattccatccaacaaaatataaaattgaagataatgttgctttccttttacagcgcagtagagtggcaggttcttcgtctgttatatataacatgtttacgtcgcaaaccaaaaaaaaacttatattatgatattcgattacttatttatctgcagggattcagaaagatcgaggcagagagatgggagtttatgaatgaaggtttcttgatgggtcagagggaccttctcaaaagcatcaagcgacgaacctcctcttcttcccctccttcgcttaactactctcagtctcagcccgaggctcatgacccaggcgtcgagcttccgcagctccgagaagagaggcatgtcctaatgatggagatctcgacgctcagacaggaggagcaaagagcgagaggctacgtccaagccatggagcagaggattaatggagcagagaagaaacagaggcatatgatgtccttcttgaggcgtgcggtggagaatccttcccttctgcagcagattttcgagcagaagagagaccgagaggaggccgcgatgattgatcaggctggcttgatcaaaatggaagaggtggagcacctgtcggagctggaggctctggcgcttgagatgcaaggatatggacggcaacggactgatggtgtggagagggagcttgacgacgggttttgggaagagttactcatgaacaatgaaaactccgacgaagaagaggcgaatgtgaagcaagattaggttttatgggttcatgtccgaaaaagaaaagtacaagtatcgatcaatcaaagctaatg

SEQ ID NO: 4461 - DNA, 1777 bp, Artificial Sequence
  P2750 (35S::G2453)
tcgaccctatcattcatcgtacacacacactctctatgacaaagctccccacaacactcaaccatctatttgatctgccggggcagatttgccatgtccagtgtggtttttgcaccactattttgctggtataccttaacttcttctcttattctctcccttcctttctcccttcctctctttatatatatgatcatgagtttaatgagtgtaaatgtgttgcaggtgagtgtaccgtttacaagcttgtcaatggtggtgactgtgagatgtgggcattgcacaagccttctctctgtcaatttgatgaaggcttccttcattcctctccatctccttgcttctctctcccatcttgatgaggtttccataacatctatacatagacaaacacacaccatctaaatatgaccaatatatatatatatatacttacttttgattatatgtaaatatatgtgcagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaacgtacgtttgagtataaattcaacttaaactttagttttgcgatttctcctttcatcagtcgtctaattatgttttgagtttgtatatatatagcacctgagaagcgacaaagagctccttcagcttacaattgcttcatcaagtaagaaataaattcaacacattacatgtgtatgtatattatatatattcttacaaatttaaccacttaaggttttgagtttgtaaaatggttcttctttgggggttgtattggagcagggaagagatcaggaggttaaaggctcagaatccaagcatggctcacaaggaagctttcagcttagctgccaaaaatgtacttaagcttaattagtcttaagatttaaaagaaaaccctaatatagttttcatctttttgttagcttaattgacagatcgagttagctaataacattttatgatttcaattttttgatttggggatggcgaagtgggcccattttcctccagctcacaacaagagagctgcttcagatcaatgtttttgtgaggaagataacaatgcgatactaccatgcaatgtttttgaggtaatcctcagcaaccatttatattttttaatcactttcgcttcaaaatcaattaccatattcttgacaagtaaactccacaacaagtgtcattttccaaagcaaaccaaataattaaagcattaactagatccaaatagcatcgctctcagtcaaaatttcagaaccctagctagactaattatataaagagaaatcatttactaattattagagtgaaagcaaggagaagggtaagtgagattgtgagaatatatcattgatcttcaactactacaatgtgtgaaatttatgacctaaacccttttatagtattgaagcttacactgcacacagtttacttttatagaaacccattcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgactcgc

SEQ ID NO: 4462 - DNA, 881 bp, Artificial Sequence
  P2752 (35S::G2456)
ctatctgaacatcgatcagtcatatcttttcaatcaaatcaaagccctcctctctctcttactccttttttgttttaaatcaagaaaaagactccatgtcgagcatgtccatgtcgtcctcctcagctccagcttttccaccggaccacttctcatctacggaccagctctgttacgtccattgcagcttctgcgacactgtccttgctgtgagtgttcctccgagtagtttgttcaagacggtgacggtcagatgcggccactgttcgaaccttttgtcggtgaccgtgagcatgagagctcttcttcttccatccgtttccaaccttggccattcctttttacctccccctcctcctcctcctcctccaaatcttttggaggaaatgcgaagcggagggcagaatataaacatgaacatgatgatgagccatcacgcttcagctcaccacccgaacgagcatttggttatggcgactcgcaacggaagatcagtggatcatctacaagagatgcctcggccaccaccagccaatagacccccagagaagcgacaaagagtaccatctgcatacaaccgattcatcaaagaggagatccaacgtataaaggcaggcaaccctgatatcagccacagagaagccttcagtgctgctgccaaaaactgggctcatttccctcacatacactttggactcatggctgaccatcctcccacgaagaaggctaacgtgcgccaacaggaaggagaggatgggatgatgggaagagaagggttttacggttcagctgccaacgttggggtggcccataactagctacgaagactttcccaatcttttgtaatcttcaaaatgtggttactttcagctcaaacttaa

SEQ ID NO: 4463 - DNA, 789 bp, Artificial Sequence
  P2757 (35S::G2826)
ctaaagacatacatatttaatggaggagctggattttagttcaaaaacaacaacttctcgtctaaagctatttggatttagtgttgatggagaagaagatttctccgatcaatcagtcaaaactaacctatcttctgtatcaccggaacgtggcgagtttccggcaggatcttccggaagaagtggcggtggtgtacgaagccgaggcggaggaggaggaggaggagaacgtaagtatgagtgtcagtattgttgtagagagtttggtaactcacaagccttaggtggtcaccaaaacgctcacaagaaagagcgtcaacagcttaaacgtgctcagcttcaagctacacgaaacgcagccgcaaatttctcaaacgctggatcagcgtctcagtttttaaggaatcctatagtctctgcttttgctcctccgcctcatcttttatcatcatccgccgtgcctcagcctatgggaggtccttggatgtatcttccacgtgtttctccatctcaacttcacgtgtctcatggctgcgtcatccaagatggttcgggtggtgcgggtgctggtgggttctcgtacgagtatggggctcgtgattcagggtttggagtagttggggctcagatgagacatgttcaggcccatgggccgagaccatcggttaatgggttttcaagagaagtaggaactacttttgatgatggtttagggttggatttgcatctcagtcttgcacctgctggtcattgacgtgttttttaaagctcttgtatatttatcaacat

SEQ ID NO: 4464 - DNA, 900 bp, Artificial Sequence
  P2770 (35S::G2723)
gtttccctatatatatctcatatattcccaaaagaatttaaataaaatggcctctagttctatgagctcgagctcttcttggacgtctaagcaaaacaagatgttcgagagggctttagccgtttacgataaagacactcccgaccgttggcaaaacgtggctaaagcagttggaagtaaatctgcagaggaagttaaacgtcactacgacatcctcgttgaagatctcatgaacatcgaacaagacttagtacctttgcctaaatacaaaaccgtcgatgttggaagtaaatctagaggcatcgatgattttgatttgaggtgaaatctttttgtccttaccaaatcttttagagtttgtggtcgtttttgtgatttctatagtgatttagtagaaacatatgtttagttcaaataatttcaaaatctgattatataaatgagttcttttggtagtagtatattaaaactagtgatgaacgttggactatataataataataatataggtataataataagaaacatgcaaccacacgcaccatcccttctatttccggcattctcattaaaaggaaaggagtcacatgaaatctaatcctgtttgtgcaccatcacatgcacattgtcctcaacttttgaatcttatatgaatgatataatgttatatatgtatatatctagctaattctatattattcgaatacgattaaatataacggtatatattaatgcaaaagtgattctgatttttcactggtcggtgatcaacaaaagtggtatcttagtgtcaagttatattaattaatctattgttttttgacaggttaatgaagaatatgagaatccagtgaagttgttacatgatgtgaagattgctatatgtctaaggattcaaag

SEQ ID NO: 4465 - DNA, 1586 bp, Artificial Sequence
  P2771 (35S::G2802)
tcgacgagagagagttgatcaaagatattcgagattgagatgaacaagagtaatcctgctggttcggtgactggttcggatataatagacgccaagatcgaagaacatcaactttgtggatccaagaagtgtcctagctgcggccacaagctcgaaggcaaaccagtaacaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaattgtgccattttccagtctgatgatcttgtcgacccacatcacggc

SEQ ID NO: 4466 - DNA, 654 bp, Artificial Sequence
  P2773 (35S::G2805)
gtttctctcccttcatcaatcatcatcagcattttccttaaatcttcttcttctaagagatcttagtttcactgaagaacgaagatgatgaagtcaagacgtgaacaatcaatcgaagaagcaatcgtcgcaaattatttgaagatgatgatcgataacgtaaacgtttggcctcgccacttcctccgaagcgaagacgtgtactgcaagaatccgtggacgcttttcgttactagagatcctataatcctacacttcggacgatacttcttcgttaatcggagtgtgaattcaggtttaaccgatggatgtgaatacggttgttggagaatcatcggtcgtgatagagtgatcaagtcggtgacgaccgggaagattctagggttaaagaaggtttataagttctgtgaaactgatcggaaaccgaaatcggtttttaagttcttggaaaaggagaagagaagagtaagagatagacgaatctgggcgatggaagagtataggtttgcaagtacgtggaaacaagattacgtgatctgcaagattcgacgtctgtatccacaaccatttgactacatgttggcccagcacattcgaggttactataaatgaatcactgatattctgatcctggatttgaacactcgattactg

SEQ ID NO: 4467 - DNA, 1081 bp, Artificial Sequence
  P2775 (35S::G1357)
gactctctttgcatcatctctacccttatggcagctgcaccaccgatcgagccggcggtgacgacgacgttccctggcttcaaattctccccgaccgacatcgaacttatatcttattacttgaagaggaagatggatggtttggagagatctgttgagattatacctgaggttgagatttacaacttcgagccttgggatttacctgataagtctatcgttaaatcggatagcgaatggttcttcttctgtgctcgcggtaagaagtatccccacggttcacagaacagaagagcaaccaagataggatattggaaagccacaggaaaagagcgtaatgtgaagtcaggttctgaggtcattggaacaaagagaacgcttgtattccacattggccgcgcgccaaaaggaggaagaacggaatggcttatgcatgagtactgcatgattggagtatcactggatgctctggttatttgccgacttaggaggaatactgaatttcaagggagtacaattcaaaagccaccacaaccaagtttaccactggataagcacgtaaacttgcggaatgaagctatttcagaaagtatttatggttgggaaactatggttgatttctacttatcaagtgagtcagggcaagaactacttagtgaaatagcagaatcttcacaatcttcacaaaatccacaggaatttttccatgtttaaaggttcctagtgaagaagatttctatgccgatatactgagggatgaaatagtaaagctagatgatccggcggtatccggtaatacactgatcaatgtaccaaggcttcaaacagagtccaataccacaagagtactacctttacctgacatggtagacaaacaaatgcaatcgttgctacagaaactaccattacaaaatgacactggagaagagaacaacatatccatgtcaaattgctttatcggtatctactcgattaagtctataaaccgagcgcgatgggacgttgttgtttggttactcgttatgatagccgtgttggtgttttatttagtgtgaggttaaagaagacatcttctaggcag

SEQ ID NO: 4468 - DNA, 934 bp, Artificial Sequence
  P2789 (35S::G2311)
gagagagcacgaggtaaatcacgcaagggttagatgggaaaccagaaactaaagtggacggcggaggaagaggaggcgttactcgccggaatcagaaagcacggtcctggaaagtggaagaatattctccgggatccagaattcgctgatcagctcatccatcgctccaacattgacctaaaggataagtggcgtaacttgagtgttccccctggtactcaaagtttaactaataaggcacggccagcaaaagtcaaagaggaaggcgacactccggctgcagatgcaaatgatgctgtcactattccacggcctattcctactattccacctcctcccggtcggcgtactttaccttctgagttgatccctgatgaaaatacaaagaatgctcctaggtatgacggggtgatatttgaagctctctctgctttagccgatggtaatggatctgatgtcagttccatttatcatttcattgagcccaggcatgaagtaccgccaaattttagaagaatccttagtacaagactgaggaggcttgcagctcagagcaaacttgaaaaggttagcaccttcaaatctatacagaacttctataagatacccgatccatcaggaacaaaaataggtgtcccaaaaccaaaggagacacatacgaagctgcgccaagcaaacaatcagacctctgctgattcacaacagatgatcgaggaagctgcaataaccgcagcctgtaaagtcgtagaggcggagaataaaatagacgttgccaaactagcagcagaagagtttgagaagatgacaaagattgcagaagaaaatagaaaactcctggtcatagctactgagatgcatgaactatgttcctgtggggagactatgctcttggcttgaattgaatctatgggacattccttgtagctctcttcag

SEQ ID NO: 4469 - DNA, 1141 bp, Artificial Sequence
  P2791 (35S::G515)
tcgacgcagaagaacatcaaccatggcgaaagctctccaatgcatatttttttgatcttttccttttcccttcttttttgatcgctgcagagaaatggaaactcctgtgggtttaagattctgtccgaccgacgaggagatcgtcgtcgattacctttggccgaaaaattccgatagagacacgagccatgtcgatcgattcattaacacagtccctgtctgtagactcgatccttgggagttaccttgccagtcaaggatcaaactgaaagatgtggcttggtgtttcttcagacctaaggagaacaaatatggcagaggtgatcagcagatgagaaaaacgaaatctgggttttggaagagtactggcagaccaaagcctatcatgcgtaatcgccaacagatcggtgagaaaaagattttgatgttttacacgagtaaggaatccaaatccgattgggttatacacgagtaccacggtttctctcataaccagatgatgatgacatacacactctgtaaagttatgtttaatggtggcatgagagagaagtcttcctcttctccttcttcttctggtgttagtggaattgagcagagtcgtcgtgactctttaatccctcagcttgtcaacaattctgagggatcctcacttcacagagaagatccaagtcagtttggtgatgtgctgcaagaagctccaatcgaggatgctaaactgaccgaggaattggtaaaatggctgatgaatgatgaggatgatgctcaaatcgaggatgctataccgattgaggaatgggaaacatggttgaatgatattgatgatgctaaggagaagagtatcatgtttatgcatgataatcgaagtgattacagacctccaaactcattaactggtgtcttcagtgatgatgttagcagtgatgataatgattctgatttgctaactccaaaaacaaactctattcaaacttcgagcacttgtgatagttttggtagctcaaatcatcgcatagaccagatcaaagacctgcaagaatctcctacctcaacaatcaacttagtgtcactaactcaagaggtgagccaagctctaataaccagtattgataccgccgagaagaagaagaatccttatggc

SEQ ID NO: 4470 - DNA, 1024 bp, Artificial Sequence
  P2793 (35S::G2636)
gttatctttccacatttggggaactctagggttttgttatttttagagctttcttcttgtgccgacaatggatgttgatgtgtttaacggttgggggaggccaagatttgaagatgaatcccttatgccacctgggtttaggtttcatccaactgatgaagagctgatcacttactatctcctcaagaaggttcttgactctaatttctcttgtgccgccatttctcaagttgatctcaacaagtctgagccttgggagcttcctgagaaagcgaaaatgggggagaaggagtggtacttcttcacactaagagaccgtaaatacccaacgggactgagaacgaacagagcaacagaagctggttactggaaagccactggtaaagacagagagatcaaaagctcaaagacaaaatcacttctcgggatgaagaaaactcttgtcttttacaaaggcagagctcctaaaggagagaagagttgttgggtcatgcatgagtatcgccttgacggcaaattctcttaccattacatttcctcctccgctaaggatgaatgggttctctgtaaagtttgtctgaaaagcggcgtagttagtagagagacgaacttgatctcttcttcttcttcttctgccgtcaccggagagttctcctctgccggttctgcaattgctccgatcatcaatacctttgcgacggagcacgtgtcctgtttctccaataactctgctgctcataccgatgcgagctttcatacattccttcccgctccaccgccgtcactgcccccacgtcagccacgtcacgtcggtgatggcgtggcgtttggtcagtttctggatttgggatcatcgggacagattgatttcgatgcagcagcagcagcgttctttccgaatctaccttctctgcctcccacggttcttcctcctcctccgtcatttgcaatgtacggtggaggctcccccgccgtgagtgtgtggccgtttactctctgatcgccatgcggtcattaaactatc

SEQ ID NO: 4471 - DNA, 1318 bp, Artificial Sequence
  P2795 (35S::G1247)
cttacatatgaagctcattcatgatgggtaaaattttccatgattcaggatcaagcgaatgatttattagcaatgaagaaaacttttactaagtctaaatggaaaccagaggaagatagaattttgaaagattatgttattcaatatggtgatagaacttggactcatgttccaaaacgcacgggccttcctcataatcctgcaagttgtcgttttcgttggatgaatcatcttaagccaagcttgaaaaaagggccctttaccgatgaggaagagaagcgtgttctccaacttcatgctgttttggggaacaaatggtcacaaatggctagagaagtatgtaactctctttcctttttttttcactctctacattttcatcttcttttactgtttgatttaaacttttgtttctttaagttccctggtcgaacagataacgagataaagaatttttggaacgcaagacgtatgcgattgaaaggaaagggtttaccagtttaccctgatgaagttcgagagcaggcgatacgtacagcagcacaatatggtgtaaaagttgaattattgaatgctcattatagtcaagactcattgatggcaggcaatgtcgagaaacctcaagaactcaataacttggcactcaatcaatgttctccgtattaccagtcaacgcttgccaatgttcagcctagccgcaatcgcgttatggaaccagaaacaacatttcctttcacgggtggatctgccatgaacgagcaaaaccctactctcttgtgtaatccttacgtggagagcactcaagaacagttacctgacagccatttgtttggaaatgttacatattcttctcctcctatgcctctcattcacgaggttgagaacttggagctcccttcattccaaggctttgattttcatgaagagcctagcagttttggagcagaacaatataacccaatgctgaatcttgagccacacaacactttggtccagtctcctctgataggccagacaccaacagatttcccatcatcattctatgatgaattgttggatgaattgttggaatcagttgttaacggttcattaggagaaataccgaaaaccgataccagttcggagtcccaactgtttcagtcctctctacgtagccataccgatgctacaccagacattgcaaacacaactggtaaaccttttttagtctctacgcattacattacaatcacttcattttttgtgtgttcaattcaagaggtttccactaatctttatgcatgacaaaacttcaattttgaaacagatttaggttatg

SEQ ID NO: 4472 - DNA, 970 bp, Artificial Sequence
  P2796 (35S::G2717)
gaacggacttgctttgacacagcagaccgtaaatcgggatgggtgctcctaagcagaaatggactcaagaagaagagtcagctttaaagtctggagttataaagcatggacctggtaaatggcgcacaattctcaaagatcctgaatttagcggagtcttgtacctgcgttccaatgttgatcttaaggacaaatggagaaacatgagtgtcatggcaaatggctggggatcgcgcgaaaagtctaggttagctgttaaaaggacgttctcccttcctaaacaggaagagaactcactagccctaaccaattctttgcaaagtgatgaagaaaatgtggatgcgacctctggactccaagtttcttctaatcctcctccaaggagacctaatgtaaggttggatagccttataatggaagcaatagctaccctgaaagaacctggtggctgtaacaaaacaacaattggtgcctacattgaggatcaatatcatgctccaccagacttcaaacgcttgttgtctaccaagctaaagtacttgacatcttgcgggaaacttgtgaaggttaaacgtaagtacagaattccaaactccactcccttgtcttcccacaggagaaaaggtctgggggtgtttggaggaaaacagaggacttcttctttgccttcacctaaaacagacatagatgaagtgaattttcagacaaggtcacagattgatacagagatagccagaatgaagagtatgaacgtacatgaggcggcagcagttgcagcacaggcagtagcagaggcagaagctgccatggcagaggctgaggaagctgcaaaggaagcggaggcagcagaagccgaagcagaagcagctcaagctttcgctgaggaagcttcaaagacattgaaaggaagaaacatctgcaaaatgatgatccgtgcctgaggtaatggaaagcgagagaagaaggagac

SEQ ID NO: 4473 - DNA, 1461 bp, Artificial Sequence
  P2797 (35S::G3075)
ggcgaaagggtgaaacatactgtagttctaaaaaattaatggtgtcgtcaaagaaacccaaggagaagaaggcgaggagcgatgtcgtcgtcaataaagcgagtggtcggagtaaacgcagctccggttccagaacgaagaagacgtcgaacaaggttaacattgtgaagaagaagccggagatttacgagatctcagaatcatcgagcagtgactctgtggaagaagcaataagaggcgatgaggcgaagaaaagtaacggcgtcgtgagcaagaggggtaacggaaagagtgtaggaattccgacgaagacgagtaaaaatcgagaagaggacgatggaggcgcggaagatgctaagatcaagtttccgatgaatcggattcggcggatcatgagaagcgataattctgctcctcagattatgcaggatgctgtatttcttgtcaacaaagccacggtatagtactaattagacatataaatttagcttgaggaacttaatttcacatggtttttgatgaatttgggagtatcaattgctagtcagtgttaattgggcgttataatctcgcaaattgctacagtaatgagattgtttctgttaattaagccgggaattaacgttattgcttcatctccatgtgtgtttgatgaaaccgtagttactgtgcttgattgtcataggtttagcttttacatccagaacttgtagacacctaacacatgagaaagtccttatatatgatttaggttcatattttcaaagcttaagtgatgagtgtttaattttcctgtattggaacttggcattgttttttctttcttttgatttcatcttgtgttcatcgaaattgatgttcattgcgtttacagtacattaactggtttttgtgattgaaggagatgttcattgagcggttttctgaagaagcttatgatagttccgtcaaggacaaaaagaaattcatccactacaaacacctctgtaagctctaatctcgtccctatttgccaatatctggttacctcaatactgaatcccatgtcgaaaatctcatgctgctgcaccaattgctgaacttaggatttctggcttctgcacaagggccagtagttagtcttaggaagagtttagataatgagttaatccgttcgtatcacttgcaagatttgttgcactcctaacataattgatgacactgtcatttctactcgttggcagcatccgtagtgagtaacgaccagagatacgagttccttgcaggtacttaataacctctgaagtattcgttttatgagttccatgtggtttacgaacagcattttaatacctgtaatatcttgaatgcagatagtgttcccgagaaacttaaagcagaggccgcgttggaggaatgggaaagaggcatgacagatgcaggctgaaataaatccggttggaatcgaactgaaccatttgg

SEQ ID NO: 4474 - DNA, 1920 bp, Artificial Sequence
  P2804 (35S::G1893)
ctcactatcttctctcctaaagttaatggctgatccagattgtatcttcagaaatggatatgtagactactataactatagcttcaactatgccacttccctctcacgcatctacaactctcatgacagcttttattatcctcaccagacgacaaacccaaacatcaacgaaaaccctaatttgacttcacctgactctcctccacttagagaagccctccctctccttagcttaagccccattcataagcatcaagaacctactgctaaccaccatgagtactatttcatggagacgacagaaacttcctctaattcaaactttcttgatcaatgccaagacagttatcgtcatgatgtaaccgtggatcttcatctagggttaccaaacctcggtgatggtggaagcagcagcagcgatgtggtccttgattccaccgaccaccaagagggtcaccatgatcatcatcaagatcaaggacttgaagttactatggcttctgaccatgatgatgaacatggtggcttacaaaggggtaatcatcttcatcacttttggatcccgactccttctcagattctgatgggtccaacacagttctcttgtcctctatgcttcaagactttcaacagatacaacaacatgcaagtaaggatatattcattcaataaacctaactctaattagttgctattttccataaaatgattttcaagttttgactttttgttcttgaaaatagattagttttcttatttgtatctacataataattcttgttatttatttatttttcaaatcttcatcatgataaaacccctagtacacactacgacttttcataataattattactattataactcgagaaataacttttaatttgatggtacaagtcatcagctgtacgatggattgatggctaggaaaagatcaactaaaatcaatcaataggtttaagatcaagaagatcttctttaaccaaaagtctttttttcatactgactgtttctaaccctaaaatgtgatcagtcgtccttttccatttttattgtctctcttgatttttgcgcagttccactacacaacactcactaccctaaaaagtaaaagaaaaagaggatgataaatgtctagcagattgtgttgtacctctttatatcttcacattataacatatatatattttatgattgtttatattaattaaccctaaacaatcattcagctctagatctttcttgtcgtaacgtctaaaacttttccattaactttatatcttcagaatatttccgaggatcaacaatatagaagaaaaaaacgaaatttacagtgtgaaatctgaaaactgaaatttccattaacatgtttcaagattagtttggaatttaatctgaaagttctttagatatggtctaatgtattgtgatgaaatgttattagatgcacatgtggggacatggttcacaatacagaaaaggaccggagtcgctgagagggacacaaccaacggcgatgctgaagctgccttgctactgctgtgcaccgggctgcaagaacaacatagaccacccaagggctaggccgctcaaggacttccgtacgcttcagacacattacaagcggaagcacggtgtgaggccctttgcttgtcgtaggtgtgggaaggcatttgcggtcaaaggagattggaggactcacgagaagaactgtgggaagctatggtattgctcatgtgggtcggattttaagcacaagaggtcacttaaagaccacgttaaggcctttgggaatggtcatgtcccttgttgtggaattgatcatgaggaagaggaggctgcttctgatgtcgagcagcaagaatgatcgtgtttagtgttgttgttgtttcgagcattaattaattgtatgctttatgc

SEQ ID NO: 4475 - DNA, 1985 bp, Artificial Sequence
  P2805 (35S::G2834)
cattggtgctctccaagttccatctcaagcttttcttcttgtgggtgattcaatctctctctttctattttttttttcatttctgttgatttagtgatctttgatttgtgaaactttgtttttatcgtgtttgtttttgatttagggttttattttgttgtcggcgagttttgatttgatgattttgatgatttttttttgtttgaccgtttggtttttggatcttaagagttatgtgtgaagatttttttttgtttgtttgggtgaagaatttgtgttgatttcgataattttgagtttgattttgaatcttagtaatgaaatttgattctgtgaagtgtgtatgatgaactttgagctggtcctaattctgattctgataaagatttgatttttatggtttcttttgtaggttttgttgttctcttaattgaaaaacaagatcttgaactaaaaaatggaaactgaagacgatttgtgcaacaccaattggggaagctcttcttcgaaatcgcgagagccgggttcatcagactgtgggaattcgacattcgcaggttttacgtcccagcagaagtgggaagatgcttcaatcttggattatgagatgggtgtggagcctggattgcaagagagcattcaagcaaatgttgatttcttacaaggtgttagggctcaagcgtgggatccaaggacgatgttgagtaacctttcttttatggagcagaagattcaccagctgcaggatcttgttcatcttcttgttggtcgtggtgggcagcttcaaggtcgtcaagacgagctcgcggctcagcagcagcagcttataacgacggatcttacttccattatcatacagcttatttcaactgcaggtagtcttcttccatctgttaagcataatatgtcaacagctccgggtccattcactgggcagcccggttcagccgtgttcccttatgtaagggaggctaataacgttgcttcacagagtcagaacaataacaactgtggtgctcgagagttcgatttgcctaagccggttcttgttgatgagagggaaggtcatgttgtggaggaacatgagatgaaagatgaagatgatgtggaagaaggagagaaccttcctcccggttcgtatgagatattgcagcttgagaaagaagagattctcgcaccgcatactcacttctgcacgatatgtggcaagggtttcaagagagacgcgaatttgaggatgcatatgagagggcatggagatgagtacaaaacagcagctgctctggcgaaaccgaacaaagaatccgtacccgggtctgagccgatgctgatcaagaggtactcgtgcccattccttggttgcaaacgtaacaaggagcacaaaaagttccagcctttgaaaacgattctatgcgtgaagaatcactataaacgcacccactgcgataaaagcttcacttgcagccggtgccataccaagaaattctctgtcattgcagatcttaaaacccacgagaagcactgcgggaaaaacaagtggctttgttcctgtggtacaacattttcaaggaaagacaagttgtttggtcacatagctctgttccagggacacacgcctgcaatccctcttgaagagacaaaaccatcagccagtacatctactcagagagggagctctgaaggcgggaacaacaaccaaggaatggttggcttcaatcttggttctgcatcaaatgctaaccaagaaaccacacagcctggaatgactgatgggaggatatgttttgaggagtcgttctcaccaatgaactttgatacatgtaattttggagggttccacgagtttccgcgactgatgtttgatgattcagagagttcttttcaaatgcttattgcgaatgcctgtggtttctcgcccaggaatgttggtgagtctgtttcagatactagtctctaaggcattgccatatatatgataagttatg

SEQ ID NO: 4476 - DNA, 775 bp, Artificial Sequence
  P2806 (35S::G2617)
ctcaccttaacttcttttctactgcatagaaaaatcttacatatgatggatagaggagaatgcttgatgtcgatgaagcttagaccgatggtgacgaggccatcttcggatgggactttattttggccgtttagggaagagagagcgtttgcgtcagctgaggagtatggcggcggaggtggttgcatgtggccaccgaggtcttactcatgcagcttttgcgggagagagttcaagtcggcgcaagcactaggcggtcatatgaacgttcatcgaagagaccgagctcgactcaaacaacaatcattatcaccttcatcaactgaccaagccacacctcctgaatgtgatcgtcaacaacaagttcttgatgtgggatcaaaggttcttgttcaagaagaaacaagaaagcctaacggaaccaagagggagataagtgatgtttgtaataacaacgttttagaaagttctatgaaaagatatgaacatgacaatggtgaagtcaagactgacttatcggtcggtctactgagtactgagtttgatcctcggaagaagcaactaatcaacggatcatcttcgtcatggaagagggcaaagacggatgtgtcaagatttccaatgatgttagggttggtcattggaatttccgagatcaacggccatcatgaggagttggatcttgagctaaggctaggagctgatccgcctaaggttaactagcttaagtaattaaaaagtaataatagttaatgtgattgccaaaaagaagaag

SEQ ID NO: 4477 - DNA, 729 bp, Artificial Sequence
  P2808 (35S::G2964)
ctactccgattcaatcgatcttatcgagacatggatgctcgtaagagaggacgccctgaagctgctgcctctcacaactccaatggcggattcaagaggtctaagcaagcacttctggatgtccatttggtgacaattgccacttcttgcactatgtgcccggtgggtacaatgctgcagcgcagatgacaaatctccgamcaccggtktstcaagtttccaraaatatgcaaggatckggtggtcccggcggcagattctcagggagaggagatccaggatcaggccctgtttcaatctttggtgcttctacttccaagatcagtgtagatgcttctttagccggtgccatcattggaaaaggtggaatccattccaaacagatatgccgtgaaacaggagcaaaattatcgattaaagatcatgaaagagacccaaacttgaagattatcgagctggaaggaacatttgaacagatcaatgtagcgagtgggatggtgagagagcttatagggaggcttggatcagtgaagaaacctcaagggattggtggtcctgaagggaaaccacatcctgggagcaactacaaaaccaagatctgtgataggtactctaaagggaactgtacatatggagatagatgccattttgctcatggtgaatctgagctgcgcaggtcaggaatcgcttagttatgtctttagactcttgagaacagattatgcattg

SEQ ID NO: 4478 - DNA, 892 bp, Artificial Sequence
  P2812 (35S::G651)
tcgacctgctctgttttggtaaattgaggaaatggaagagaggcataagtgcaagttatgttggaagagcttcgctaatggaagggctttgggaggtcacatgaggtctcacatgctcattcaccctctccccagtcagcccgagtcatattcgtcttccatggctgatccagggtttgttcttcaggacagagagagtgaaaccgagtcgtccaagaagccctcccgcaaacgatccagacttaaccggagatccatctcatcattacgtcatcaacaatccaacgaagaagggaaaagtgaaaccgcaagagcagcagatatcaagatcggggttcaagaactcagtgagtcgtgtacggagcaggaaccgatgagttcggtgtcggacgctgcaacaacggaagaagacgtggccttgagtctcatgttgctgtcgagagacaagtgggagaaggaggaagaggaaagtgatgaagagagatggaagaagaagaggaataagtggttcgagtgcgagacttgcgagaaagtgtttaagtcgtatcaggcgttagggggacacagagcaagccacaagaagaagatagcagaaacagatcaattaggctcagatgagttgaagaagaagaagaagagtactagtagtcaccatgaatgtccaatctgtgccaaagtcttcacatctggtcaagctctcggaggtcacaaaagatctcacgcttccgctaataatgaattcacgagaagatcaggaataataattagcttgatagatctaaatctcccagcgccatcggaggaggaagagatggcctcgtcggttttttaatgcttgatcagattggtcaaactatagtaattaccacctttgattccaagtaatgtaggc

SEQ ID NO: 4479 - DNA, 816 bp, Artificial Sequence
  P2819 (35S::G3060)
caatttgatttctactctcgtatcggatctatacttaatcatggatactcgtaagagaggacggcctgaagctggctcattcaactccaatggcggcggatacaagaagtctaagcaagagatggaatcatattcaactggtttaggaagcaaatcgaagccatgcacaaaatttttcagtacttctggctgtcctttcggagagaattgccatttcttgcattatgttcccggaggatacaatgctgtatcgcagatgacaaatatgggaccacccattcctcaagtttccagaaacatgcaaggttctggtaatggaggccgattctcagggaggggagagtctgggcctggccatgtctctaactttggtgactcagccactgccagattcagtgttgatgcctctttagccggtgcaatcattgggaaaggcggagtcagttcaaagcagatatgtcgtcagacgggagtaaaattatcaattcaagatcacgagagagacccaaacttgaagaacattgtgcttgaaggaacacttgagcagataagcgaagcgagtgcaatggtaaaagatttgattgggaggcttaattcagcagctaagaaaccacctggtggtggtcttggtggtggtggtggcatgggttctgaagggaaaccacatccagggagcaacttcaagactaagatatgtgagagattctcaaaaggaaactgtacatttggtgatagatgtcactttgctcatggggaagcagagctacgcaagtcaggaatcgtctagttgttgcttgcagatagagaatttgctgg

SEQ ID NO: 4480 - DNA, 1332 bp, Artificial Sequence
  P2820 (35S::G3055)
tctcgaattcacgaaatctctcagcttttccgtgattcttggtaaaaattcacaaaatcgaaattggagaaagaaagaaaaaattagggtttgaggaaaagcttcgatttttcacacgatgagtcatcaccggcgagattccggcggagatgtagttcacgtgattcccacaaacaatcctccgccggataattggtttccgaatctcggcgatagtgctgtttgggcgacggaagatgattacaatagagcttgggctatgaatcccgataacacctccggcgacaacaatggtccaccgaacaagaagactcgaggctctccgtcgtcttcatcagccacgactacttctgctgcgagcaatcgtactaaagcgattgggaaaatgttcttcaagacgaagctttgttgcaagtttcgtgctgggacttgtccgtatataacgaattgtaactttgctcatacggtggaggagcttcgtcgtccaccgccgaattggcaggagattgtggcggctcatgaggaggagagatctggtggtatgggaactcctacagtttctgtggttgagattccacgggaggagtttcagatcccgtctttggtgtcatcgacggctgagagtgggagatcttttaaaggaagacattgtaagaagttttatactgaagaaggatgtccttatggagaaagttgtacgtttctgcatgatgaggcttcgaggaatagagagagtgttgctattagcttaggacctggtggttatggaagtggtggtggtggtggaagtggcggtggttctgttggtggtggtggtagtagtagcaatgtagtagtgcttggtggtggtggtggaagtggaagtggaagtgggattcagattttgaagccttcaaattggaagacaaggatttgcaacaaatgggagattactgggtattgtccatttggtgctaagtgtcattttgctcatggagctgcagagttacatagatttggcggaggactcgtggaagaagaaggcaaagatggagtatcacccaatccggacacaaagcaaacagtacaaaaccccaaaggactatcagacacaacaacacttctatctccaggagtacctcataatgcagatgccagttaccacactggagttgcattgcaacgagcgtctagtgcggttacacaaaagcctggaattagaactcatcagaagtggaaaggaccggcgaaaatcagtcggatatacggtgattggatcgacgatattgaatgatgttacctctttcttttttctacacatttagataactgctaagaaaattacaatctccc

SEQ ID NO: 4481 - DNA, 2194 bp, Artificial Sequence
  P2826 (35S::G2887)
ctttactggtgaagagtttacagaagattgttcaaagttttcccctttggattcttcgccaatggggaaaactcaactcgctcctggatttcgtttccatccgactgatgttgaactcgtgaggtattacttgaagaggaaaatactggggaaaaagctccttgtcgatgctattgctgaagttgacatttacaagtttgaaccccctgatttacctggtatccatttctaaaacactcttgttctgttcatgtgtttgcatctaagttctctgactcggagacttgttctttacagatatgtcttttataagaagtggggatcttaagtggcacttcttctgccccagggaaaagaagtatgctagtggggtaagggcaaaccgtgcaactgagtgtggctactggaagaccacggggaaggagagaccagttctgtgcaattctgaggttgtgggaaagatcaaaactctggtttatcactttggcaagtcgcctcgtggggagcggactgattgggttatgcatgaatacaggcttgacgacaaagtactgacgcagatgaatgttcctcaggtaatatatactacttattataaatggcaaatatgatttcaacttgaacaggtgtttaggtttacgagtatttactgatgatagcttgccgttttaatttgttccttaattgctttgatagtgtgttactgtcctgcctgcaattttttccttcttccacttatatattgtttcctgcttgtttagttttatagatttatgtatcatccatgtaagcttatatcactctctctttacttacaattatgttttggactgcaggatacttatgtggtgtgtgttctgttcaagaaagatggtcctggacctagaaatggagctcaatatggagctccgtttaaggaagaggactggagtgatgaggaagtacgtactgatgttccttctactagtaatcccacaaaccttcttgagcctagcaaagaaaccactctggctttgactgccccagatgactccaataaggattgttttggtggcatgatatcagagtcatgtgtctcggatttcctaccagctacaactaataccaccagcgagcttccacatccaagtgatgcagctaccactcctatgtctactgcacctctggcagagaccgttcagacccccaacaatgatgacttatattcaatgttggatctatttgatgatgacgaagagttcttagggttcaacaataatgaggtagtttttttttgcattcttcttctttggcttagtatagtgataacaagccggtgtcactgcatgttcttaagctagcaaggctactttaaagctgttaagtgttttagtggcattggaacgtagtagttacccattagacaaagcttctttgctatatcttcgatcttagtatccaacatcaatatgtgctcttttgtatctgcttgttctccaacatcaatatgtgctcttttgtatctgcaaaatacattctcatatttaatcaatctacaggtaagatatgatcccggtgtctcagctccagtttgcttagaagaagaaggcattttcaacggactaccagagttgagcagcatgccaaggacggcctcttacgacctagttgaaaactcggagttatacctagagctacaagacctcactgctccattaaatccccaaactgggctacaagacctcactgctccatttaatcctcaaactgggctacaagacctcactgctccatttaatcatcaaactgggctacaagaccacactgctccatttaatcctcaaactgggctacaagaccacactgctccatttaatcatcaaactgggctacaagacctcactgctccatttaatcctcaaactgggctacaagacctcactgctccatttaatcctcaaactgggctacatgacctcacttctccatttaatcctcaaactgggctacaagacctcactgctccattaaatcctcaaactgggaatcgcaatgacccgagaagctcctcctttctgtataatcaaggccattttgacttctctggtggtaatgatgatgatccttatggcttttctgcttccatgagacatagaccaaaaatgtaaaaaaagaagaagagaagagaagcaggatttacaaatccaacagatgc

SEQ ID NO: 4482 - DNA, 1402 bp, Artificial Sequence; identical to SEQ ID NO: 1673
  P2829 (35S::G2765)

SEQ ID NO: 4483 - DNA, 746 bp, Artificial Sequence
  P2831 (35S::G2839)
cttgaagtcactaagttgattcaaaatggttgcgagaagtgaggaagttgagatagtggaagatacggcggcgaaatgtttgatgttgttatcaagagttggagaatgcggcggaggaggagagaaacgagttttccgatgcaagacttgtcttaaagagttttcgtcgtttcaagctttgggaggtcatcgtgcaagccacaagaaactcattaacagtagcgatccatcacttcttggatccttgtctaacaagaaaactaaaacggcgacgtctcatccttgtccgatatgtggcgtggagtttccgatggggcaagctcttggtggtcacatgaggagacataggagtgagaaagcctcaccaggcacgttggttacacgttcttttttaccggagacgacgacggtgacgactttgaaaaaatcgagtagtgggaagagagtggcttgtttggacttagattcgatggagagtttagtcaattggaagttggagttgggaagaacgatttcttgattcgttttatttcttcatattcgttatagggttttaacatattttcatacagtttcatattgtaatctttgtagatccatttatcttaccgatcgatgtgaatattattttgatatacactattggagtttacattcaatgtacaaaaaaaaaaaaaaagggcggccgctctagagtatccctcgaggggcccaagcttacgcgtacccagctttggtgtgttcaa

SEQ ID NO: 4484 - DNA, 1213 bp, Artificial Sequence
  P2833 (35S::G2375)
ctcttctttttttcaatgaaacctctcttcatttataagtaacccaacaaaaaaataaaattatctccctcttatttcttctcttcacgtcacaaagacaattcgattccaaataatggaccgacgtaaccctttccaacatcaccaccaccaccatcagcttcatcatcacttgatccaacagcaacagcttcctccgccgccgctgagcaccacggcgacgatggatcccggcggaggaggaggaggtggggagagaatcccacagtggagcatagaggagacaaaggagcttttggctataagagaagaacttgatcaaactttcatggagaccaaacgtaataagcttctttgggaagtcgtggctgctaagatggccgacaagggttttgtccgaagcgcagaacaatgtaagagcaagtggaagaacctcgtcactagatacaaggcgtgtgagaccactgagccagatgctattaggcagcagttcccattctacaatgagattcagtcgatttttgaagcaagaatgcaaagaatgctgtggtcagaagccacagaaccaagcacttcctcgaagagaaaacatcatcaattttcatctgatgatgaagaagaagaagttgacgaaccaaatcaagatatcaacgaggaattattgtctttagtagagacacagaaaagagagacagaagtgattactactagtacttcgaccaatccaagaaaacgtgcaaaaaaaggaaaaggcgttgcgagtggtacgaaagctgaaactgcgggtaatacactaaaagatatattggaggagtttatgaggcaaacggtgaagatggaaaaggaatggagagatgcatgggagatgaaggagatagagagggagaagagagagaaagagtggcggaggagaatggcggagctagaggaggaaagagccgccacagaaaggaggtggatggagagagaggaagagagacggttgagagaagaagctagggctcagaagagagattctctcatcgatgctttgcttaataggcttaatagagatcataatgatgatcatcataatcaaggtttctaagttctcattatttgtgttaagcataagttaattagctagttaatttgttaggcaaatcaatttagataatatatctaaattaatgtttgttttataatatttatatgaactattgaaatttccaaa

SEQ ID NO: 4485 - DNA, 1765 bp, Artificial Sequence
  P2910 (35S::G2592)
gaggactatatgttaagtttatactaagaaaatggttttggtatgtttttgcagcgtttctctaaagtagaatctttggtattcggaaaaatgtcgtttctgagtattgttcgtgatgttagagatactgtaggaagcttttcgagacgtagtttcgacgtgagagtatctaatgggacgactcatcagaggagtaaatctcacggtgttgaggcacatattgaagatcttattgtaatcaagaacactcgttgggctaatttaccggctgcgctattacgagatgtgatgaaaaagttggatgaaagcgagagtacttggcctgcacgtaaacaagtcgttgcttgtgctggtgtctgcaagacatggagactaatgtgcaaagatattgtgaaaagtcctgagttctcaggcaaactcacatttccagtttcgttgaaacaggttcgtggtttcgttattcgttacttccattcgacattatgtcggttattctgacaactcttttgatggtgaagcccgggcctagggatggaatcatacaatgttatatcaaaagagacaagtctaacatgacttaccacctttacctttctcttagtcctggtaagttattcgtctttgtcgatgttactacctctgcttcagtaaaatttggactcaaaatttagtagaacacacatgtcatacttttgtttaaattcaatacttatcaagatcttgaaaatatcaagaactcgaattttctctattatttagtttttgaatcttgtcaaatttgtacagccatacttgttgaaagtgggaagtttcttctctcggcaaagcgctcacggagagctacatacacagagtatgtaatatcaatggatgcagacaacatttcaagatcaagcagcacttacattggcaaactgaagtaagaagaagatttaaaaaaaacatcattcgtccacatgttttgagttcttgattaattcagacaaacgtttgtcttacttcattttcaggtctaactttctagggacaaaatttatagtatatgatacggctcctgcgtacaacagtagccagatattgtccccaccaaaccggagtcgtagtttcaactccaagaaagtgtctcccaaagtcccttctggaagttacaacattgctcaagttacatacgagctgaacttgcttggaacccgtggacctcgtagaatgaactgcattatgcactctatcccctccttagctctagaacccggaggtactgtccctagccaacctgagtttctacaacgttcccttgatgaatctttccgcagcatcggttcctcaaagatagtcaaccactcgggagatttcacccgaccgaaagaggaagaaggaaaggtgcgacctttggtactgaaaactaaaccgccaaggtggctccaaccgttgcgatgttggtgccttaacttcaaagggagagtgactgtagcttctgtcaagaacttccagttgatgtccgctgcaacggttcagcccggtagtggtagtgatggtggagcattggctacgaggccatcgttatcaccacagcagccagagcaatcaaaccatgataagataatactacactttgggaaagtgggtaaggatatgttcactatggactatcgttatcctctctctgcctttcaagcgtttgccatttccctgagcacctttgatactaaattggcatgtgaataaaagtagaaagatcataagagggacttaaaactaataggaa

SEQ ID NO: 4486 - DNA, 1411 bp, Artificial Sequence
  P3279 (35S::G2699)
catggacatgtcattgtctccaccctactatactctttttttgttctttttgtttcctcttgtgtcacaaaaataacaagattaaacgtacatttctctctaaaaccagactcaaatgaccaaaacccggattctcaacccgacccgattcccttctcccaaacccttacgtggctgcggcgacgctaacttcatggaacagctcctccttcactgcgccaccgccatagactccaacgacgctgcattaactcaccaaatcctctgggtcctcaacaacatcgctccaccagacggtgactccacccaacgtcttacatccgcattcctccgcgcgttgctctcacgcgccgtctccaaaacccctacactatcatccaccattagcttcctacctcaggccgatgaactccatcgtttctcagtcgtggagttagccgctttcgtagacctcactccgtggcaccggttcggattcattgcagccaacgccgcgatcttaaccgccgttgaaggttactcaacggttcacatcgttgacttaagtttgactcattgtatgcaaatccctactcttatagacgccatggcaagccgactcaacaaacctcctccgcttcttaaactcaccgtcgtctcttcctccgaccacttcccaccattcatcaacatctcctacgaagaactcggatctaaactagtcaacttcgccaccacacgaaacattacaatggagttcacaatcgtaccttctacttactccgatggcttctcctccctcttacaacagttacggatttatccttcttcattcaacgaagctctcgtcgttaactgtcacatgatgctccgttacatccctgaagaacccctaacttcatcatcatcatcgctccgaacagttttcttgaaacaactccgatctttgaatccaagaatcgtaaccctaatcgaagaagacgtagatctcacatcggagaacttggttaaccggttaaaatcggcgtttaactacttctggattccgttcgatacgacggacacgtttatgagtgagcagagacggtggtacgaggcggagataagttggaagatagaaaacgtggtggcgaaggaaggtgcggagagagtggagaggacggagacgaagagacggtggatagagagaatgagagaggctgagttcggtggagttagggttaaagaagatgcggtggcggatgtgaaggcgatgctggaggagcacgctgtcgggtggggaatgaagaaggaagacgacgacgagagtctcgtgctgacgtggaaaggtcatagtgttgtgtttgctaccgtttgggttcccatttaaatcaggttgatttaatttaattagcgttttaattggatacctaatatagtagaatagcattgc

SEQ ID NO: 4487 - DNA, 1073 bp, Artificial Sequence
  P3286 (35S::G2830)
gtaatcaataacgtgccagatttgaaattaactaaataacaaatatattgactttgaattcatgaatttcaatatattaccttttttgcacttcaaaaatatataaaaggatacatagggaaataatttagatacacttagagctacaaaatgtcttccatcccaaataggttcaatatttatggtggtgataccacaaaccatcgtgaatcgcttcccatcgaaatgaatcacaactctcgaatggttcgatccatgttcattacatctgatcgcatgaatcatagagatttgttttcttctcctccttctttctcttcttatcaaaattcacatatctcttcatcttctgttgggtttaataattcacatatgacttatcatatgctgaaaagaaattatgattctgtttcccgtgctgattatttctctactaaagatcattctcattttactcaagtatctttcactcaaaccatcacaaataagtatactactattgttccttccaatatatttgacactgttcactatgatattggtcgtgtcaaacgtgccatagattttagaaatatttggaatcctaaatctcatcttccaaaaaaatttaataggcaatgcgagattttgaatcctacccctcttaatatcgtctttccgcaccaggattcagctgatcgtcaacatttagacattattttctcgtcatcaaagcacaaccatgttttccaagatggtcgatccttgaagaaaatttccgaaccaaccaatctgtttgaaaaatctaattcttatgattctcaagaagatgagaaaatcgatgcttatcaatatgatggtcgtacacatagtctaccgtatacgaaatacggtccatatacatgtcccaggtgtaacggtgtgtttgatacttctcaaaaatttgctgcacatatgttatctcactacaataatgagacggacaaagaaagagaccaaagatttcgtgcaagaaataaaaaacgatatcgtaagtttatggacagtcttaaaatatcaaaacagaagatatgatccgtcgcgatgggacgatc

SEQ ID NO: 4488 - DNA, 1019 bp, Artificial Sequence
  P3288 (35S::G2837)
ctgtcataaccgccatggttcagagaaaactttatataagggctaattcaatgtcgttttgaaacatcaatccctagactaaagtgcgaaaatagtatgagtaatccgaacccagagaaaacgaaagtggatgttactgaggaagagaaagaggaatctgatgagcaatggagcgatgaagaaaccaatatgagagaaattgttctcggcctccctgctttgaatatcagcagtagaatatttggagagagtagtagtgtcgttgaggaagatgcagaaaaagcgcgtttgaatgagcaagcggttcttgcggcggggttgattttggctgcggcagaggaagcggttatgaaaggaatgaatgagggaagtgggagtggtgggaagaaaaagagtagaccaaggatatctacgcaaaccgatgacgaaggggatggtttgggtgaaggagaagcgaaaaagccgaagaagaaagcaaaggaattgactcatccaccgaaaggaccaccggtttgtcatatctgtggaagaggtttcggttcgtggaaggcagtgtttgggcatatgagggctcatagagatagaaactatcaagggtttcttcctcctcctacattctctgcgggggctgaaaggtttgtgattcccgggctaagatctgcttttactattgccactgtcggaggaggaagttctggtggtgtagcggtaggaggaagaagttccggtgatttttctggcagtggtggtggtgatgcgccaggatctgaaggtgggagaggttcaggtattgatttgaatgtggaacctgtggagcaagtagaggaagcgactgaatctggatgtattgccaagttcgatcttaataaatctccaccaaaagatgaagaggaagaggacaaacccaagtgaaagattttttcatactatttaataatttactataacacatagtatagttattattttcatatttcatatttgatatatttatctaacacattatgttgattctttga

SEQ ID NO: 4489 - DNA, 773 bp, Artificial Sequence
  P3291 (35S::G3003)
tcgaccgtgggatctacttacgtatctgcatgattattagttataaaagttattgcaaacattaaattactttcatagagagcaatcattatattaaggtaatttaattttattatatatagtcaagatttaaaggaataaagaaaagattctcaaaacatttcatctctctccaacaactattcaccacattcaatggagtcaccaccactatacgagatatcctcaagctcttcttctgaaaaacctagacaccatttccaatcccttgatctcttccctaacctcaaccaaaactcttgtatcaacaataccctaattgagcctttaccgcttattgatcgcataaacttgaactcaaacctagacctaaaccctaatcccttgtatgcggaagaaggagagcaagaggaggaagaagaagaagaccgtgaagtggacgtggacttacacatcggccttcctggttttggtaaaccaagcaatgatgctaaacagctgaagaagagaaatgggaaggagatcgccacatatgacgccggaaaaggcatcgagaatgaactttccggaaaggcatactggatcccggcgccggagcaaattctcatagggttcactcatttttcttgccatgtatgcttcaagacattcaatcgctacaacaatcttcaggtacgagtcaatatatctcatgcgcattgcttttccatgcacaaacatatataataaattcatcttatagagttatatctccggatctaatgttatgaggc

SEQ ID NO: 4490 - DNA, 1867 bp, Artificial Sequence
  P3298 (35S::G1136)
ctacacgtcacctctctcttcttctcaccggaaaaaagtcttcacctttcaccggaaaatatcaccttttcaaccggcgtatgttcacatgaacggcacaacatcatcaatcaacttcttgacctccgacgatgacgcgtcggcggcggctatggaagctttcattggaacaaaccaccactcatctctctttcctccaccaccacaacaaccacctcagcctcagttcaacgaagatactcttcaacaacgtctccaagctttaatagaatccgccggagaaaactggacttacgctatcttctggcagatctcacacgacttcgattcatccaccggagataacacagtgatcctcggctggggagatggttactacaaaggagaggaagataaagagaagaagaagaacaacaccaacacggcggagcaagagcatcggaaaagagtaatacgtgagcttaactcgttaatctccggcggaattggggtttccgatgaatcaaacgatgaagaagtaacagatactgaatggttcttcttagtttcgatgactcaaagcttcgttaacggtgttggtctccccggagaatctttcttaaactctcgtgtgatttggttatccgggtctggtgctttaaccgggtcgggttgtgaaagagcgggtcaaggtcagatttacgggttaaagacgatggtgtgtatcgcgactcaaaacggcgtcgttgagcttggttcgtcggaggttataagtcaaagctcagatctgatgcataaagttaacaacttgtttaatttcaacaacggtggtggaaacaatggtgttgaagcttcttcgtggggttttaatctgaatccagatcaaggagagaatgatccagctttgtggattagtgaaccgacgaacaccggaatcgaatctccggcgagggttaataatggtaataactcgaattctaattctaagtctgattctcatcaaatttctaagcttgagaagaatgatattagctctgtagagaatcagaatcgtcaaagttcgtgtcttgtcgagaaagatttgacctttcaaggtgggttgttgaaatctaatgagactttgagtttctgtggtaatgagagtagtaagaagagaacttcggtatctaaagggagtaataatgatgaagggatgctttcgtttagtactgtggttagatcagctgcgaatgattcggatcattctgatcttgaagcatctgttgttaaggaagcgattgttgttgagccaccggagaagaagccgaggaaacgggggaggaaaccggcgaatgggagagaagagccgttgaatcatgttgaagcagagaggcagagaagagagaagttaaaccagagattctactctttgagagctgttgttcctaacgtttcgaagatggataaagcttcgcttctcggagacgcgatttcgtatatcaatgagcttaagtcgaagctgcagcaagcggagtctgataaagaggagattcagaagaagctagatgggatgagtaaggaagggaataatgggaaaggttgcgggtcaagggcaaaagaacggaaaagttcgaatcaagattctacggcgagttctatagaaatggagattgatgttaagatcataggttgggatgtgatgatacgtgtacaatgcggcaagaaagatcatcccggtgctaggttcatggaagcacttaaggaattggatttggaagtgaatcatgcgagtttatccgttgtgaatgatttgatgattcaacaagctacggtgaagatggggagccaatttttcaatcatgaccagctcaaagttgctttgatgacgaaagtcggagaaaactattga

SEQ ID NO: 4491 - DNA, 2488 bp, Artificial Sequence
  P3299 (35S::G324)
tcgaccataagtgaacacagaagaagcggtggctctgagccggcgaaatctcctttctcatccctaaaattttcatgtccatcttgcctcctccgattatccaaggtcacaattcgtcttctccttcttcagattcctctctaaaccctagctctgagcatggcaacaactcttcttcttctctctctcctcttccctcctctcctccttcccggatctcttcttccaccggaactcgattctccggacattctgaatcctctcacaatttctccggtggctctagggaaccgagtgttgcagctgaggagggacatagccgtggatcttccaaagagatgacacaaaatggagcagggaaggagagtttttccccacctaatgcagataagcgtgaccattttcgatatgatggtcgaaggaataggtctagagggagaggtactggagctgctggttcttcttcttctcaattgcagcataattccggaccttttaattctcctagaggcggtgtttcgcatcataatccaactggtagaagagctaatatgataagtgggaatcatttactgaattttcagtatgatccgatttcgcaaccgcaatctaggggtcctcctccgcctcaaagaaggcaacaatataaggggaggccttttaacaaggatttgtttcttaaggccaattataagtttgttgtgttggacactggagatcattctcctgattcaatggatcctgataaaatgctgcagtgggatgatattatttgtgtaaggtattctactccgtctcctgtccagtgtccgatttgcttggagtatcctctatgtccgcagattacttcctgtgggcatattttctgtttcccgtgtattctacagtacctgttgactggtgttgataaccacaaggtggactgcttcaagaggtgtcctttgtgctttgtgatgatttctccaagagagttatacactgtttatattgagaacgtcaagcagtattctgttggagatcccatcgagtttgtacttttgactcgcaagaaagattcttttgctcctacccggaaaaatgagcatgacttggctgttcctaatggtgaaaatgagatatatgatccgttctcaaagttcactttcacccaagatgttgatctctctgtcagacaagcagtttcagagttagacagttggattgcaagagcagatcctcagctcgttgaagacttggagaagcatctttatgtaaatgccgctttagagcgtttggagcagagaaaattgtactggaatgagcataagctctctatttacagcaaagtgtgcacaacggctagaaatcagactcaatcattgtcacctcctgatgtttctcgagttggttatcaagcacccatggggggccatggagcgccagatagcggctccaatgatcaagataaatcaactgaagattcttcagcggataagtcagatggagaatctcaatcaagtttggaaaagggttgtgataatgatcttggtcatcctctagaagatcaagacgcaccgtcatcttcctcatgcaatggaagtaaaggtttcctgtctcaccaaattgacaccaaagacctgaaggacaacgacgcgtacaacttttatcagtctgttgatggtcagcacattatccttcacactttgaatgtgaagtgccttctgcatcactatggaagctatgactttcttccaccaagattgagtggaaagatactggaaatggaaaccattacccaatcagaagcgataaggagacgctaccgctttttaagtcatttttctttatcaactacacttcagatatgtgagattgatatgaaggaatccttgcctcctgatgcatttgctccatttatacatgaaattaagaagcgtgtgaagcagcggaaagaacgtgcttggaaggatcgaaaaaataaaatcaaagctgaagtagctgcagctgcagagcttgtaccattgatggccagttttgggcagtcgtcttctagtgatgactttcccccattttccttggatgactttgaagctctgggaaactctgccccaatatcatcaagccctccaaacattggagagagaagttccttctcacatgtgacaaggctcggtttcgcagctggtcacgactccccaaacctgaataacgagccaacaaacgttcaaagcagcagcagcagcagtgaagtctcaaacgcaaccacaggtgcaagaaacacaaacataacatcctttgcgagtgtagcttcaagaacaacaacaccaatggcaccaaccgtcaaagagcccggtaagagagggaagaaacagagccgagtacttctatcgacaactagtgtacgccgttactgaaaaggcctatggatttgtgtatgtataataatcttttcatctaagaaaaactgagtaaagaaagaaccagagattatggtgagtgagtaagtggc

SEQ ID NO: 4492 - DNA, 1621 bp, Artificial Sequence
  P3303 (35S::G1361)
ctccctcatacctttgtttattctgatgaagttgtgagcactgaaagaaaagaagagaggagaagagagatatgcacaagaagaattaaacttagggacacaaaacaacatgacttggtgcaatgaccgtagcgatgttcagaccgttgaaagaatcattccctccccgggggcggctgagtcccccgtagcctcacttccggtctcttgtcacaaaacttgcccttcttgtggccataacttcaagtttcacgaacaggttcttgtttctctttctacctatatcaagtttaaactttagatgatattggatatttgaatataatatattaatatgtaatgtaggctgggatccatgacttgccgggacttcctgctggagtaaaatttgatccgacggatcaagaggtcttggagcatcttgaaggcaaggtaagagatgacgcaaaaaagcttcatcctctcattgatgagtttatccgtaccatcgatggtgaaaacggcatttgttatacccatcctgaaaaattgccaggtgattctatgttgcatgttcaatcatcaattaatcggttacaaattgagactatagttacaaattttccgtcttcaaatgatcttctagttatgcttattgaaaactacataaatacgttgaaaaaacaatttaatcatattttaatacgatggaaattgtcatatagaaaaagaaaatgtagctaatccaatttcttaattaaattaagtttgatgaatgctaattagtcgttgaatacatatataggagtgaacaaggacgggacggtgcgtcatttcttccaccgaccgtcgaaggcatacacgacgggaacaagaaagcgacgtaaagtccacactgattctgacgtcggtggagagacacggtggcacaagacaggaaaaacacggccagttcttgctggaggaagagtgagaggctacaagaaaatcctagtgctctacacaaactacggcaaacaaaaaaaacccgagaagactaattgggtaatgcatcaatatcatcttggcactagcgaggaagagaaagaaggtgagctcgtcgtctccaaagtcttttaccagactcaaccacgtcaatgcggtggctccgttgctgctgcagccaccgctaaggaccgaccttacctccacggcctcggtggaggtggtggccgccaccttcattaccatcttcatcataacaacggtaacggtaagagcaacggcagtgggggaaccgccggagccggtgagtattatcacaatattccggctattatctcgttcaatcagaccgggatacagaaccacttggttcatgactctcaaccttttatcccttaaaaacaaaatgattttatatcaacgatcctaaaataaaacaaacggtatataatctaagcattatctttgatatacacatacatatatacgttgaaaataatttaaaatttacagtgcattcttgtattcgtaacttgttttttgtttctcttaattcttttttccttttgattttacggctttgtacaatttaaattccttggactgagactgaccatgaaaaatatgtacaaagatctccattggctattgttacatg

SEQ ID NO: 4493 - DNA, 3077 bp, Artificial Sequence
  P3308 (35S::G434)
gatcacactcactatatgtccagggagctaaacctctatatcgagtactaatagtatgcaatgtccaggttattgcattgagggaaaatgaatggacaaggtgatttggatgcggttggaaacattccaaaaccaggtgaagctgaaggcgatgagattgatatgattaatgatatgtctggtgttaatgatcaagatggtggaaggatgagaagaacccataggcgcactgcttatcaaactcaagaacttgaaaagtttgttcactttcttcttcatttcatcatcatgcaacatttcctattattttttttatttttttattttgagtttggaatgtttctctttactttgctctttactttaaaatgagtgtagtttctacatggaaaatcctcatcccactgaagaacagaggtacgagcttggacaaaggcttaatatgggtgtcaatcaagtcaagaattggttccagaataaaagaaatctcgagaaggtaccaaaaaatacagaagtgtatacatgcatgtggctgtgtcttttcttattctttgcacgtaccgtattatggaccatgtttctgccctatgttaaaaacaaatactgtatatagtttaccacctctctctctcatcctcaaaatctgccttgattatggtataattattgagtgtggttttttgggtaagcagatcaataatgaccaccttgagaatgtaactcttagagaagagcatgacagattgctagcaactcaggatcagcttagaagcgcaatgctacgtagtttatgcaacatttgtggtaaggcaactaattgtggagacactgaatatgaggtgcaaaaacttatggctgagaatgctaacttggagcgggagatagaccagttcaattccagatacctttctcatcccaaacaaaggatggtcagtacatccgaacaggcgccttcttcttcctctaatccaggaataaatgcaacaccagtacttgattttagtggtggaactaggacgtctgagaaggagacatcaatttttctgaatcttgccattacggctttgagagagttgattacattgggagaagtggactgtccattttggatgatagatccaatcgttagatccaaaggagtatcaaagatctatgagaagtatagaagttctttcaacaatgtcacaaaacctcccgggcaaattgtggaggcttcaagagctaaaggtttagttcccatgacttgcgtgactctggtcaagactcttatggacacagtaataacctttaaaccaccacccattttttagtgaaatgttgttacatgaaatgttaacaagttttttttttttttttaaacagggcaaatgggtcaacgtgtttgcacctatagtccctgtggcatcaacccataaagtgctatctaccggttctggtggaaccaaaagtggctcactccaacaggtataatatatatagttttctgagtcgtctatattggttgataatccaagagaagtagaaacatttcaaatttgtgatcatataattttggcagattcaagcagaatttcaagtaatttctccgctggtaccaaagagaaaagtaacgtttattagatactgcaaagagatcagacagggcttatgggtggtcgtcgacgttactcctactcaaaatccgactttgctgccctatggttgttctaagaggctaccctcaggccttatcatagacgacctgtccaatgggtactcccaggttacttctgaatcctgttctttgaacaatatatgttggttcacttgttattactcgcaatcataattaatgatctatcagagcatcttgtactgtggagacataaataaatggttaatggttattattatattcaccacatgtataacacatagagatttgatttcacaggttacatggattgaacaagcggaatataatgagagtcacatccaccaactctaccagcctttgattggctatgggatcgggctaggtgcaaagagatggctcgcgacgctgcagagacactgcgaaagcctctcgaccctttcatctaccaacttgactgaaattagtccaggtgaaagctatttaaattatagaataaatctcattacaactactttttaggtcattttcggttctccactaaatttggacaggccttgattgtgatatatgttttcgatataggattgtctgcaaaaggtgcaactgaaatagtgaagctagcacagcgaatgactctcaactactacagaggtattacgagtccttcggtggacaagtggcagaaaattcaggtggagaatgtggcacaaaacatgagtttcatgatccgaaagaacgtgaatgagcctggtgagctaactgggattgtgctgagtgcatccacttctgtttggctcccagtgaaccagcatacactctttgctttcattagccacctgagtttcagacacgagtgggatatcttgaccaatgatactaccatggaagaaacaatccggattcaaaaagcaaaacgccatggaaacatcatctctcttctgaaaatcgttgtgagtttcaaaacatttatttttggtttaatgagtgtcgttttgtctatgtttccattgattttcgtgagttttgcaatgcaaacagaataatggtatgctggttctgcaagagatttggaatgatgcatcaggtgcaatggtggtgtatgcaccagtggaaaccaattctattgagctggtcaagagaggtgaaaattcagattctgtgaagtttcttccttcgggattttcgatagtgccagatggagtaaatgggtcatatcatagaggcaatactggtggaggatgtctactgacatttggacttcagatcttggtgggcatcaatccaactgctgcactcattcaaggtactgtcaaaagtgtcgagacactcatggctcatactattgtcaagatcaaatccgcgttagatttacagacgtaaccatcagcagctccagtttccgttgttccgcaagaaattcgacattggcttgccctagttt

SEQ ID NO: 4494 - DNA, 859 bp, Artificial Sequence
  P3310 (35S::G140)
atggagggtggtgcgagtaatgaagtagcagagagcagcaagaagatagggagagggaagatagagataaagaggatagagaacactacgaatcgtcaagtcactttctgcaaacgacgcaatggtttactcaagaaagcttatgagctctctgtcttgtgtgacgctgaggttgctcttgtcatcttctccactcgaggccgtctctacgagtacgccaacaacagtgtgagaggaacaatagaaaggtacaagaaagcttgctccgacgccgttaaccctccgaccatcaccgaagctaatactcagtactatcagcaagaggcgtctaaactccggagacagattcgggacattcagaatttgaacagacacattcttggtgaatctcttggttccttgaactttaaggaactcaagaaccttgaaagtaggcttgagaaaggaatcagtcgtgtccgatccaagaagcacgagatgttagttgcagagattgaatacatgcaaaaaagggaaatcgagctgcaaaacgataacatgtatctccgctccaagattactgaaagaacaggtctacagcaacaagaatcgagtgtgatacatcaagggacagtttacgagtcgggtgttacttcttctcaccagtcggggcagtataaccggaattatattgcggttaaccttcttgaaccgaatcagaattcctccaaccaagaccaaccacctctgcaacttgtttgattcagtctaacataagcttctttcctcagcctgagatcgatcttatgcatatatatattcatgttacacttactgtcaaaaaacttaaaatgcagatggtaacgatttgagagggacc

SEQ ID NO: 4495 - DNA, 775 bp, Artificial Sequence; identical to SEQ ID NO: 289
  P3312 (35S::G351)

SEQ ID NO: 4496 - DNA, 1041 bp, Artificial Sequence
  P3315 (35S::G129)
cattttctgcaacttctccaaatctcatactttccagaaaatcattttcccaagaaaaataaaactttcccctttgttcttctccccccaacagcaatcacggcgtaccaatcggagctaggaggagattcctctcccttgaggaaatctgggagaggaaagatcgaaatcaaacggatcgagaacacaacgaatcgtcaagtcactttttgcaaacgtagaaatggtttgctcaagaaagcttacgagctctctgttctttgtgatgctgaagtcgcactcatcgtcttctctagccgtggtcgtctctatgagtactctaacaacagtgtaaaagggactattgagaggtacaagaaggcaatatcggacaattctaacaccggatcggtggcagaaattaatgcacagtattatcaacaagaatcagccaaattgcgtcaacaaataatcagcatacaaaactccaacaggcaattgatgggtgagacgatagggtcaatgtctcccaaagagctcaggaacttggaaggcagattagagagaagtattacccgaatccgatccaagaagaatgagctcttattttctgaaatcgactacatgcagaaaagagaagttgatttgcataacgataaccagattcttcgtgcaaagatagctgaaaatgagaggaacaatccgagtataagtctaatgccaggaggatctaactacgagcagcttatgccaccacctcaaacgcaatctcaaccgtttgattcacggaattatttccaagtcgcggcattgcaacctaacaatcaccattactcatccgcgggtcgccaagaccaaaccgctctccagttagtgtaatataggctgaaggaaatggccgggagtgaataaaaaccagaattgggttgagcaagcaatataaagctaatgcatgttatatatatatttatcccatgaatgttgtatcagtgaattttatgcttatgttgatgtgaaattaatatcttaaagacatgtcattaatgtgcttaatttgcttca

SEQ ID NO: 4497 - DNA, 1472 bp, Artificial Sequence
  P3320 (35S::G2443)
ttctttcagataccagctcccacaccatcaaacttactacatctgagttattatgttgaaacaagagagtaacgacataggtagtggagagaacaacagggcacgaccctgtgacacatgccggtcaaacgcctgcaccgtgtattgccatgcagattctgcctacttgtgcatgagctgtgatgctcaagttcactctgccaatcgcgttgcttcccgccataaacgtgtccgggtctgcgagtcatgtgagcgtgctccggctgcttttttgtgtgaggcagatgatgcctctctatgcacagcctgtgattcagaggttcattctgcaaacccacttgctagacgccatcagcgagttccaattctaccaatttctggaaactctttcagctccatgaccactactcaccaccaaagcgagaaaacaatgaccgatccagagaagagactggtggtggatcaagaggaaggtgaagaaggtgataaggatgccaaggaggttgcttcgtggctgttccctaattcagacaaaaataacaataaccaaaacaatgggttattgtttagtgatgagtatctaaaccttgtggattacaactcgagtatggactacaaattcacaggtgaatacagtcaacaccaacaaaactgcagcgtaccacagacgagctacgggggagatagagttgttccgcttaaacttgaagaatcaaggggccaccagtgccataaccaacagaattttcagttcaatatcaaatatggctcctcagggactcactacaacgacaatggttccattaaccataacgtaaggcttttgtatatttgttaccccttcaatttagcatcttcccataacgcagcagggtgaattctttcatcatacacacaaatccactgatccactgccaacagttgatctatagcacatagaaatttcaccagaagtctataataaaaacaatatatgcttccttttgcatcgactctctttagtcctcttaccagggggattgagaatgtctttgtttctgtcattaggcatacatttcatccatggaaactggtgttgtgccggagtcaacagcatgtgtcacaacagcttcacacccaagaacgcccaaagggacagtagagcaacaacctgaccctgcaagccagatgataacagtaacacaactcagtccaatggacagagaagccagggtcctgagatacagagagaagaggaagacaaggaaatttgagaagacaataaggtatgcttcgaggaaggcatatgcagagataagaccgcgggtcaatggccggttcgcaaagagagaaatcgaagccgaggagcaagggttcaacacgatgctaatgtacaacacaggatatgggattgttccttcattctgatactccctgtggcaaaaagaaaaactagattgcaagctgtaaattacttttagtttgacattatg

SEQ ID NO: 4498 - DNA, 1880 bp, Artificial Sequence
  P3322 (35S::G2453)
tcgaccctcattcatcgtacacacacactctctatgacaaagctccccaacatgacgacaacactcaaccatctatttgatctgccggggcagatttgccatgtccagtgtggtttttgcaccactattttgctggtataccttaacttcttctcttattctctcccttcctttctcccttcctctctttatatatatgatcatgagtttaatgagtgtaaatgtgttgcaggtgagtgtaccgtttacaagcttgtcaatggtggtgactgtgagatgtgggcattgcacaagccttctctctgtcaatttgatgaaggcttccttcattcctctccatctccttgcttctctctcccatcttgatgaggtttccataacatctatacatagacaaacacacaccatctaaatatgaccaatatatatatatatatacttacttttgattatatgtaaatatatgtgcagaccgggaaagaggaggttgcagctacagatggtgtggaagaagaagcatggaaggtgaatcaggagaaggagaacagtccaacgactttggtttcatcttcagacaatgaagatgaagatgtgtctcgtgtttaccaagttgtcaataaacgtacgtttgagtataaattcaacttaaactttagttttgcgatttctcctttcatcagtcgtctaattatgttttgagtttgtatatatatagcacctgagaagcgacaaagagctccttcagcttacaattgcttcatcaagtaagaaataaattcaacacattacatgtgtatgtatattatatatattcttacaaatttaaccacttaaggttttgagtttgtaaaatggttcttctttgggggttgtattggagcagggaagagatcaggaggttaaaggctcagaatccaagcatggctcacaaggaagctttcagcttagctgccaaaaatgtacttaagcttaattagtcttaagatttaaaagaaaaccctaatatagttttcatctttttgttagcttaattgacagatcgagttagctaataacattttatgatttcaattttttgatttggggatggcgaagtgggcccattttcctccagctcacaacaagagagctgcttcagatcaatgtttttgtgaggaagataacaatgcgatactaccatgcaatgtttttgaggtaatcctcagcaaccatttatattttttaatcactttcgcttcaaaatcaattaccatattcttgacaagtaaactccacaacaagtgtcattttccaaagcaaaccaaataattaaagcattaactagatccaaatagcatcgctctcagtcaaaatttcagaaccctagctagactaattatataaagagaaatcatttactaattattagagtgaaagcaaggagaagggtaagtgagattgtgagaatatatcattgatcttcaactactacaatgtgtgaaatttatgacctaaacccttttatagtattgaagcttacactgcacacagtttacttttatagaaacccattcaactaatttaaaacattgaagctgaatatgtatagttttcaattaatataccaaataattgttgaaatgtttgtgatgcaggaccatgaagaaagcaataatgggttccgagagagaaaggctcagaggcattccatttggggaaaatctccatttgagtaataacaatttgggatatgaaaatttaacaaaaaaataaataatggcgtatgacatgtgatggtgacctgaattggttcctttaaagcctgcttttttgtacaaagttggcattataaaaaagcattgcttatcaatttgttgcaacgaacaggtcactatcagtca

SEQ ID NO: 4499 - DNA, 870 bp, Artificial Sequence
  P3326 (35S::G1753)
aagctgtgatcaattcctcccaaaccattttctaactggtttgcactttcttcactctcttctcttcactcttcactacgtacttcactctccaactaacttaactgcaccataaaatggcttcgatctcttcctctccttcctcaaactcatcactcttctctactcaaaaccctaatactcattatcaatatgcaaggaacctccaaagacaatggcggccgccaccctttgtacaggggagtaaggcagcgaaagaactcaaacaaatgggtttctgagatccgtgagccgagaaaacctaaccgtatctggttaggaacattctctacccccgagatggcggcaatagcctatgacgtggcagctctagccctcaaaggcagtcaagctgagctcaacttcccaaactcagtttcctctttgcctgccccaacctccatgtctccagcagacatccaagcagcagccgcttcggccgctgctgcttttggtgctgctagggatgcgattgttatggcaaataataacagccaaacaagtggtgtggcttgcatgaatagtagttatgataatacaaatatgaatggattcatggacgaggatttggtattcgacatgcctaatgtgctcatgaatatggctgaaggaatgcttcttagcccccctcgtcctactgtctttgatgctgcttacgacgctgatggttttcctggaggagacgattacttgtggaattttccatgatagttaaacaaaccaaccatataaatatgtgattttgtgtgtttctatatatgtatgtatgaaataaataaatatggtgtctagtgatgcattgtatgcatggttaggcccgttaagaccgta

SEQ ID NO: 4500 - DNA, 896 bp, Artificial Sequence
  P3327 (35S::G2934)
ttggagatctgacactggtaaagctcaaagtgtcaaactatggatccttataagaatcttaatccaaaaggttaccagagacagagaccgtttagctcagccggcgagagtggcggcagcggcggctccggtacggcccatgaaacagatgacaataagaagaagaagaagcttctccaccgcgacatcgaacgccaaagaagacaagaaatggctacactctttgctactcttcgtactcacttacctcttaaatacatcaagggaaaaagagctgtgtcggatcatgtaaatggagcggtaaatttcattaaggacacggaagcacggattaaagaacttagtgcaagaagagacgagttaagtagagaaaccggccaaggatataaatcgaatccggatccaggaaaaactggatccgatgtaggcaaatcggagccggcgactgtgatggtgcaaccacacgtgagcggtttagaagtggtagtgagcagcaactcctcaggccccgaagctttgccactatcaaaagtgctcgagacaattcaggagaaagggcttgaagtcatgagctccttcactacaagagtcaatgataggctcatgcacactattcaagtagaggttaatagtttcggatgcatagacttattatggttgcagcagaagctagttgaggatttgatactttcgacggggtactaatcatgcagaaacataccattcgtagtcctaaagaacttcctcatcaaaaaatcaaagtcttcttgaaatttcgttatgagagcaaggtgcataggtgttaaagttcattcatggattgaggtgtagctttggtttaaacaagttcaagtgacttcatggggtagatcataacttcaccatgattcgccgcc

SEQ ID NO: 4501 - DNA, 780 bp, Artificial Sequence; identical to SEQ ID NO: 3858
  P3354 (OPLEXA::G156)

SEQ ID NO: 4502 - DNA, 1051 bp, Artificial Sequence
  P3359 (OPLEXA::G226)
tccagtagttatggataataccaaccgtcttcgtcttcgtcgcggtcccagtcttaggcaaactaagttcactcgatcccgatatgactctgaaggtctctcttcaattcattactctacactcatcctcctaactcgtcagcgttaaattatcttctcatttaatttttgtttggataaaacgaaacaaaaatgcagaagtgagtagcatcgaatgggagtttatcagtatgaccgaacaagaagaagatctcatctctcgaatgtacagacttgtcggtaataggtaacaaattctcttcttctgtcatgtccgattcaacatattttaaaaacaactagtattttataaaattaaaaaaaaaaaaaaaaaaactagtattttataatttaaaaaaaattcacatggcgagagtaacaaatcaaagctgataaagtgttatgttatggtaaacatgattctagagtagtttagactttcgaacgtgtttcgagaaaaatgacatgccaatatttaagcaatgacatgagtattttacttgtataatttcaaaaaaagttttatgttgttgataaactgataaaatgtataattaacagaaactaaaatttcttcttttcttaaagtgtgatgattttaaaaacagtgaaaggattgaataatatattggctcttgaatattattgtctttatatatatacattttaaatttcatttctgcattatatatgttgactcctgaattttgataaatgttttttcagaattttgtgctcgtctataattcaaaaacacattatatgcttgaatattgattgtcaggtgggatttaatagcaggaagagtcgtaggaagaaaggcaaatgagattgagagatactggattatgagaaactctgactatttttctcacaaacgacgacgtcttaataattctccctttttttctacttctcctcttaatctccaagaaaatctaaaattgtaaagaaatcaaaataaaagctttcaatcataaaagtagaacaaatcttgaatgtcttctcatca

SEQ ID NO: 4503 - DNA, 686 bp, Artificial Sequence; identical to SEQ ID NO: 3929
  P3367 (OPLEXA::G975)

SEQ ID NO: 4504 - DNA, 973 bp, Artificial Sequence
  P3369 (OPLEXA::G1073)
ggcaagaactgcatctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggtt

SEQ ID NO: 4505 - DNA, 1012 bp, Artificial Sequence; identical to SEQ ID NO: 4152
  P3371 (OPLEXA::G1760)

SEQ ID NO: 4506 - DNA, 734 bp, Artificial Sequence; identical to SEQ ID NO: 4097
  P3372 (OPLEXA::G1820)

SEQ ID NO: 4507 - DNA, 1160 bp, Artificial Sequence
  P3373 (OPLEXA::G1930)
attcacattactaatctctcaagatttcacaattttcttgtgattttctctcagtttcttatttcgtttcataacatggatgccatgagtagcgtagacgagagctctacaactacagattccattccggcgagaaagtcatcgtctccggcgagtttactatatagaatgggaagcggaacaagcgtggtacttgattcagagaacggtgtcgaagtcgaagtcgaagccgaatcaagaaagcttccttcttcaagattcaaaggtgttgttcctcaaccaaatggaagatggggagctcagatttacgagaaacatcaacgcgtgtggcttggtactttcaacgaggaagacgaagcagctcgtgcttacgacgtcgcggctcaccgtttccgtggccgcgatgccgttactaatttcaaagacacgacgttcgaagaagaggttgagttcttaaacgcgcattcgaaatcagagatcgtagatatgttgagaaaacacacttacaaagaagagttagaccaaaggaaacgtaaccgtgacggtaacggaaaagagacgacggcgtttgctttggcttcgatggtggttatgacggggtttaaaacggcggagttactgtttgagaaaacggtaacgccaagtgacgtcgggaaactaaaccgtttagttataccaaaacaccaagcggagaaacattttccgttaccgttaggtaataataacgtctccgttaaaggtatgctgttgaatttcgaagacgttaacgggaaagtgtggaggttccgttactcttattggaatagtagtcaaagttatgtgttgaccaaaggttggagtagattcgttaaagagaagagactttgtgctggtgatttgatcagttttaaaagatccaacgatcaagatcaaaaattctttatcgggtggaaatcgaaatccgggttggatctagagacgggtcgggttatgagattgtttggggttgatatttctttaaacgccgtcgttgtagtgaaggaaacaacggaggtgttaatgtcgtcgttaaggtgtaagaagcaacgagttttgtaataacaatttaacaacttgggaaagaaaaaaaagctttttgattttaatttctcttcaacgttaatcttgctgagattatttat

SEQ ID NO: 4508 - DNA, 505 bp, Artificial Sequence; identical to SEQ ID NO: 4055
  P3375 (OPLEXA::G3)

SEQ ID NO: 4509 - DNA, 904 bp, Artificial Sequence
  P3376 (OPLEXA::G22)
atacacaactacttatctcttcacttcattagtctccaagaagaaaacatctctcactctctaaaatacacactctcatcaaaaaccttctcttcggttcagaagcattcaagaatccattatgagctcatctgattccgttaataacggcgttaactcacggatgtacttccgtaacccgagtttcagcaacgttatcttaaacgataactggagcgacttgccgttaagtgtcgacgattctcaagacatggctatttacaacactctccgtgatgccgttagctccggctggacaccctccgttcctcccgttacctctccggcggaggaaaataagcctccggcgacgaaggcgagtggctcacacgcgccgaggcagaaggggatgcagtacagaggagtgaggaggaggccgtgggggaaattcgcggcggagattagggatccgaagaagaacggagctagggtttggctcgggacttacgagacgccggaggacgcggcggtggcgtacgaccgagcggcgtttcagctcagaggatcgaaagctaagctgaattttccgcatttgattggttcttgtaagtatgagccggttaggattaggcctcgccgtcgctcgccggaaccgtcagtctccgatcagttaacgtcggagcagaagagggaaagccacgtggatgacggcgagtctagtttggttgtaccggagttggatttcacggtggatcagttttacttcgatggtagtttattaatggaccaatcagaatgttcttattctgataatcggatataattagttttaagattaagcaaaatttgtccaacgagttttgctgtatgaaatatctatcgatgactcaacaggttttgatcatgatcatatgtaatgtgatgg

SEQ ID NO: 4510 - DNA, 732 bp, Artificial Sequence; identical to SEQ ID NO: 3816
  P3404 (OPLEXA::G489)

SEQ ID NO: 4511 - DNA, 748 bp, Artificial Sequence; identical to SEQ ID NO: 893
  P3412 (OPLEXA::G1275)

SEQ ID NO: 4512 - DNA, 1008 bp, Artificial Sequence; identical to SEQ ID NO: 4038
  P3424 (OPLEXA::G1543)

SEQ ID NO: 4513 - DNA, 1366 bp, Artificial Sequence
  P3573 (OPLEXA::G558)
cagcgcccagaatgctccgggtgaccaacatttgttcctgattcatttcctattggttcgtattgtctgtgcacacaagagaaatttcaagaagttgttactaaaagagaggccacaagtggatattgtctttgttatcaagtgttagtacagaaaagtggtgagaaagtaatatggctgataccagtccgagaactgatgtctcaacagatgacgacacagatcatcctgatcttgggtcggagggagcactagtgaatactgctgcttctgattcgagtgaccgatcgaagggaaagatggatcaaaagactcttcgtaggcttgctcaaaaccgtgaggcagcaaggaaaagcagattgaggaagaaggcttatgttcagcagctagagaacagccgcttgaaactaacccagcttgagcaggagctgcaaagagcaagacagcagggcgtcttcatttcaggcacaggagaccaggcccattctactggtggaaatggtgctttggcgtttgatgctgaacattcacggtggttggaagaaaagaacaagcaaatgaacgagctgaggtctgctctgaatgcgcatgcaggtgattctgagcttcgaataatagtcgatggtgtgatggctcactatgaggagcttttcaggataaagagcaatgcagctaagaatgatgtctttcacttgctatctggcatgtggaaaacaccagctgagagatgtttcttgtggctcggtggatttcgttcatccgaacttctaaagcttctggcgaatcagttggagccaatgacagagagacagttgatgggcataaataacctgcaacagacatcgcagcaggctgaagatgctttgtctcaagggatggagagcttacaacagtcactagctgatactttatcgagcgggactcttggttcaagttcatcagggaatgtcgcaagctacatgggtcagatggccatggcaatgggaaagttaggtacactcgaaggatttatccgccaggctgataatttgagactacaaacattgcaacagatgataagagtattaacaacgagacagtcagcacgtgctctacttgcaatacacgattacttctcacggctacgagctctaagctccttatggcttgctcgacccagagagtgaaactgtattttggtcacatgtcagctgtacaaaatccatatggacacaaaaccaggagagactattaatcaacacttgtcagattcttcttaccaaatccatcaacaaataagcaaatttctgggaaacaaaagactctttgtatgtaggtttcttctacatggttgtggtaattcatgttgttttagttgtagtcatca

SEQ ID NO: 4514 - DNA, 1564 bp, Artificial Sequence
  P3580 (OPLEXA::G1078)
cggttagtaattcgatgagacggcatcatcaacaaccttcaccaatgccgcaagtatacggcggcgctgaacaaagtaaatatgataaagcagatgatgctacgatatcttctggtagctatagaggcggaggagatatcgctgacatgaagatggtagttaggcatagggatttgaaagaaatcatcgatgccattaaggaaaatttcgataaggctgctgcctcaggggagcaagtctctcagatgctcgagcttggcagagctgagctcgatcgtagtttcagccaattgaagaaaacggtgattcattcgagtagtttattaagcaacttgagctcgacatggacctcgaagccgccattggcagtcaagtataggatagacacgactgcgctggatcaaccgaacagttcgaagagcctttgttccactcttgaccgtctcttggcatgggagaagaagctttatgaagaaattaaggctagagaaggtttcaagattgagcatgagaagaagttatcacagcttcaaagccaagaatataaaggggaggatgaagctaagttagacaagacaaaggcctctataacgaggttacagtcactgatcattgttacttctcaagctgttactaccacatctactgccatcatccgtcttcgtgatactgaccttgttccacaactcgttgagctctgtcatggctttatgtacatgtggaaatctatgcatcaataccatgagactcagaacagcatcgtggagcaagtccgggggctcattaacagatcgggcaaaggcgaatcaacatctgagctacaccgacaagctacacgtgacttggaatcagctgtctcttcttggcactccagtttcagtagtttgattaaattccaacgtgacttcatacactcagttcacgcctggttcaagctgacccttcttccggtttgccaagaagacgccgccaatcatcacaaagagccgctcgatgcttacgccttctgcgatgagtggaaactcgctctagatcgtattcccgatacagttgcatctgaggcaatcaagagcttcatcaacgttgtacacgtgatatccgcaaaacaagccgatgaacacaagataaagaaaagaacagaatcagcatcaaaagagcttgagaagaaggcttcgtcggttagaaacctagagagaaaatactaccagtcatactcaatggttggtgtcggtttaccagagtcaggacccgataaccgacacatgttagacgctcgagacccgttaagcgataaaaagtcagagcttgcggtttgccaaaggagagttgaggaagagatggtgaaatactcaaaggcaatagaagtgacaagagccatgactttgaataatctgcagacagggttgcctggtgtgttccaatctttaacaagtttctctgctttgttcatggagtctcttcaaacggtatgcactcgctcatactctatcaaataggacattatatattatatatatatatatattgatatgcttacagagtttacagtaacaattgtgagccg

SEQ ID NO: 4515 - DNA, 1055 bp, Artificial Sequence; identical to SEQ ID NO: 3952
  P3592 (OPLEXA::G1328)

SEQ ID NO: 4516 - DNA, 768 bp, Artificial Sequence; identical to SEQ ID NO: 4001
  P3598 (OPLEXA::G913)

SEQ ID NO: 4517 - DNA, 533 bp, Artificial Sequence
  P3599 (OPLEXA::G1053)
cctcatataaaccaaactaaaaccatgattccggcagaaatcaacggatatttccaatatctatcaccggaatacaacgtaataaacatgccttcatctccaacctcttccttaaactacctaaacgatttgatcatcaacaacaacaactattcctcatcatccaacagtcaagatctcatgataagcaacaactcaacttccgacgaagatcatcatcaaagcatcatggtactcgacgagaggaaacagagaaggatgctttcgaacagagaatctgcaaggaggtcaaggatgaggaaacagagacatcttgatgaactctggtctcaggtaataaggcttcgcaacgagaacaactgtcttatcgataagctgaaccgcgtatcggagactcaaaattgtgtattgaaggagaactctaaactcaaagaagaagcttctgatctccgacagcttgtttgtgaactgaaatctaacaagaacaacaacaatagttttccaagagagtttgaagataattagtattactc

SEQ ID NO: 4518 - DNA, 668 bp, Artificial Sequence; identical to SEQ ID NO: 1211
  P3603 (OPLEXA::G1836)

SEQ ID NO: 4519 - DNA, 1127 bp, Artificial Sequence; identical to SEQ ID NO: 1093
  P3604 (OPLEXA::G1640)

SEQ ID NO: 4520 - DNA, 1300 bp, Artificial Sequence; identical to SEQ ID NO: 4021
  P3606 (OPLEXA::G1635)

SEQ ID NO: 4521 - DNA, 1243 bp, Artificial Sequence; identical to SEQ ID NO: 4042
  P3617 (OPLEXA::G1903)

SEQ ID NO: 4522 - DNA, 1065 bp, Artificial Sequence; identical to SEQ ID NO: 4047
  P3619 (OPLEXA::G635)

SEQ ID NO: 4523 - DNA, 956 bp, Artificial Sequence
  P3645 (OPLEXA::G1865)
caagaagaggacatgaagcacagagattctgcagactgcaggtgaccaatggacactttatcaataaaaacatacctactactctcttacactttcaattttccaatacaaatcccaatctttaatctctctttcttcttcatctctctttctctttctctcttcatggctacaaggattccattcacagaatcacaatgggaagaacttgaaaaccaagctcttgtgttcaagtacttagctgcaaatatgcctgttccacctcatcttctcttcctcatcaaaagaccctttctcttctcttcttcttcttcttcatcttcttcttcaagcttcttctctcccactctttctccacactttgggtggaatgtgtatgagatgggaatgggaagaaagatagatgcagagccaggaagatgtagaagaactgatggcaagaaatggagatgctctaaagaagcttaccctgactctaagtactgtgagagacatatgcatagaggcaagaaccgttcttcctcaagaaagcctcctcctactcaattcactccaaatctctttctcgactcttcttccagaagaagaagaagtggatacatggatgatttcttctccatagaaccttccgggtcaatcaaaagctgctctggctcagcaatggaagataatgatgatggctcatgtagaggcatcaacaacgaggagaagcagccggatcgacattgcttcatccttggtactgacttgaggacacgtgagaggccattgatgttagaggagaagctgaaacaaagagatcatgataatgaagaagagcaaggaagcaagaggttttataggtttcttgatgaatggccttcttctaaatcttctgtttctacttcactcttcatttgatcatcttttgttcttataaccttgtatttcttgttaagatggtaatgcaaattctc

SEQ ID NO: 4524 - DNA, 1055 bp, Artificial Sequence; identical to SEQ ID NO: 4133
  P3647 (OPLEXA::G1226)

SEQ ID NO: 4525 - DNA, 953 bp, Artificial Sequence
  P3650 (OPLEXA::G812)
atcgaaatcatcaagaatcttgtctttaatttccaattgggtttttcaaaacccgttacctcaggatgatgaacccgtttctcccggaaggctgcgatccaccaccaccaccacaaccaatggagggtttacacgaaaatgctccacctccatttctgaccaagacatttgagatggtggatgatccaaacactgaccacatcgtatcttggaacagaggaggaacaagttttgtcgtctgggatttgcattctttctccacgattctccttcctcgtcatttcaaacacagcaatttctcaagtttcatcagacaactcaatacttatggtttcagaaagatagaagcagagagatgggaatttgcaaacgaagagtttttgttaggacaaagacagttgttgaagaacatcaagaggagaaacccttttactccatcatcttcaccaagccatgacgcttgcaacgagcttcgcagagagaagcaagtgctaatgatggagatagtgagtctaagacagcagcaacaaacaacgaaaagctacatcaaagctatggaacagaggatagaaggaacagagaggaaacagagacaaatgatgtcgtttctggctagagcaatgcagagtccttcgtttttgcatcagttgttgaaacaaagagataaaaaaattaaggagcttgaggataatgagtcagcaaagaggaaaagaggttcttcttcgatgtcggaattggaagttttggctttggagatgcaagggcatggaaaacagaggaatatgttggaagaagaggatcatcaactggtggtagagagagagttggatgatggtttctgggaagagttgcttagtgatgagagtttggcttccacctcctaactagatggatttctttttggttttgtttttagtttcttctactttcaagctcattttcttctgtcacaa

SEQ ID NO: 4526 - DNA, 892 bp, Artificial Sequence
  P3651 (OPLEXA::G1950)
ttctgaattcgaattcgaactttggaagaagaagaagctttgatcaatcatggaaattgcaaccgatacagcaaagcagatgagagacgaagagttgttcaaagcagcggaatggggagattcatcgttgttcatgtcattatctgaagaacagctctctaaatctctcaatttcagaaacgaagatggtcgctctctcctccatgtcgctgcttccttcggccattctcaaatagtgaagttgttatcaagttcagatgaagcaaagactgtaatcaatagcaaggatgatgaaggatgggctcctttgcattccgctgctagcatcggtaatgctgagctcgttgaggtgcttttgaccagaggtgctgatgtcaatgccaaaaataacggtggtcgcactgctcttcactatgctgctagcaaaggccggttggagattgctcagcttttattaacacacggtgcaaagattaacatcacagacaaggttggttgcactccgcttcacagggcagcaagcgtgggaaagttagaagtttgtgaatttcttattgaagaaggagcagagatcgatgctacggataaaatgggtcaaactgcactcatgcattcagttatctgcgatgacaaacaggttgcgttcctgcttataagacatggtgcagatgtggatgtagaagacaaggaaggctacactgttctaggccgagctaccaatgaattccgacctgcacttatcgatgctgctaaggccatgcttgaaggataaaatgactctggattactttaaaacttactaactctgagagttgtttagttacttaaaaggatttttctttactgtatcatgtttgcaaaatgtttctgccttatcaattcatgttctgtc

SEQ ID NO: 4527 - DNA, 918 bp, Artificial Sequence
  P3657 (OPLEXA::G580)
ctattctgttctgttctccaatgttgtcatcagcaaagcataataagatcaacaaccatagtgccttttcaatttcctcttcatcatcatcattatcaacatcatcctccctaggccataacaaatctcaagtcaccatggaagaagtatggaaagaaatcaaccttggttcacttcactaccatcggcaactaaacattggtcatgaaccaatgttaaagaaccaaaaccctaataactccatctttcaagatttcctcaacatgcctctgaatcaaccaccaccaccaccaccaccaccttcctcttccaccattgtcactgctctctatggctctctgcctcttccgcctcctgccactgtcctcagcttaaactccggtgttggattcgagtttcttgataccacagaaaatcttcttgcttctaaccctcgctcctttgaggaatctgcaaagtttggttgtcttggtaagaaaagaggccaagattctgatgatactagaggagacagaaggtataagcgtatgatcaagaacagagaatctgctgctcgttcaagggctaggaagcaggcatatacaaacgaacttgagcttgaaattgctcacttgcagacagagaatgcaagactcaagatacaacaagagcagctgaaaatagccgaagcaactcaaaaccaagtaaagaaaacactacaacggtcttccacagctccattttgagaaaaatctactatttctttttgggggagtttcaagtgtttcttatgaagatgagaaaaacagaaaaagtttgtacattttagctaagttaaatttgtggtggtaagtaatgtaaaagaaaagtgtgtgtagaagaaaagtgtctagaaaaagaaagcaactaactttcttcttcttctctggtttcctatcg

SEQ ID NO: 4528 - DNA, 1420 bp, Artificial Sequence
  P3663 (OPLEXA::G1958)
cgattatccccaagaggagaatcctcataatcattttctccgattcgattcgtcttccttggtcctggattgcttcatgaatttctaggacaacaatggaggctcgtccagttcatagatcaggttcgagagacctcacacgcacttcttcaatcccatctacacaaaaaccttcaccagtagaagatagtttcatgagatcagataacaacagtcagttaatgtctagaccattaggacaaacctaccatttactttcatctagtaacggtggagctgttggacatatatgttcttcttcatcatctggttttgcaaccaatctccattactcaactatggtatctcatgagaaacaacaacactacacaggaagcagcagtaataatgctgtgcagacaccaagcaacaacgatagtgcttggtgtcatgattcattgccaggagggtttcttgacttccatgaaaccaacccggcgattcaaaacaactgtcagattgaggatggtggcattgcggctgcttttgatgacattcaaaaacgaagtgattggcatgaatgggctgaccatttgatcactgatgatgatcctttgatgtctactaactggaatgatctcttgcttgaaacaaattccaattcagattcaaaggaccagaagacactgcaaattccgcaacctcagattgttcagcagcaaccttctccgtctgtggaattgcgacctgttagcacaacatcttcaaacagcaataacggaacgggcaaggcacgaatgcgttggacgccagagcttcacgaggcttttgttgaggctgtcaacagtcttggcggtagtgaaagagctactcctaaaggggtactgaagattatgaaagttgaaggcttgactatatatcatgttaaaagccatttacagaaatataggacagctagatatcggccagaaccatcagaaactggttcgccagaaaggaagttgacaccgcttgaacatataacatctcttgatttgaaaggtgggataggtattacagaggctctacgacttcagatggaagtacagaagcaactccatgagcagctcgagattcaaagaaacctgcaactccgaatagaagaacaaggcaagtacctgcaaatgatgttcgagaagcaaaactctggtcttaccaaagggacagcctcaacatcagattccgcagccaaatctgaacaagaagacaagaagactgctgattcgaaggaggttccagaagaagaaaccaggaaatgtgaggaactagaatctccacagccaaagcgtcccaaaatcgataattgaaagtattggtcttttgctggataatctcggagtttcagagttaacagtgatagagagaacgagctcttatcttgaggttcttcaggacttctctc

SEQ ID NO: 4529 - DNA, 716 bp, Artificial Sequence; identical to SEQ ID NO: 3805
  P3771 (OPLEXA::G435)

SEQ ID NO: 4530 - DNA, 946 bp, Artificial Sequence
  P3843 (OPLEXA::G1638)
gattcgatcaacaatcgttgaaaacatgaacagaggaatcgaagttatgtcaccagcaacatatctagagacatcaaactggttgtttcaagaaaacagaggaaccaaatggacagctgaagaaaacaagaaattcgaaaacgctttagccttttacgacaaagatactcccgacagatggtccagagtcgctgccatgcttcccggtaaaacagtcggagatgtgatcaaacaatacagagagcttgaggaagacgttagcgacatcgaagctggtcttataccaatccctggttacgcctctgattcattcacacttgattggggtggctacgacggagcaagcggtaacaatgggtttaacatgaacggttactacttttccgccgccggaggaaagagaggatccgccgcacgaacggcggagcatgagaggaagaaaggtgttccatggacagaagaagaacacagacaatttctgatgggtttgaagaaatatggaaaaggagattggagaaacatagctcgtaactttgtgaccacaagaacgccaacgcaagtcgcaagtcacgctcaaaagtatttcatacggcaagtcaatggtggcaaagacaaacgccgttcaagcatccatgatatcacaaccgtcaacatccccgactctcctgacgctgcagccgcggataacgcaaccgcaaacgcaccttgctcgccaccttccgtaggaggaaaccagcgggagacatcggagtgggaaggtcaaacactatacgatgaaacggcagctgcgttttataatcaaaacgcgttttcagaaacgctacttggaatgtcttcgacgccctacatggcaaaacttcaggagcagagttttctgaacgcatcgcaattcgaatcgtacaatgcgtatctccaaatgtagctcacaaggtgaagatctcggaga

SEQ ID NO: 4531 - DNA, 535 bp, Artificial Sequence; identical to SEQ ID NO: 3993
  P3852 (OPLEXA::G30)

SEQ ID NO: 4532 - DNA, 505 bp, Artificial Sequence; identical to SEQ ID NO: 3994
  P3853 (OPLEXA::G47)

SEQ ID NO: 4533 - DNA, 1231 bp, Artificial Sequence
  P3955 (OPLEXA::G328)
gcgtccgctcaccatcaaacaactacaacatctgcggttagtatgttgaaagtagagagtaactgggcacaagcctgtgatacatgccgatcagccgcctgcaccgtgtactgccgggctgattctgcctacttgtgctccagttgtgatgctcaagttcatgctgccaatcgtcttgcttcccgccatgaacgtgttcgagtctgtcaatcatgtgagcgagccccggctgcctttttctgcaaggcagatgctgcatctctatgcacaacctgtgattcagagattcattccgcaaacccacttgctagacgccatcaacgagttccaattctgcccatttctgagtactcttacagttccacggccactaaccattcatgtgagacaacagtgacagatccagagaacagacttgtgcttggtcaagaagaagaggatgaagatgaagcagaggcggcttcatggttgttgcctaattcagggaaaaacagtggtaacaacaatggcttctcgattggggatgagtttctgaaccttgttgattatagttcgagtgataagcaattcacagatcaatccaatcagtatcaactagactgcaacgtacctcagaggagctatggggaagatggagttgttccacttcaaattgaagtatcaaagggcatgtaccaagagcaacagaactttcagctgagtatcaactgtggctcctggggagctcttcgaagctccaatggttccctcagtcatatggtaagctttcatatatttaattcagatccgttactatgaccagcatgctgcttctttcacacaaatccatgaagtaaatttctaagaatgtctttgttactgtcattaggtgaatgtttcatctatggacctgggagttgtgccggagtcaacaacgagtgacgcaacagtatcaaacccaagatcgcccaaagcggtaacagaccaaccaccttaccctccagctcagatgctcagtccaagggacagagaagctagagtcctgagatacagagagaagaagaagatgaggaaatttgagaagacgataagatatgcttcaaggaaagcgtatgcagagaaaagaccacggatcaagggccggtttgcaaagaagaaagatgtcgatgaagaggcaaaccaagctttctccacaatgataacatttgacaccggatatggaattgttccatcattctgatgctgctatggc

SEQ ID NO: 4534 - DNA, 1416 bp, Artificial Sequence
  P3979 (OPLEXA::G1650)
agtcacaaatgtccatatgagtttctgggcgacttctatcagaatttttgttcataattttttttattgtatcaagggatgacttggaaaccgaagatgcttatattatcccatgatctaatctcaccagaaaaatacatcatgggtgaagatgatatcgtggagctcttagggaagagcagccaagtagttacaagtagccagacacaaacaccctcttgcgatcctcctctcattctccggggcagcggaagcggggacggagaaggaaatggtcctctaccgcagcctccgcctcccctgtaccatcagcagagtctctttatccaagaagacgaaatggcttcttggcttcaccagcctaatcgccaagattatctctactcccaacttctttactccggagtagcctcgactcacccgcaaagtttggcctccctagaaccaccaccaccacctagggctcagtacattctggcggcggatagaccgaccggtcatattttggccgagagaagggcggagaattttatgaatatctcgaggcaaagagggaacatatttcttggcggtgttgaagctgtaccgtcgaactcgaccctgttgtcttcagccactgaatcaataccagcgactcacggcaccgagagtcgagcaacagtcactggcggagtatctcgtacttttgcagttcctggtcttggtccgaggggaaaggcggtggcgattgagacggcgggaacacaatcttgggggttgtgcaaggccgaaacagagccggttcagagacaaccagcgacggagacggatatcaccgatgaacggaagagaaaaacgagagaggaaacaaatgtcgaaaaccagggaactgaagaagctcgtgattcgacgtctagtaagaggtcacgagctgcaataatgcataaactctccgaaaggagacggagacaaaagattaacgagatgatgaaggctttgcaagaactccttcctcgctgcacaaagactgatagatcttccatgctggatgatgttatagagtacgtgaaatctctacagagccaaatacaggatgttctcaatgggacatgttatgattccaccgatgatgtatgcggggaatatacaacaacagtacatgccccacatggccatgggtatgaatcggcctcctgcattcatacctttccctaggcaggctcatatggcggaaggtgtaggtcctgttgatttatttagagagaatgaagaaacagagcaagagacaatgtctcttctccttagagaagacaaaagaacaaaacagaaaatgttttcttgaactgaaacttgttagttcttttattaagacaagacacactcttatatacatgttcacataactactctacgttggtaacagttgtaacttctcca

SEQ ID NO: 4535 - DNA, 542 bp, Artificial Sequence
  P3982 (OPLEXA::G1809)
cctattctcgtctttagcaaaatctcaaaagacaaaaagatattgatgtctctccaacgacccaatgggaactcgagttcgtcttcttcccacaagaagcacaaaactgaggaaagtgatgaggagttgttgatggttcctgacatggaagcagctggatcaacatgtgttctaagcagcagcgccgacgatggagtcaacaatccggagcttgaccagactcaaaatggagtctctacagctaaacgccgccgtggaagaaaccctgttgataaagaatatagaagcctcaagagattattgaggaacagagtatcagcgcaacaagcaagagagaggaagaaagtgtatgtgagtgatttggaatcaagagctaatgagttacagaacaacaatgaccagctcgaagagaagatttctactttgacgaacgagaacacaatgcttcgtaaaatgcttattaacacaaggcctaaaactgatgacaatcactaaatatttaccctttaatccattgttcagtgttgtatgattatctttcg

SEQ ID NO: 4536 - DNA, 1421 bp, Artificial Sequence
  P3994 (OPLEXA::G1273)
tcagattttcttcgttccctaactcctaaaaaggagagattcttcaaatccttatcacaacttcagtttttgcattcaccgtcgtgagtgttctacttttggtcaagtaatggaggtgaatgatggtgaaagagtggtaatagcaaaaccagttgcctcaagaccttcttcaagttctggcttcaggacattcactgagcttcttactgattcagttaccgtatctccgcaaacgacttgccacgagattgtagacgctgctataagaccaaagactttgagattcaatcagccagtagcagcttcggtctcatgtccacgggctgaagtaaaaggtattggaaatggaatgtcttgtgatgatgattcagatagcagaaactacgtcgtttataaaccgaaagcaaagcttgtctccaaagcaaccgtctctgcattggctaatatggggaatcgtcaacaaacttggagacaaagcgaagcagtatcctatgggaagagtgtgagccaaggtacacatcgagcaggtcctaatctagtccagaaagttccatcttttacggaatcagagacatctactggggatagatcttctgtggatggatacaactggaggaaatacggacagaagcaagttaaaggaagtgagtgtccaaggagttattacaaatgcacacacccgaaatgtccggtgaagaagaaagtagagagatcagtggaaggtcaagtttcagagattgtgtatcaaggtgaacataatcactcaaagccatcttgtcctcttccacggcgtgcttcatcatcaatctcttcagggtttcaaaaaccaccaaaatcgattgcttctgaaggatcaatgggacaagaccctaacaataatctctattctcctctatggaacaatcaaagcaatgactctactcaaaacagaacagagaagatgagtgaaggttgtgttattacaccatttgagtttgctgttccaagatcgacaaattcaaatcccggaacttcagattccggttgcaagagtagccaatgtgatgaaggagagcttgatgatccaagcagaagcaaaagaaggaagaacgagaagcaatctagtgaagcaggagtatcgcaaggctcagtggaatcagacagtcttgaagatggattcaggtggagaaagtatggacaaaaagtggtaggaggcaatgcgtatccaagaagttattacagatgcacaagtgctaattgcagagcaaggaaacatgttgaacgagcgagtgatgatccaagagctttcattacaacctacgagggtaaacataatcatcatttgctcttgagccctccatcttcctctactcttccctttaactccccacaactttctaagcaaacaatttgatttgatgatccattcatgctttttcttt

SEQ ID NO: 4537 - DNA, 898 bp, Artificial Sequence
  P4002 (OPLEXA::G1007)
attccttcttgcctaggaactaattgttgcacacttcggtacacaattttttgagcacttcgacatcaaaacgagagagaaaagaatggtggattctcatggctccgacacggaatgttcctccaagaagaaaaaggagaaaacgaaagaaaagggggtatatcgtggggctcgcatgaggagctgggggaaatgggtctcggagattcgggagccccgtaagaaatcaagaatctggctcgggactttccccacggcggagatggcagcgcgtgcccatgatgttgcggcattgagtatcaaaggaagttccgcaatccttaacttccctgagctcgcggattttctgccaagaccagtctcgctcagccaacaggatatccaggccgcagccgccgaagccgctcttatggatttcaaaactgtaccattccatcttcaggatgactcaacgccgttgcaaactaggtgtgatactgagaagatcgaaaagtggtcatcctcatcgtcctcagcctcatcctcatcctcatcttcgtcctcgtcctcatcatctatgctttcgggggagctaggagatattgtggagttgccgagtcttgaaaacaatgtaaaatacgattgtgcgctgtatgactcgttggaggggctggtgtcgatgcccccatggttagatgctaccgaaaatgattttaggtatggagatgattcggtactgttggacccatgtctcaaagaaagctttttgtggaattatgagtaaggtttttttttggaaagaaatgtggttttttgtttcctcctctcttttatactttcgatctttttttctaagcatatatatcttctacatatgtaatacttttccattagtaaacaatgattcggtttcgggtac

SEQ ID NO: 4538 - DNA, 780 bp, Artificial Sequence; identical to SEQ ID NO: 4074
  P4012 (OPLEXA::G450)

SEQ ID NO: 4539 - DNA, 1258 bp, Artificial Sequence
  P4019 (OPLEXA::G675)
tcagagagagatggggaggtcgccttgttgcgacgagaatggtctaaagaaagggccatggactcctgaagaagatcaaaagcttattgattacattcataaacatggtcatggaagctggagagctctccccaagctcgcagatttgaataggtgtggaaagagttgtagactgaggtggacaaattatttgagaccagacatcaaaagaggaaagttttcagccgaagaagagcaaacaatcctccatctccactccattctcgggaataaatggtcagctattgcgacgcatttgcaaggtcgtacagataatgagataaaaaacttttggaacacacatctaaagaagaaattgatccagatggggatcgatcctgtgactcatcagccaagaaccgacctcttcgcaagtttacctcagctcatagccttggcaaatctaaaagacctaatcgaacaaacatcacaattctcatccatgcaaggcgaagcagcccaactagccaatctacaatatctccaacgtatgtttaattcttcggcttcattaaccaacaacaacggcaacaattttagcccgagtagtattctcgatatcgatcagcaccatgccatgaacctcttaaactccatggtctcttggaacaaagatcaaaaccccgcttttgatccggttcttgaactcgaggctaacgatcaaaatcaagatttatttccactagggtttatcattgatcaacccacccaaccactccaacaacaaaaataccatttaaacaatagtcctagtgagctaccatcgcaaggtgacccacttcttgatcatgtccctttcagtctccaaacacctttgaatagtgaggatcactttatagataatttggtcaaacatccaactgatcatgagcatgaacatgatgacaatccatcttcatgggttctcccttctcttatagacaataaccctaaaactgtcacgtcttctcttccacacaacaatccggcggatgcaagtagcagctcaagctatggaggttgtgaagctgcgtcgttttattggcctgacatttgcttcgacgaaagcctcatgaacgttatatcttagttactcttggtttagtgttttttttttagatctctgttattttatacaagttttttatttggtgttggtgttttgtaagtagaaaaggtgcgaatgtgtgatccgtttatccctttatgtaattaaacaggagatctctgtgatccgtta

SEQ ID NO: 4540 - DNA, 860 bp, Artificial Sequence
  P4035 (OPLEXA::G1784)
cactggagaactctgatcacgtcgaagtatttcggaaaaagacacatggctcttgagaaaagcaaaggatgcaaactcctttttgtttgtgatgattttgtagatcgtgcagaggacactctgtttttaaaaacagttgccttggagaagacgtcagtttctgagggagatgaacaagctttcgaattcgaaggatataaggggtttctcgatatttccgagagctgtgatggccttgtctgcttctacgacactacaagagcagtggaagtaatgaatccggccacaacaatgttcatagaactccctctatcgagaatccaacagctttgtatatacaagccaaacccggaggtggagctggagccagttcaagatccaaatcctgttctagacccagtcatgacatgttctcagattggagttgggaaagacagcgttagtggaagttataaactagtatggatgtataatacttctcctgctactcctcctacgtgcgaggttttggatttagatggaaaaaaatggaggttcgtgaatactacttctcttgatcatcatcagatcttgtgcgatcagaggccggtgtttgcaaacggatcactctactggctcacgggagatgaggaaggatatgcaacaacacaaaccaaactcatagttttagatttacacacagagatgtttcaagtcatccaaacaccgccttttattacccgtgatgcctctggtgacaagattggtttatgcaatcttgatggtcgtctctgtatttcagagttgaagaaagattgcaagcaagagttttgatggagagttgaagataacaacacatgggagaggatcttctcggttga

SEQ ID NO: 4541 - DNA, 685 bp, Artificial Sequence
  P4190 (OPLEXA::G485)
tcctctctgatccaacggacccaaaacatctatctctctttctcgaccttttgtctcctcgatctaaagatggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaattgtaaaatgataaaagcaaattttcatttttattaattaatgatatatatatatatatgtttaacttttagtataatgtttacagaattttttttttaaaactaggttcaacccactaacgtaacagcg

SEQ ID NO: 4542 - DNA, 1289 bp, Artificial Sequence
  P4195 (OPLEXA::G1785)
agattcataccgagatttcatccgttttccattttagaatcttcatttcaattcaagttcgtgtttaaatggaattctcattgatctccgatgaaaatttcatctttaacaacgcttatctatgttctgttaatgatgatacatctcatataccaaaaaataatcttacctttttcaatgacaatctaggtcaatcttcttgtactagatggtccttttcaccagatctgactgatatctctaatcagcactaccaccaaaatcttatacctttgatcccaaattacgattctcaaaatcagaatttggatactaatcaaaaccatttggtttacaactcttcctcatataaaattccatcaaactacccattaatgagtatcaaatcctactcaaatgttgatatctctgagcaatctatgaatagcatagccaacaacggaaaaatccatatgattgataaccccccaacttttgcataccctaaaggtaatgggtgaacctcaatcatttaatgtgccagtgccagaatatatcaaaaacacaaccaacgaaatcatgaatcaaagtgaagatgataagatgaaaaaaaattatcaaaagaagaatataaaggtggtgagcacaagcaaatatttgaagaaaagtgacatcgacaaagtaaactggacagaatctgaggacataaaattgaaagagataatggcgcttggacccaaaaacaaatggacaaaggtcgcaaaaaaattcgaaggaagaacaggaaaacaatgcagagagaggtggtataaccatgctcgtcctaacattaagaaaactgcttggagtgaagaagaagatcaaattttgattgaagcacacaaagtacttggtaccaaatgggtcgagatcgcacagcaacttccggggaggagcgataacaatattaagaaccattggaacaccacaaagcgtcgggtgcaaaataaaagaggtggaactgtcaaccctgtcggcaataacatccttgaaaactacataaggtgtatcacaatcaacaacgaagattttcttaagaccgatggatcttatggtgaaccgacaaacattgagagtgatgatgactctaaagatatgttatacggggagatgaatttgagtctagagactataacgacgcagaccaccaaaccattgaccaatgcttctacaacatcaccttatgttcagatgccagaagataattatactatggaggattgtgaatcactggaggacattctagagctgctgcgttggtgggaataatt

SEQ ID NO: 4543 - DNA, 722 bp, Artificial Sequence; identical to SEQ ID NO: 1365
  P4196 (OPLEXA::G2108)

SEQ ID NO: 4544 - DNA, 1064 bp, Artificial Sequence; identical to SEQ ID NO: 1393
  P4229 (OPLEXA::G2132)

SEQ ID NO: 4545 - DNA, 1092 bp, Artificial Sequence; identical to SEQ ID NO: 995
  P4336 (OPLEXA::G1462)

SEQ ID NO: 4546 - DNA, 1142 bp, Artificial Sequence; identical to SEQ ID NO: 997
  P4337 (OPLEXA::G1463)

SEQ ID NO: 4547 - DNA, 1633 bp, Artificial Sequence; identical to SEQ ID NO: 4178
  P4342 (OPLEXA::G2505)

SEQ ID NO: 4548 - DNA, 999 bp, Artificial Sequence
  P4350 (OPLEXA::G1504)
gggaatgtgttctgtgtagtcagctgcgttctcggaagtgggtgacaaatgaataacgatttgtggttacctgaagaggacttcaagggtctaccggataatttccttgataatctcgttgatcctaccaatgatgtttctgtagaagatatagagaccggcgatgatgagggagattgggatgccaaatttcaaaagctcgtacctccaccattggatgagctaatgagtttgtcctatgagttcacttgcaatggacagcgtgtgcaagttcagaagcatgtgccaattttgaagcagtcgagttcttcagaagtcttctctactgttgataactcccctcctaatgtcaaagtctcaaagttgttgcaatctttaagcccagtctcagtcctcaagaacaccaacggttctggctcaccccaaaacccaaacggagatcagaaactggcctttctcgtgaaaggcatcagaagcaagcgcaaacgccccacactactgagagttacattcctcaaatcatttctattagagatgtcacagcagtttgctccggatgaatctgaatcttctgagatttccgccttgaagaaacgcaagaagaacaagagtcgtcgcttgaaatgcactcattgcgagacaaccactaccccgcagtggagggaaggacctaatgggcgtaaaaccctttgcaatgcttgtggaatccgctttagatcgggccgtcttgttttagaataccgtccagcagcaagcccgaccttcatcccaaccgtgcattcaaatttgcacaagaagatcatatatatgagaatgaaagataacgaccagtttgataccagaaagatccgtgctgagacatccggaccagagactagatcaaggcttcgtaacttcggcagaccaatgagttatggtcaatgaaaaacaagattgtcaggatccgtagaattggttaattttctctcaaagactgatgttctaaatactagggtctag

SEQ ID NO: 4549 - DNA, 966 bp, Artificial Sequence
  P4352 (OPLEXA::G383)
cgtggactctttctttgttttggctgactcttctttcaccgtttccttagagaacttattcatctcataaacaccacacacaacacacacttctctttctccttctctctatatattttaatatcaactttctagggtttccaagttcatatatagtgatgggtttctcaatgttcttctcccccgaaaacgacgtcagccatcattcctctccatatgcttctgttgactgcactctctcacttggaactccctccactcgcctctgcaacgaggatgatgaacgtagattctcgtctcatacctccgacaccataggctgggacttcttgaacggttccaagaaaggcggtggaggcggcggacataacctcctcgctcgccgttgcgccaactgcgacaccacttctactcctctttggagaaacggtccaagaggtcccaaggtatttaatatgtaacctttacatcaaatattttatcatttcttgatgtgggactaatatttctctctgtacaacaaaacaaatattgataataactttatatgatttttaatttggtcagtcgttgtgtaatgcgtgtggaatccgattcaagaaagaagagagacgtgcatcgaccgccagaaactcgacctccggcggaggatcaactgcagctggagttccaactttggatcatcaagcaagtgcaaattattattataacaataataaccaatatgcttcatcgtcgccttggcaccatcagcataatacgcagagagttccatattactcgccggccaataacgaatactcatacgttgatgatgtcagagttgttgatcatgacgtcacaaccgacccgttcttgtcttggaggcttaacgtcgccgaccggaccggccttgtccacgattttacgatgtgatgagtgatcatttcatagatattccccttataagtcttagccttggatacc

SEQ ID NO: 4550 - DNA, 1331 bp, Artificial Sequence
  P4357 (OPLEXA::G1364)
ttgtgttaattgttgtaaagttagggtttttttttctttctgagatggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgagtatgtcttttttaaccttttaacaatgctatgttgtgtttgctcttgctgaatgtttagaggcttgataggaactttgagttttagtttcaagtcttaaactttatagtgatttttgggtttttcttaactagtgaaagttgaggcctttttagtccttacattggttactctttcttgttgttcatctttgtttggctttgatgttgcatatttgatgatgcaatggtttttctatgacgttgatgagcagagcgagtgataaatgtcaaagagagaaaaggaagactattaatggagatgatttgctttgggcaatggctactttaggatttgaagactacatggaacctctcaaggtttacctgatgagatatagagaggtatgttctgagtacgatgtttattagttatgctgttgtgtgaagagagtttttgaatttcactaacttactctgtttctccttttccttttcttgctctactacgtgaactggaatatcacagatggaggtcagtggttcttcttattctatttcttgttcattcctaaaacttgcaacgatctatgatctttatggcttccgtgaatcatctctttttgtcaacttatgtatcaaactatttatgctttccttatccttttcaatgatcaatagggtgacacaaagggatcagcaaaaggtggggatccaaatgcaaagaaagatgggcaatcaagccaaaatggccaggtatatgtctcaaatctcatgcctttgaccattttttcgtcttcgcattcatctgcacgtattctctcttccgctttagctaagttagtctgacattcatggggtttgtttaccatttggcagttctcgcagcttgctcaccaaggtccttatgggaactctcaagtaacttttcctctcttctcttcacactcaagcaatacgcatcattctcttctaatttgttaagaattgaaaacttgtaaagcatcacttatgttataatctatgaatacctcaaaatctgtgaactaatttgacattggactcggtataattgtaggctc

SEQ ID NO: 4551 - DNA, 892 bp, Artificial Sequence; identical to SEQ ID NO: 4190
  P4359 (OPLEXA::G211)

SEQ ID NO: 4552 - DNA, 485 bp, Artificial Sequence; identical to SEQ ID NO: 7
  P4361 (OPLEXA::G2133)

SEQ ID NO: 4553 - DNA, 746 bp, Artificial Sequence
  P4382 (OPLEXA::G2313)
acaatcgctcttccgtaacatattccacaaaacgatcttcttgtttcttgaatttttagccatctcttttttttttttctcattttctcggatactatggcttcgagtccacgctggacggaggacgacaacaggcgttttaagtcagctctgtcgcaattccctccggataacaagcgtttggtgaatgtcgcccagcatctgccgaaacctttggaggaggtgaagtactactacgaaaagttggtcaacgatgtttatctgccgaaacctttagagaatgtcacccagcatctgcagaaacctatggaaatggaggagatgaagtacatgtacgaaaagatggccaacgatgttaatcagatgcccgagtacgtaccactggcggaatcgagtcagtccaaacgcaggaagaaggatacgccaaatccttggacagaagaggaacacagattgtttctgcaaggattgaaaaagtatggggaaggagcttcgacgttgacatcaacgaattttgtgaagacaaagactccacggcaagtgtcaagccatgcacagtattacaaaaggcaaaaatcggacaataagaaggagaaacgccggagtatttttgacataactttggagtctaccgagggcaatccagattctggaaatcagaaccctccggatgatgatgatccgtcccaaggtcaaggcacttgtcttggagtttagatgttggaagatagaagaatggtgtgaaa

SEQ ID NO: 4554 - DNA, 1135 bp, Artificial Sequence
  P4387 (OPLEXA::G1645)
ctcccaacactaactccatgtttataacggaaaaacaagtgtggatggatgagatcgtcgcaagaagagcttcttcttcttgggacttccctttcaacgacattaatattcatcagcatcatcatcgtcactgcaacacaagtcatgagtttgaaatcttgaagagtcctcttggagatgtagcggttcacgaagaagagagtaataataataaccctaatttcagtaacagcgagagtggtaagaaggagacaacagatagtggtcagtcttggtcctcgtcgtcttcaaaaccatcggtcttggggagaggacattggagaccagctgaagatgttaaactcaaagagcttgtctccatttacggcccacaaaactggaacctcatagctgaaaagcttcaaggaagatctgggaagagctgtagactacgatggtttaaccaattggacccgaggataaaccgaagagctttcacagaagaagaagaggagaggctgatgcaagcacataggctttatggtaacaaatgggcaatgattgcgaggcttttccctggtagaactgataattcagtgaagaaccattggcatgttgtcatggctcgtaagtatagagaacactcttctgcttaccgtaggagaaagcttatgagtaataatccacttaaacctcacctcaccaataatcatcatcctaaccctaaccctaattaccactcttttatctccactaatcattacttcgctcagcctttccccgagtttaatttgactcatcacctggttaataatgcccctatcacgagtgaccataaccagcttgtgttgcctttccattgctttcaaggttatgagaacaatgaacctccgatggttgtgagtatgtttggcaaccaaatgatggtcggcgataacgttggtgccacgtcagacgcgttatgcaatattccgcacattgaccctagtaaccaagagaaaccggagccaaatgatgcaatgcattggatcggaatggacgcggtagatgaggaggtgttcgaaaaggctaagcagcaaccacattttttcgattttcttggcttggggacggcgtgaatgttgaacaaattggtgttaatcagataacgacagtg

SEQ ID NO: 4555 - DNA, 794 bp, Artificial Sequence; identical to SEQ ID NO: 4213
  P4390 (OPLEXA::G1752)

SEQ ID NO: 4556 - DNA, 819 bp, Artificial Sequence
  P4393 (OPLEXA::G1935)
tttgattattttgcagtgaccatcggatatgggtcgggttaaattggagttaaagcgtatagagaagagcacgaaccgacaaattacgttctcaaaacgtaaaaaaggtttaataaaaaaggcttatgaattgtcaacactttgtgacatcgatcttgccctcctcatgttctctccctctgatcgactatgtctcttttccggtcaaacaaggatcgaggacgttttggcgaggtacatcaatcttcctgatcaagaaagagaaaacgccatagttttccctgatcagagcaagcgccaaggtatccaaaacaaagagtatttgttaaggactttggaaaaactcaaaattgaggatgacatggctctccaaatcaacgaacctcgtccagaagccaccaactccaatgtcgaggaacttgagcaagaagtttgtagattacaacaacagcttcagatatcagaggaagaactcaggaaattcgaaccagatccaatgaggctaacatcaatggaggagattgaagcatgtgaagctaacctcatcaatacgttgacacgtgtcgtccagagaagggaacatttgttgagaaagtcctgcgaagcacaaagtaaccaacaaagcatggacgggatccttctaaatgacatcgtcgaggattggggacctgagcccgagcccaaacaagcccatatgatagctaattcggcccatcattcaaatcagccaagctatgatttactcttacgcaggagtaattcgagttcgaaccaaaatccaaaatgatattaggtgaatcgcaaggcgtcgtcgagccc

SEQ ID NO: 4557 - DNA, 1406 bp, Artificial Sequence
  P4394 (OPLEXA::G2417)
ataccggtggaagattctgctttactacgctctccgcttcttcttctcctcgattcgattctcctcatgggtttatcatgaatttttaggttttgagtaattcagaaactcgagtgatgatcccgaatgatgatgatgatgcaaattctatgaagaattatccgttaaatgatgatgatgcaaattctatgaagaattatccgttaaatgatgatgatgcaaattctatggagaattatccgttaaggtcaattccgacggagctttcacacacttgttcattgataccaccttctttaccaaacccttcagaagcagcagcagacatgtccttcaattcagaactcaatcaaatcatggcaaggccttgtgatatgctccctgccaatggtggagctgttggtcataacccttttttggaaccaggattcaactgccccgagacaacagattggattccctctccactcccccatatttattttccttcgggttctcccaatctaataatggaggatggtgtcattgatgagattcacaaacaaagtgacttgccactttggtatgacgacttgattaccactgatgaagatccactcatgtctagtatcttgggcgatcttctccttgacactaatttcaactcagcttcaaaggtccagcaaccaagtatgcaatcgcagattcaacaaccccaagctgttctgcagcagccttcttcttgtgtggaattgcgcccacttgataggacagtatcctcaaacagcaacaacaatagcaacagtaataatgcagcagcagcagctaagggacgtatgcgttggacgcctgaacttcatgaggtttttgttgacgctgttaaccagctcggtggcagtaatgaagcaactcctaaaggtgtcctgaagcatatgaaagtcgaaggtttgactatttttcatgtcaaaagtcatttgcagaaatatagaacagctaaatatataccagtaccatcagaaggttcgccggaggcaaggttgacaccgcttgagcaaattacatctgatgatacgaaacgtgggatagatatcactgagactctgcgaattcagatggaacatcagaagaaactgcatgagcagcttgagagtctaagaacaatgcaacttcggatagaagagcaaggaaaggcgctgttgatgatgattgagaagcaaaatatgggtttcggcggaccagaacaaggagagaaaacaagtgcgaaaacgcctgaaaatggttcagaggagtcggaatccccgcggccaaagcgtccgagaaatgaagaatgaaggaaacctttcttcggatggtagatcataaaactgtggttttggtggagttgtagagtatgacttattaggagtagagctttcagtcttcttcag

SEQ ID NO: 4558 - DNA, 980 bp, Artificial Sequence
  P4396 (OPLEXA::G2425)
gagatctgattgctcaccggagagaacaaaacaagaaatggggaggacgacgtggttcgacgttgacgggttgaggaaaggagagtggacggcggaggaagaccggaagctcgtggtttacatcaacgaacacggtctaggcgagtggggttcactgcctaagagagccggtctacaaagatgtggaaagagttgtagattaagatggctgaattatttgaggcctgggattaaaagaggcaagttcactcctcaggaagaagaagaaatcatcaaataccatgctcttcttggaaacaggtgggcagcaatagctaagcaaatgccaaacagaacagataatgacataaagaaccattggaactcatgccttaagaaaagacttgctaaaaaaggaatcgatccaatgacccatgagccaacaacaacaacaagcctcaccgtcgatgtcacctcctcatcaactacgtcgtctcctacaccgagccctacttcttcttctttttcctcctgttcctctactggctctgcacgtttccttaacaagctcgctgctggaatctcgtcaagaaaacacggactagagagtatcaagacagtgatattggcagaacaaccaagagaagccgttgatgaagagaagatgatgacaattaacatgaaagagaaggaattgattagttgttacatggagattgatgagacgatgagtattgatgaactaccttgtgatgactcgacgtctggcttcgtggcttttgacgactactcattaatcgacccatacagagacggtgtgtacgtatctgatttctacgatgagactgaacaccttgacctgttccttctttgaatcacatttcctttgtctaaataaatccgtttctttagtgtgacgagagagagacagtggagagagagacagtggagagagatgtctgaaaaaaacaagtgcggattagtactttgaatgacatgcg

SEQ ID NO: 4559 - DNA, 968 bp, Artificial Sequence; identical to SEQ ID NO: 983
  P4397 (OPLEXA::G1444)

SEQ ID NO: 4560 - DNA, 1985 bp, Artificial Sequence
  P4398 (OPLEXA::G270)
caaaggacgaacgggaagtcaggcccatatgtttaagtaaggcccattagaaagtgaggcccattgaaattgtcggatactacatcagaggccggcgaggaggagaggagaaagctccgttattcaagattattccgataatgcagtcactctccaccccacacaccatctctcttcttctccccagaacctctccgtctcgtctttctccctctcttcactcccttgctttccccactcgattacggtctctttcctattcttctcaaacgtcgatcctccccgatgccggcgatgatttcattgtcggtgactgtctcgtctacgaggacggcgtcttcgaagacccttaccttgataaggaggtcactcaggttgcgaagcaggagcgcaagaagaatcggcgtggcggggctaagagattagatgaatccgagattgagcccgagaacctcgtgccagaggaatggagggatattcaggcggaggtgaatctgacgaagaaggacaagcgcaaaatagcgcaggagatggagttcggggttcgggtggagaagaagaggcaagggctaattccgctgaggaaagttgacttgaatgactttctcacgtacaaggaagccaagttggctcaattgaggcctgtcattctcgataaaccgggaaatttctccgacgacagtggagcgtcaagcgatggagagaccgctgtatcatctcccagcgagcgagtggctcctaagaaccctagatgggcagtttacggaaagggattcgaccacgttgccaagttcttcaatagcgacaagtacgatcccagcgacaagaaatccgacggtatacgtttaccactcttgtttccttctcttgcttgaattgcaaaaagagcttatatttggctgatccctcgttaggccctcgaaagctgctttcaaaagaagagaagtttatgctcaatagccggaatcctgacctagccgttgccacatcagtaagtccccttacgatgctcttcgtcaaagtgaatgttttcagtctctgatgaaaatgtatttatgtgtgtgtacctctggtgaatcagaaaaaatggcttcctcttcacacactggcagcatgtggagagttttatctggttgattccttgctaaagcacaatcttgatatcaatgcaaccgatgtggtatgtctgacttttttgaagctgttgcttttgtgcacagtgtttatgtttgttggcgtctctttctagtgttgtttccattcttgtcgtttctagggcggcttgacagtacttcaccgagcaatcattggtaagaagcaggctattactaactacctgctgagggaatcggcaaatccatttgttcttgatgacgtaagtggtcaactaatgatatttatatcttgttatgatctcccttgcgcttcagatactggatctgatccgtttggtttatgataggaaggtgcgaccttgatgcactatgctgtgcaaacagcatcagctcccacaataaaacttctcctactgtataacgctgatataaacgctcaggacagggtaggatgatgtcaagcattcattgtaagacaacatcattgttgatcaggtggttgacaatttggcactgggttttcaggacgggtggactccactgcacgttgcagtacaggccagaagaagcgacattgtaaagcttcttttgataaaaggggcggacatagaagtgaagaacaaggcaagttcccgcgtatattcccatatctggttttgaaagcattaactgatgataccatatttgactataccaggatgggttaactccgcttgggctttgcctctaccttggaagagagataaggacgtatgaggtgatgaagctgttgaaagagtttccacttagcagacacaagaagagattggtaacaacagatgaagatattgaatagtcctttcaatttcagcttgaagtacattcccttac

SEQ ID NO: 4561 - DNA, 688 bp, Artificial Sequence
  P4405 (OPLEXA::G2294)
tcctcccttaattagtatcaaaaatggtgaaaacacttcaaaagacaccaaagagaatgtcatctccatcatcatcatcttcatcatcctcatcaacatcatcatcatccataaggatgaagaagtacaagggagtgagaatgagaagttggggttcatgggtttcagagatcagagctcctaatcaaaagacaaggatctggcttggttcttactcaactgctgaagccgcggctagagcctacgacgcagcactcctatgtcttaaaggatcctcagctaataatctcaacttcccagagatctcaacttctctctaccatattatcaacaatggtgataacaacaatgacatgtcccctaagtctatacaaagagtagcagctgcagctgctgctgccaacacagatccttcctcatcatcagtctctacttcatctccattgctttcctctccatctgaagatctctatgatgttgtctccatgtcacagtatgaccaacaagtctccttgtctgaatcatcatcatggtacaactgctttgatggtgatgatcagttcatgttcattaatggagtctccgcgccgtatttgacaacatcactttctgatgatttctttgaggaaggagatatcagattatggaacttctgctgattctactttcattataccttattctttgt

SEQ ID NO: 4562 - DNA, 522 bp, Artificial Sequence
  P4406 (OPLEXA::G1791)
tgcaaaaacaaaaaccttaaaagctttcatggaacgtatagagtcttataacacgaatgagatgaaatacagaggcgtacgaaagcgtccatggggaaaatatgcggcggagattcgcgactcagctagacacggtgctcgtgtttggcttgggacgtttaacacagcggaagacgcggctcgggcttatgatagagcagctttcggcatgagaggccaaagggccattctcaattttcctcacgagtatcaaatgatgaaggacggtccaaatggcagccacgagaatgcagtggcttcctcgtcgtcgggatatagaggaggaggtggtggtgatgatgggagggaagttattgagttcgagtatttggatgatagtttattggaggagcttttagattatggtgagagatctaaccaagacaattgtaacgacgcaaaccgctagatcatcactacttacttacagtgtaatgtttttggagtaaagagtaataatcaatataatatactttagtttag

SEQ ID NO: 4563 - DNA, 722 bp, Artificial Sequence
  P4407 (OPLEXA::G1755)
gccatcttctttgctactactaatctactattacactgaatcgtttgggttcttcttcttcttcagctgctactttgttcgagtgattgctgacatgccgtcagcgtcggagattgttgacaggaaacggaagtctcgtggaacacgagatgtagctgagattctaaggaaatggagagagtacaatgagcagaccgaggcagattcttgcatcgatggtggtggttcaaaaccaatccgaaaggctcctccaaaacgttcgaggaagggttgtatgaaaggtaaaggtggacctgaaaatgggatttgtgactatacaggagttagacagaggacatggggtaaatgggttgctgagatccgtgagccaggccgaggtgctaagttatggctcggtactttctctagttcatatgaagctgcattggcttatgatgaggcttccaaagctatttacggtcagtctgcccgactcaatcttccactgctgccactgtgtcaggctcggttactgcattttctgatgaatctgaagtttgtgcacgtgaggatacaaatgcaagatctggttttggtcaggtcagactagaggattgtattgatgaatatgttctcctagatagttctagtgtattgttaatcgtagttgactattgtgaggtcttaagttgtagattgaaaatgagatagctcatatggagctttattgaaatgcaagaaag

SEQ ID NO: 4564 - DNA, 1590 bp, Artificial Sequence
  P4417 (OPLEXA::G1954)
tcttctactatcttgcatgtcttgcgtcttttatatacatctctcgtaaaccctagcaaatcatacaaggtcaagaagcttgaccttcattagacttaagcagtttataatcaactaccacgaatagcaatggataaagattactcggcaccaaacttcttaggtgaatcctcaggcggtaacgatgataacagctctggtatgatagactatatgttcaatagaaaccttcaacaacaacaaaagcaatcgatgccacaacagcagcaacatcaactctctccttccggatttggagcaacaccctttgataaaatgaacttctctgatgtgatgcagtttgcggacttcggttcgaaacttgcgttgaaccagaccagaaaccaagacgatcaagaaaccgggattgaccccgtttatttcttgaagttccctgtcttgaacgacaaaatagaggaccataaccaaacccaacatctcatgccttctcatcagacgtctcaagaaggaggtgagtgtggaggaaacataggcaatgtgtttcttgaagaaaaagaagatcaagacgatgacaacgacaacaactccgtgcaactacgttttattggaggagaagaagaagatagggagaacaagaatgttacgaaaaaggaggtgaagagcaagaggaagagagctagaacgagcaagaccagcgaagaagtggaaagccaacggatgactcatatcgcggtcgaaagaaaccgtaggaagcaaatgaatgagcatcttcgtgtccttagatctctcatgcctggctcctacgttcaaaggggagaccaagcgtcaatcataggaggagcaatagagtttgtgagagagctcgagcaactcctacaatgtcttgaatcacagaagcgtcgaagaatcttaggagaaaccggtagggacatgacaacgacaacgacttcttcttcttctcccataactacggtagcgaaccaagcacaaccgctcattattacgggaaatgtaaccgagctagagggcggaggagggcttcgggaggagactgcggagaacaagtcgtgcttggctgacgtggaggtgaagctgctagggtttgacgccatgatcaagatactttcaagaagaaggccgggacagctgattaagactatagctgctttggaggatcttcatctctctattcttcacactaacatcactaccatggaacaaaccgtcctctactcctttaatgtcaagataacaagtgaaacgaggtttacggcagaagacatagcaagttccatccaacagatatttagtttcattcatgcaaataccaacatatctggaagctctaacctgggaaatattgtgtttacttgaaaatcatcacacggcgacaactttgtacactggtgaagattacagtacgtaataatctctacatattgggttttattctccaagcatttggaagagtgtttaagttaaagggagtgcttactttatttttttggggcttttttcatgcaatttaaattttagtgatgattgtgtcgcttgtaatgttagaactcgttgttgtgatttctgctgctt

SEQ ID NO: 4565 - DNA, 1237 bp, Artificial Sequence; identical to SEQ ID NO: 4238
  P4418 (OPLEXA::G2156)

SEQ ID NO: 4566 - DNA, 1347 bp, Artificial Sequence
  P4419 (OPLEXA::G2157)
ccatgtcttgtgtgtctgcttcatgcaacatgttggtttggatttggttaatctaaaagtttaagataaggttttcggattctcttcctgtcttgtaatagtttcttgtcggagagccatcaacaccaacttcaacaaaaaaaacaagaaaaagaaaaagattctctttctcgttttatttccattagagaagaaaaaaagaatggcgaatccttggtgggtagggaatgttgcgatcggtggagttgagagtccagtgacgtcatcagctccttctttgcaccacagaaacagtaacaacaacaacccaccgactatgactcgttcggatccaagattggaccatgacttcaccaccaacaacagtggaagccctaatacccagactcagagccaagaagaacagaacagcagagacgagcaaccagctgttgaacccggatccggatccgggtctacgggtcgtcgtcctagaggtagacctcctggttccaagaacaaaccaaagagtccagttgttgttaccaaagaaagccctaactctctccagagccatgttcttgagattgctacgggagctgacgtggcggaaagcttaaacgcctttgctcgtagacgcggccggggcgtttcggtgctgagcggtagtggtttggttactaatgttactctgcgtcagcctgctgcatccggtggagttgttagtttacgtggtcagtttgagatcttgtctatgtgtggggcttttcttcctacgtctggctctcctgctgcagccgctggtttaaccatttacttagctggagctcaaggtcaagttgtgggaggtggagttgctggcccgcttattgcctctggacccgttattgtgatagctgctacgttttgcaatgccacttatgagaggttaccgattgaggaagaacaacagcaagagcagccgcttcaactagaagatgggaagaagcagaaagaagagaatgatgataacgagagtgggaataacggaaacgaaggatcgatgcagccgccgatgtataatatgcctcctaattttatcccaaatggtcatcaaatggctcaacacgacgtgtattggggtggtcctccgcctcgtgctcctccttcgtattgattagttagataggcggtggttggtgcgttctttttactggaatgattatattttccattaggatggttaggcttttgtttattaaagctatcaagtttcttttttttttacggataattcggatgacaattagctagtgtttgtttgtttgttttgtggcggcttttctgacttgactattttgatcgcggatagctttgtatgaaagtgaa

SEQ ID NO: 4567 - DNA, 918 bp, Artificial Sequence
  P4423 (OPLEXA::G2052)
acgtctagcaagtcatcgtattctactttgttgttgcaaatgggaagttcatgtttacctccagggttccggtttcatcctacggatgaagaactcatcgaatattacttgaaaagaaaagtcgaaggtctcgagattgagcttgaagtcattcccgtcatcgatctttatagtttcgatccttgggagttaccagacaagtcgtttctcccaaaccgggacatggaatggtacttcttctgctcaagggacaaaaaatatcctaatggttttcgtacaaatcgaggaacaaaggctggttattggaaagcaaccggaaaagatcgaaaaattacttctcgttcatcttctataattggttatagaaaaactctagttttctacaaaggccgtgccccgttaggcgatagaagcaattggatcatgcatgaatatcgactatgcgatgatgatacatcacaaggatcacaaaatttaaagggagcttttgtgttatgtcgtgttgctatgaagaatgagatcaaaactaatacgaaaatccgaaaaattccaagcgagcaaacaatcggatcaggagaaagctcgggtttatcaagccgagtaacgtctcctagtcgcgatgaaacaatgccgtttcactcatttgccaatcctgtatctactgaaactgattcttccaacatttggatttcacctgaattcatcctcgattcttcaaaggactatcctcaaatccaagatgtcgcatctcagtgcttccaacaagactttgattttccgatcatcggtaaccaaaacatggagtttccagcgagtacaagcttagatcagaacatggatgagtttatgcaaaacggttattggacaaattatggatacgatcaaaccggtttattcggttactcagatttctcctag

SEQ ID NO: 4568 - DNA, 1548 bp, Artificial Sequence; identical to SEQ ID NO: 4245
  P4524 (OPLEXA::G2153)

SEQ ID NO: 4569 - DNA, 1199 bp, Artificial Sequence; identical to SEQ ID NO: 703
  P4527 (OPLEXA::G937)

SEQ ID NO: 4570 - DNA, 1348 bp, Artificial Sequence
  P4528 (OPLEXA::G729)
aacaacttcagtggcagcaatagcaagagaaaggtttctttaattatgtctatggaaggtgtttttctagagaaaaccaaaacaaacacaacaactactctccctgatctatctctccacatcagtctcccagatattcatcaataccatcacaatgaatcttctaaagaatcttcaagaagatcctcccaactcgaaaacaacaaccgatcgtccaactttgaactctctttatctcatcataaccatccaacagcaagaatcttccattgtcctgatcgaagaacccttaatcttcctcatcagcagcattacaacaaccctatcatcaatggtgttcatcaaagggtcgatgaatccgagattagtaatctccaccgtccaattagaggcatcccggtctatcacaaccgttcattccctttccaccaacaaaactcttcattaccttctcttggaggaggagacatggatcaaatctcaatcttaaactcatcttccggctacaacaacgcttaccgatcattacaatcttccccgaggcttaaaggtgttcctttgcatcatcatcatcatcataatcagtatggagtcgttggatcttcagattcgtcttctcctcatcaccataaccatcatcatcatgggatgatcagatcaagattcttgcctaagatgccgacaaagcgaagcatgagagctccaaggatgcgttggactagtagcctccacgcgcggtttgttcacgctgttgagcttctaggcggccatgaaagagcaactccaaagtcggttcttgagctcatggatgtaaaagacttaactttagcacatgtgaagagccatttgcagatgtatcgaactgttaagaccactaacaagcctgctgcttcatcagatgggtcaggagaagaagaaatgggcataaatggaaacgaagttcatcatcaatcatcgacggatcaaagggcacaatctgatgatacttctcttcatcaagaaactgacatttcttccacacaacctcgttggagtaactcttcacgagagacatggccattaagtaataactgctcaagcgacatagatacaatgatcagaacttcatcaacatcaatgatctctcattatcaaagatccagcattcaaaatcaggagcaaaggtcgaatgatcaagcaaagaggtgtggaaatcttagttgtgaaaatccaagtttggagtttacattaggcagaccagattggcacgagaaatgactttcttgatcaatttggatttttatatatattggattttttatttttttgtttcatctttctctctctatatatactcagaaacatgtat

SEQ ID NO: 4571 - DNA, 986 bp, Artificial Sequence
  P4529 (OPLEXA::G1909)
atggaagtataataagtggccacggactagtactctctcaccaacttccacctctccaagcaaaccctaaccctaaccaccaccatgtcgctacctctgctggtcttccgtcaaggatgggtggatcgatggcggagagagcaaggcaggccaacattcctccactagcgggacccctaaagtgtcctcgatgcgactccagcaacactaagttctgttactacaacaactataacctcactcagcctcgtcacttctgcaaaggttgccgtcgctactggacacaagggggcgccctgagaaacgtccctgtaggtggaggctgccggaggaataacaagaagggcaaaaatggaaatttaaaatcttcttcttcttcgtccaaacagtcttcctcggtcaacgctcaaagtcctagctcaggacagctaaggacaaatcatcagttccctttttcaccaactctttacaatctcactcaactcggaggtattggtttgaacttagccgctactaatggcaacaaccaagctcaccagatcggttccagtttgatgatgagcgatctagggtttctccatggacgaaatacttcaactccgatgacgggaaacattcatgaaaacaacaacaataataacaatgaaaacaacctaatggcatccgttggatctttgagcccctttgctctcttcgatccaacgacggggctatacgctttccagaacgacggtaatatcgggaacaacgttgggatatctggttcttctacttccatggttgattctagggtttatcagacgcctccggtgaagatggaagaacaacctaatttggctaacttgtctagaccggtctccggtttgacgtctcctgggaatcaaacaaatcagtacttttggcctggttcggatttctcgggtccttctaatgatctcttgtgagatttttgtgtgttttgtcggatcattaacgtatgctacgac

SEQ ID NO: 4572 - DNA, 1411 bp, Artificial Sequence; identical to SEQ ID NO: 4254
  P4539 (OPLEXA::G989)

SEQ ID NO: 4573 - DNA, 759 bp, Artificial Sequence
  P4547 (OPLEXA::G1897)
aactctcaactctcgactttcagataacctctcttctcaacaacatgccttctgaattcagtgaatctcgtcgggttcctaagattccccacggccaaggaggatctgttgcgattccgacggatcaacaagagcagctttcttgtcctcgctgtgaatcaaccaacaccaagttctgttactacaacaactacaacttctcacaacctcgtcatttctgcaagtcttgtcgccgttactggactcatggaggtactctccgtgacattcccgtcggtggtgtttcccgtaaaagctcaaaacgttcccggacttattcctctgccgctaccacctccgttgtcggaagccggaactttcccttacaagctacgcctgttcttttccctcagtcgtcttccaacggcggtatcacgacggcgaagggaagtgcttcgtcgttctatggcggtttcagctctttgatcaactacaacgccgccgtgagcagaaatgggcctggtggcgggtttaatgggccagatgcttttggtcttgggcttggtcacgggtcgtattatgaggacgtcagatatgggcaaggaataacggtctggccgttttcaagtggcgctactgatgctgcaactactacaagccacattgctcaaatacccgccacgtggcagtttgaaggtcaagagagcaaagtcgggttcgtgtctggagactacgtagcgtgatagagactatcggttcagcttctacttcatcggaggg

SEQ ID NO: 4574 - DNA, 1763 bp, Artificial Sequence
  P4559 (OPLEXA::G843)
gccgggaagaagtgcgagcttggtgccgatgggtcgttcgaaactagcttctcgtcctgctgaggaagacctgaatccaggaaaatcaaaaaggaaaaagatatcattgggtcctgagaatgctgcggcatcaatttccaccggaattgaagctgggaatgagaggaaacctggcctttactgttgtaactattgcgataaagatctgtctggtttggttcgtttcaaatgtgctgtttgtatggactttgatctttgtgtggaatgcttttctgtcggcgttgaacttaatcgtcacaagaacagtcacccatatcgtgttatggacaatttgtctttttcgcttgttacttctgattggaatgccgatgaagagatactccttcttgaggccattgcgacatacgggtttggcaattggaaagaagttgcagaccatgttggtagtaagacaacgacagaatgtattaaacacttcaattctgcttacatgcagtcaccatgctttccacttccggacttgtcccatactattggaaagagcaaagatgagctgcttgctatgagtaaagatagtgcagtcaaaacagaaatacctgcatttgtgaggctatctccaaaagaagagttacctgtgtcagctgaaatcaaacacgaagcttcagggaaggtcaatgaaatagatccacctttgtctgccttagctggagtcaagaagaaaggcaatgtaccgcaggctaaggacatcatcaagttggaagctgcaaaacaacaatctgacaggagtgtcggggagaagaaactcagacttcctggagagaaagttccattagtaacagagttatatggttacaatctaaagagggaagaatttgagatcgaacatgacaacgatgctgagcaactgcttgctgacatggaatttaaggattctgacacagatgctgagcgtgagcagaaactgcaggttcttcgtatttactcgaaaaggcttgatgagaggaagcggaggaaggaatttgttctggaaagaaacttgttgtaccctgatcaatatgagatgagcctttcagcagaggagagaaaaatatataaaagctgtaaagtgtttgcgcggttccaatccaaagaagagcacaaggaactgattaagaaagtcattgaagagcaccaaattctcagaagaatcgaggatcttcaggaagctagaactgctggttgcaggacaacttcagacgcaaatagatttatagaagagaagagaaagaaggaagctgaagaaagtatgctgctgcggcttaaccacggtgcaccaggcagtatagccggtaaaacactaaaaagtccaagagggttacccagaaatttgcatccctttggttctgactcactgccaaaggtcacacctccaagaatatacagcggtttggacacttgggatgttgatggtctccttggagctgacttactctcagagaccgaaaagaagatgtgcaatgagaccagaatactgcctgtacactatttgaagatgttggatatcttaacaagagaaataaagaaggggcagataaagaaaaagtctgatgcttatagcttcttcaaagtagagccgagtaaagtagacagagtatatgatatgctggttcataagggaataggtgactcaacatgactcatagcttcatggtcctaacatgtacttctcgaacatatattagccatgtaaatataaaggaaggtgatgctgattttggttacac

SEQ ID NO: 4575 - DNA, 500 bp, Artificial Sequence
  P4562 (OPLEXA::G1481)
gacacaaaacgaacaaccacagaaacttgaaagagagaaagagtttgattttgattaaaatggggaagaagtgtgatttatgtaacggtgttgcaagaatgtattgcgagtcagatcaagctagtttatgttgggattgcgacggtaaagttcacggcgctaatttcttggtagctaaacacacgcgttgtcttctctgtagcgcttgtcagtctcttacgccgtggaaagctactgggcttcgtcttggcccaactttctccgtctgcgagtcatgcgtcgctcttaaaaacgccggcggtggccgtggaaacagagttttatcggagaatcgtggtcaggaggaggttaatagtctctgctccgatgatgagatcggaagctcttcagctcaagggtcaaactattctcggccgttgaagcgatcggcgtttaaatcaacggttgttgtttaactcacactctaccgtatcgtcagaatgaacggcgccggtacatcg

SEQ ID NO: 4576 - DNA, 863 bp, Artificial Sequence
  P4563 (OPLEXA::G1884)
ctcttgtcccatattgcaccatctccttcagaaaaaaataaaaagagtttataactcatgatgacgtcatcccatcagagcaacaccaccggctttaaaccgcggcggatcaagacgacggcgaagccaccacgtcagatcaataacaaagaaccatctccggcgacgcagccggtgctcaagtgtccgagatgtgattcagtcaacaccaaattctgctactacaacaactacagcttgtctcagccacgtcactactgcaagaactgtcgtcgttactggacacgtggcggcgccctccgtaacgttcccatcggtggctccactcgaaacaagaacaagccttgcagcctccaagtcatctcttctcctcctttgttctcgaacgggacgtcatcggcgtctcgtgagcttgtaagaaaccatccatcgacggcaatgatgatgatgagttctggtggattctccggctatatgtttccgttggatcctaacttcaaccttgcctcgtcttctatcgagtctttgagttcttttaaccaagatttgcaccagaagcttcagcaacaaagactcgtcacttccatgtttctccaagattctcttccggttaacgagaaaacggttatgtttcagaacgtagagttgattcctccttcgacggtgacgacggattgggttttcgataggttcgccactggaggaggtgcaacaagtggcaatcatgaagataatgatgatggggagggtaatttgggaaattggttccataatgctaataataatgctctgctctaattatcaattatcatttactctctatttctctaaatattgtagctagcatgcagaagctatggctg

SEQ ID NO: 4577 - DNA, 828 bp, Artificial Sequence; identical to SEQ ID NO: 4266
  P4566 (OPLEXA::G2513)

SEQ ID NO: 4578 - DNA, 1668 bp, Artificial Sequence; identical to SEQ ID NO: 4278
  P4593 (OPLEXA::G922)

SEQ ID NO: 4579 - DNA, 1325 bp, Artificial Sequence
  P4598 (OPLEXA::G2150)
tcttcagaattcccagagaagttgttggaattgaatttttcacttttttgttcataaaagttctagtctttttagatgaacatggacaaggaaacagagcaaaccctaaattacttacctttgggtcagagcgatccctttggcaatggcaatgaaggaacaattggagatttccttggaagatactgcaacaaccctcaggagatttcaccgttaactctacaatccttctctctgaattctcagatctccgagaatttcccaatctctggtggaatcagattccctccatatccaggtcaatttggatccgatcgtgaatttgggtcacaaccaacaacgcaggagagtaacaagagctctttgttggatccagattcagtttcggatcgagttcacaccacgaaatctaactctagaaagaggaagtcgattcctagtggtaatggcaaggagtctccagcttcatcgtctcttacagcttccaattcaaaggtttcaggagagaatggtggatctaaaggtgggaagagaagcaagcaagatgtagctgggagtagtaaaaacggagtagagaagtgcgatagtaaaggcgacaataaggacgatgctaagcctcctgaggcgcctaaagattatattcatgtcagagctagaaggggtcaagcaactgatagccatagtcttgctgaaagagcaagaagagaaaagattagtgagagaatgacgttgcttcaggatctggttcctggttgcaaccggattacagggaaagcagtcatgcttgatgaaattataaattatgtgcagtccttgcagagacaagttgagttcttgtccatgaagctggctaccgtaaatccaaggatggagtttaatgctaatgcttctttatccacagagatgattcaaccgggggagtcgttaacgcagtctctttacgcaatggcttgctcagagcaaagacttccatcagcatactattcacttggcaagaacatgccaagattctcagacacacaattcccctcaaacgatggatttgttcacactgagacaccaggattctgggaaaataatgacctgcaaagcattgttcagatgggttttggagatatcctccagcaacagagcaacaacaacaacaacaactgttctgagccaacgcttcagatgaagcttgaaccatagtccatagctatgattattatctctgttgtacatacagaaaaccaagtagtgatgagtaacggagtgaatcatattggaattttaatgtttacaatcgttgcttctttgcttgtgtctctgttgatttcttctca

SEQ ID NO: 4580 - DNA, 817 bp, Artificial Sequence
  P4601 (OPLEXA::G1808)
ccccttctaatttctctcatctctctattagaaaaattattagcaattatgttgtccactgcaccggccttttcattctccgaaccgggtttggttaatcaattctcgggtttccaaaccgggttcactccttgggaatgggattgctctgatctctttttcgtggaccaaatgtctcttgaaccggccatccctagtccttgttatggtgaatccgacactggttccgtcaaaattaattccggttctcatgacatgaaaaccggttctgacgaatcttgtgccggtttcgtcaaaattaatcctcgttgtgacgacgccgacatatcaaacgatctaccgtgctctcaagcagatgaaccggactcggacgacacaaaacaattgacagccatcacaaatttcggttcgggagagaataaccataaccggaaaaaaatgatccaaccggagatgaccgacgagcggaagaggaagaggatggagtcaaaccgggaatcagcgaaacggtcaagaatgcgtaaacaaagtcacattgataacttacgagagcaagtaaaccggttggatttagaaaaccgtgagctcgggaaccgactccggttagttttacaccagcttcaacgagtgaattccgacaataaccggctcgtgacagaacaagagatactccggctaagattgtcggagatgcgtcggattctgatcattagacaacttcaacaacagcaacaatgggaactacataaccggagaatgatcatgactgaacaaaaccaccctcatcttcaatgatagatcaaaatatttaagaagg

SEQ ID NO: 4581 - DNA, 1590 bp, Artificial Sequence
  P4603 (OPLEXA::G2072)
tatgccattttcctccccgtggaaggtctaacaatcacacgtctcctaatctcgtacgtcttcttaggtatgttctttgcatgttaaagaaactgtatcttcaattcttgtcattacatgataatggttttcttatacatgttttgctcataccttataggttttgaagaatggaaaatttaaggaggttgtcaaacccgggaaatttcggattcattggaagatcacaatcacgagttccccaaaaaaacatggaaaataacatttctcctcctaataatatgcaccaccatagtgcttctttagatgatcttttcacagaagaccaaccagcttggctcgatgagctcctaagtgagccagcatcacctaagattaacaaaggtcatagacgttcagctagtgacacagctgcttacttgaactcagctttaatgccttcgaaggaaaatcatgttgctggttcgtcttggcagttccagaactatgatttgtggcagtccaactcttatgaacaacacaataaattaggatgggatttctctacagcaaatggaactaatatccaaagaaatatgtcatgcggagctttaaatatgtcgtcgaaacccattgagaaacatgtaagcaaaatgaaagaaggaacttctacaaaaccagatggtcctagatcaaagactgactcaaaacgtatcaaacagtaagtagtcttatctttgtcatgtgtacttataataggttattaaaatgtcccacatcgattgagattaagatctttaggcattatctggcaatccttaactcttgagctaactgttgggataagttagaccacattcctaatataggttgataaacatatttctgatgcggtttaataatatacaattttatcgaaaattattaaaatgcagtcaaaatgctcatcgagcgcgtttgagaaggcttgagtacatatcagaccttgaaaggaccatccaagtgctacaagtaagattctaaaggctcgtgtatttctcgaagttctttaatttcattaataatatgaaaagattcctaatgttatattatacatgttggattttcttcaataggttgaaggatgtgaaatgtcatctgccattcactacttggatcagcagttactcatgcttagcatggaaaatagagctttaaaacaacgtatggatagtttagcagaaatccaaaagcttaaacatggtatttaacctttcatatcactactaaaatggatcaaaatgcatttattttgttctcttgtaaaattttgattttggttggttaatacagtggagcagcaattgcttgagagagagataggaaacctacagtttcgacgacaccaacaacaaccacagcaaaaccaaaaacaagtccaagcaatacaaaatcgatacaacaaatatcaaccacctgttacacaagaacccgatgcccaatttgcagccttggcaatatgatttaggaaatatggatacattgttcagattaagctgagctcctcttgctctaccttaatgtccatacaacataggtgaacttgatgtttgtagccttgaatgaaaaccg

SEQ ID NO: 4582 - DNA, 1149 bp, Artificial Sequence
  P4605 (OPLEXA::G2116)
ttcatctccatcattatctccattgacattgttctcaattgcgaataataatcataattattcacacaaccaaagcattcatctctcagattctcttaaaaaaatggagaaatcagatcctccaccagtcccaaagcccggcgccactattatcccctcctccgatccaattcctaatgccgatccgattccatcttcttccttccaccgccgatctcgctccgacgatatgtccatgttcatgttcatggatcccctctcctccgccgcaccaccttcctccgacgaccttccctccgacgacgatctcttctcttctttcatcgatgtcgatagcctcacctctaatcccaatccctttcaaaatccttccctctcctccaactccgtttccggcgctgctaatcctcctcctcctccttcctctcgtcctcgccaccgtcacagcaattccgttgacgctggatgcgccatgtatgccggtgatatcatggacgctaagaaagctatgcctcctgaaaaactctctgagctttggaacatcgatcccaaacgcgccaaaaggattctagcgaatcgacaatctgcagctcgatccaaagagagaaaagctcgatacattcaagaacttgagcgcaaagttcaatctcttcaaaccgaagctaccactctctctgctcagcttactctctaccagagagacacaaatggactagcaaacgaaaacacagagctgaaacttaggttgcaagcaatggaacaacaagctcagcttcgtaatgctttaaacgaagcgttgaggaaagaagttgaaaggatgaagatggagacaggagaaatctctggtaattcagattcgtttgatatgggaatgcagcagattcagtattcttcctcaactttcatggctattccaccatatcatggctcaatgaacctccatgatatgcagatgcattctagtttcaatcctatggagatgtccaattctcaaagcgtgtcggactttctacagaacggccgaatgcaagggctggagattagtagcaatagctcaagcttagtcaaatctgaaggaccttctctctctgctagtgagagtagctctgcctattgacgacaagattatgatgaggctcatttttctgg

SEQ ID NO: 4583 - DNA, 866 bp, Artificial Sequence
  P4728 (OPLEXA::G1815)
tatgagacattagttatagaagagagactaacatgaagatggatttttcatgtttccaagaatacccttttgagtttcattgcagaggaacaacatttaatgggtttagagaaaacaatgcagtgtctgaaacagtagaagagttctgtaataaaagaaggatgcagaagaagagtgatgatttgaagactaagaagaagaagaaacagagtgtttctagggtttgtagtagaggacattggaggatctctgaagatactcagcttatggagcttgtttcggtttacggtcctcaaaactggaaccacattgcagagagtatgcaaggaagaacaggtaacgacaaaaattgaaatctttaatcttcccttagctaattccggaacatgaaacttacaatgttttttcttgcttctttgtgttttgtcttaaaggaaagagctgcagattgaggtggtttaaccagttagatccgaggattaacaagagagctttcagtgatgaagaagaagagagactacttgctgctcatagagcttttggtaacaaatgggctatgattgctaagcttttcaatggaagaacagataatgccttgaagaatcattggcatgttctcatggcaaggaagatgagacagcaatcaagttcttacgtccaaagattcaatggttctgctcatgaatctaacacagatcacaaaatcttcaatctttctcctggtttgtctcttcttaccttacacatatgcattgagtttaactctgttattgtaatgagatactttcgatatttatcactcaggaacaatgaacttatggtttggtctcaaaagtagtcagattgcaagtttggtgagtctttaa

SEQ ID NO: 4584 - DNA, 1235 bp, Artificial Sequence; identical to SEQ ID NO: 4312
  P4729 (OPLEXA::G2893)

SEQ ID NO: 4585 - DNA, 1099 bp, Artificial Sequence
  P4741 (OPLEXA::G2296)
atcctaaacagaaaatatgtctcttgagattgatgcgaaggctgtctcagcactcctccttggccaaggatgcgctaacaatctcaagacgctcctcaaaaaccatgaaacaggctcagtttcaacagagccactcatcaactccattcttgattctttctcgtttgctctgtcttctcagaacataccacgtcatgtgtctcaaagatcatcaaagaagtaaattattaaaaactctaaatcaagtagaaaacacacacctgttttggtctatgttactctatttcttctaccactttcgatgcaagtatcctagtgaacattgctctgatacaacattgcagaaagatgtgtggaatacaaggtatggaagattctccgacaccggcccacattgatggcttcatctggaggaaatatggacaaaagaccatcaaaacctctccgcaccaaaggttagttaattaagtagattagaaagacatagctactgctctcttttcacaaatacagagctattttctagagtgtgtattgagcgatgactaattgtagagtaaaatttacaggtggtactaccgatgtgcctatgcgaaagaccaaaactgcgacgctaccaagcgggtacagaagatccaagacaatcctccagtgtacagaaacacctatgtcggacaacatgcatgtgaagctccagcttatgcagttaataatggtggtacatacggttcaaaaatgatcaaattcgactatgttattcctgaatcggttatgcctcaacctttatcaattgattcccaagaaattaccatggaggataaagacacagacgaccatattttgaactatattaacgagcatttgatggaagatgaggcgtatgatgttttccctgatgtacttggagaacgttgctgctttggattagaaccctttccaggattgaacattaataaatcttaaaagcttttcatgttcttcgatcttatggtggagaatgaatgattcattcttcatttcttttcatgttcatgttttgtaattttgatttacgtgttgtttttttgtaaaaggaagttttatcagtgatgtatttctt

SEQ ID NO: 4586 - DNA, 1225 bp, Artificial Sequence; identical to SEQ ID NO: 1397
  P4743 (OPLEXA::G2137)

SEQ ID NO: 4587 - DNA, 1520 bp, Artificial Sequence
  P4753 (OPLEXA::G2141)
ttctgattagtgagtggtgttcatcaagtattagaagaagatggatttaagtgcgaaagatgagttttcagcagagaagaggaatcctgataactatgattctgttaataatccgtctggagattggcgagttgattcatatccttcagagaatctgatttcagctggtcctgcgtcttgttctccttctcagatgatggattcatttgggcaaactctttggtatgatcccacgagtgttcaggctgttggttatgccggttttaatggtggtaatgcttcgtcttcttcgtttaggggtagtattgatagatctcttgaaatgggttggaatctgcctaatttgttgcctcctaaaggcaatggtcttttcttaccgaatgcgagtagtttccttcctccgagtatggctcagttcccggctgattcaggttttatagagcgtgcagcgaggttttcgctctttagcggtgggaattttagtgatatggtgaatcaaccacttgggaattctgaggctattggtttgtttcttcaaggtggtggaacaatgcaagggcagtgtcaaagtaatgaacttaatgttggtgaacctcacaatgatgtatctgtagcagtgaaagaatcaactgttagatctagtgaacaagctaaaccgaatgttcctggatcgggcaatgtatccgaggatactcagtctagtggtggtaatggtcagaaaggcagagaaacctcttccaacacaaagaagaggaaaagaaatgggcagaagaactctgaagcagctcaatcacacagatcccagcagtctgaggaagaaccagacaacaatggtgatgaaaagcgcaatgatgagcaaagtccaaattcacctggaaagaagtcaaacagtgggaaacaacagggcaaacaaagttctgatcctccaaaagatggatatattcatgtacgggcacgaagaggccaggccacaaatagccatagtcttgcagaaagagttaggagagaaaaaattagtgaaaggatgaagtttcttcaagatctagtaccgggttgcaacaaggtgactgggaaggcagttatgcttgacgaaatcataaactacgtacaatcactacaacgccaagttgagtttttatcgatgaaacttgcaactgtgaacccacaaatggactttaaccttgaaggtcttcttgcaaaagatgcacttcaactacgagctggttcttcatctacaacaccattcccaccaaatatgtcaatggcttatcctcctctacctcatggattcatgcaacaaactctttccagcattggaaggaccattacctctccattgtctcctatgaatggtggattcaagcgacaggaaacaaatggatgggagggtgatttgcaaaatgtgatccacattaactatggagctggtgatgtcacacctgaccctcaagcagcagctacagcatctcttccagctgcaaatatgaaggttgagccatgatatttcgtcctgttagata

SEQ ID NO: 4588 - DNA, 1176 bp, Artificial Sequence; identical to SEQ ID NO: 4336
  P4754 (OPLEXA::G2145)

SEQ ID NO: 4589 - DNA, 597 bp, Artificial Sequence; identical to SEQ ID NO: 4012
  P4776 (OPLEXA::G24)

SEQ ID NO: 4590 - DNA, 1125 bp, Artificial Sequence; identical to SEQ ID NO: 3799
  P4877 (OPLEXA::G237)

SEQ ID NO: 4591 - DNA, 1002 bp, Artificial Sequence; identical to SEQ ID NO: 3950
  P4914 (OPLEXA::G1324)

SEQ ID NO: 4592 - DNA, 1241 bp, Artificial Sequence
  P4942 (OPLEXA::G522)
gtgtcctatacacatatctataattccacaggttgaagaaaagaaataatggaatcggtggatcaatcatgtagtgttcctccgggattcagattccatccaacagatgaagagctcgttggttactatttaaggaaaaaagttgcatcgcaaaagatcgatcttgatgtcataagagatattgatctctacagaatcgaaccatgggatttacaagagagctgccgaatcggatatgaggaaagaaatgaatggtatttcttcagccacaaagataagaaatatccaacaggaacaagaacaaacagagcgaccatggctgggttttggaaagccacgggccgagacaaggctgtttacgacaagtcaaaactgattggtatgagaaaaacacttgtgttctacaaaggaagagcccctaatggccaaaaaaccgattggatcatgcatgaataccggctagagtcagatgagaatgcacctcctcaggaagaagggtgggtggtttgtagagcgttcaagaaaaagccaatgaccgggcaagccaagaacacagaaacttggagctcaagttacttttacgacgaattaccgagtggagtacgctcagttacggagcctcttaactacgtatctaagcagaaacaaaacgtttttgcacaagatttaatgttcaagcaagaactagaaggatcagatatcggtttaaacttcatccactgcgatcaattcattcaacttccgcagcttgaaagcccttcactccctcttaccaaaagaccagtgagcttgacgtcaattacatcattggagaagaataaaaatatctacaaaagacatttaatagaagaggatgtgagcttcaatgcgctaataagtagtggaaataaagataagaagaagaagaaaacatcagtgatgacgacggattggagagcactcgataaatttgttgcttctcaacttatgagccaagaagatggagtttcgggttttggaggtcatcatgaagaagataacaataaaatcggtcattacaataacgaagagagcaataacaagggatcagtagagactgcttcttccacgttattgagtgatagagaagaagagaacagattcatcagtggattattgtgttccaacttggactatgacttatatagggatttacatgtttgataaaagataacactataatatggtgcgtaacgtttgctatataggtaccgtagaattta

SEQ ID NO: 4593 - DNA, 982 bp, Artificial Sequence
  P4955 (OPLEXA::G159)
cgcttttctttttctgttcaaaacatctcgaaaatggcgagaaagaatcttggtcgtagaaaaatagagttggtaaaaatgaccaacgaatcaaaccttcaagttacgttttcaaaaagaagatctggtcttttcaaaaaaggcagtgaactttgcaccttatgtgacgcggaaattgcgataatcgtgttttcaccctcgggaaaagcatactcttttggtcatccaaatgttaacaagttacttgaccactctttagggcgtgttataagacacaacaacacaaactttgctgaaagccgcacaaagctccgtattcaaatgctcaatgagtctttaactgaggtgatggctgaaaaagaaaaagaacaagagaccaagcagtcaatagtccaaaatgaaagagagaacaaggacgctgagaagtggtggaggaactctccaacagaactcaacttagctcaatcaacttccatgaaatgtgatcttgaagctttgaagaaggaagttgatgaaaaagtcgctcaacttcatcatagaaacctaaacttctatgttggaagttctagcaatgttgctgctccagcagctgttagtggtggtaatatctccacaaaccatggtttctttgatcaaaacggaaactctacttctgctccaacactgccgtttggatttaatgttatgaatcgcacaccagctgggtacaacagttaccaactccaaaaccaggaggttaaacaagtccatcctcagtattgggctcgttactattagtctatctctctcgttgtgtgactttttaagtctccaatagtttgttctgctttttgttttgtttttgtttgttgttgttgttgttgtcgggcttttaattaagtctcgagtcaactagtttcttgtttcttttcgttatactttgtcttgtagctttatatcattttcttgtggaatatgagtaagctatatgaagtttcatatt

SEQ ID NO: 4594 - DNA, 1034 bp, Artificial Sequence; identical to SEQ ID NO: 3812
  P5072 (OPLEXA::G482)

SEQ ID NO: 4595 - DNA, 649 bp, Artificial Sequence; identical to SEQ ID NO: 3832
  P5099 (OPLEXA::G682)

SEQ ID NO: 4596 - DNA, 1034 bp, Artificial Sequence; identical to SEQ ID NO: 157
  P5142 (OPLEXA::G190)

SEQ ID NO: 4597 - DNA, 1136 bp, Artificial Sequence
  P5557 (OPLEXA::G881)
gtgaccgaagaaagcaaattgagactacgcaccaactagtcctttggtttgtatcttaagataaaggtttcttttatggacggttcttcgtttctcgacatctctctcgatctcaacaccaatcctttctccgcaaaacttccgaagaaggaggtctcagttttggcttctactcacttaaagaggaaatggttggagcaagacgagagcgcaagtgagttacgagaggagctaaacagagttaattcagagaacaagaagctaacagagatgttagctagagtctgtgagagctacaacgaactacataatcatttggagaagcttcagagtcgccagagccctgaaatcgagcagaccgatataccgataaagaaaagaaaacaagacccggatgagttcttaggctttcctattggactcagtagtggaaaaactgagaacagctccagcaacgaagatcatcatcatcatcatcagcaacatgagcagaaaaatcagcttctttcatgtaaaagaccagtcactgatagcttcaacaaagcaaaagtttcgactgtctacgtgcctactgaaacatcggacacaagcttgacagttaaagatggatttcaatggaggaaatacggacaaaaggttacaagagacaacccgtcacctagagcttactttagatgctcgtttgcaccgtcttgtccagtaaaaaagaaggtacaacgcagcgcagaggatccatctttacttgtagcgacatacgaagggacgcataaccacttgggtccaaatgcttctgaaggggatgctacaagccagggtgggtcaagcacagtgactttggatctggttaatggctgtcatagactagcgttggagaaaaacgaaagggataatacgatgcaagaggttctgattcaacaaatggcgtcatcgttaacaaaagattcgaaatttacagctgctcttgctgctgctatatctgggaggttaatggagcaatctagaacatgaacgtttttagtgaatgtattgtttttgtttgtttagaatgattcttcgttttcgaattgtgtctttcgattaggagataaaagatgtatataaatattataagtagatgaagaaatcgtataagtaaa

SEQ ID NO: 4598 - DNA, 673 bp, Artificial Sequence; identical to SEQ ID NO: 4227
  P6071 (OPLEXA::G1792)

SEQ ID NO: 4599 - DNA, 1079 bp, Artificial Sequence
  P6407 (OPLEXA::G187)
ggcttatctcatctcttcttctttgtcttctttactctttttttacctctctcttcattgttcttcaccatgtctaatgaaaccagagatctctacaactaccaatacccttcatcgttttcgttgcacgaaatgatgaatctgcctacttcaaatccatcttcttatggaaacctcccatcacaaaacggttttaatccatctacttattccttcaccgattgtctccaaagttctccagcagcgtatgaatctctacttcagaaaacttttggtctttctccctcttcctcagaggttttcaattcttcgatcgatcaagaaccgaaccgtgatgttactaatgacgtaatcaatggtggtgcatgcaacgagactgaaactagggtttctccttctaattcttcctctagtgaggctgatcaccccggtgaagattccggtaagagccggaggaaacgagagttagtcggtgaagaagatcaaatttccaaaaaagttgggaaaacgaaaaagactgaggtgaagaaacaaagagagccacgagtctcgtttatgactaaaagtgaagttgatcatcttgaagatggttatagatggagaaaatacggccaaaaggctgtaaaaaatagcccttatccaaggagttactatagatgtacaacacaaaagtgcaacgtgaagaaacgagtggagagatcgttccaagatccaacggttgtgattacaacttacgagggtcaacacaaccacccgattccgactaatcttcgaggaagttctgccgcggctgctatgttctccgcagacctcatgactccaagaagctttgcacatgatatgtttaggacggcagcttatactaacggcggttctgtggcggcggctttggattatggatatggacaaagtggttatggtagtgtgaattcaaaccctagttctcaccaagtgtatcatcaagggggtgagtatgagctcttgagggagatttttccttcaattttctttaagcaagagccttgatcgatcattgttataactacatatattatatatattgagagagagaggtagag

SEQ ID NO: 4600 - DNA, 451 bp, Artificial Sequence
  P6424 (OPLEXA::G1795)
acaaacacgcaaaaagtcattaatatatggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatgagcgagatataattcatgattatttctaac

SEQ ID NO: 4601 - DNA, 831 bp, Artificial Sequence; identical to SEQ ID NO: 3811
  P6812 (OPLEXA::G481)

SEQ ID NO: 4602 - DNA, 1281 bp, Artificial Sequence; identical to SEQ ID NO: 15
  P7140 (OPLEXA::G867)

SEQ ID NO: 4603 - DNA, 820 bp, Artificial Sequence; identical to SEQ ID NO: 4267
  P7170 (OPLEXA::G2107)

SEQ ID NO: 4604 - DNA, 1246 bp, Artificial Sequence; identical to SEQ ID NO: 3851
  P7824 (OPLEXA::G9)

SEQ ID NO: 4605 - DNA, 949 bp, Artificial Sequence
  P7826 (OPLEXA::G28)
gaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaa

SEQ ID NO: 4606 - DNA, 1473 bp, Artificial Sequence; identical to SEQ ID NO: 797
  P7832 (OPLEXA::G1067)

SEQ ID NO: 4607 - DNA, 1820 bp, Artificial Sequence
  P8079 (OPLEXA::G2345)
ccgatttcccaatctctacctgattatctagggtttctgagatggccgaatcgcaaaccggtggtggtggtggtggaagccatgagagtggcggtgatcagagcccgaggtctttgaatgttcgtgagcaggacaggtttcttccgattgctaacataagccgtatcatgaagagaggtttacctctaaatggcaaaatcgctaaagatgctaaagagactatgcaggaatgtgtctctgaattcatcagcttcgtcaccagcgagtaatttctttctctactttctcaaaaatgttacctttttgttgctttggtggttatagcgtgtaaagccctcttctttgttaagttagattgatgttatattcattgggttgttaagcaaagtcactatgtcgattttggaatattgttttgccttttagggctagtgataagtgccaaagagagaaaaggaagaccatcaatggagatgatttgctttgggctatggccactttaggattcgaagattacatcgatcccctcaaggtttacctgatgcgatatagagaggtatgttccacttcagattagtcagtttacattctgctatacattcactgactctctgtttttccttctcatttccttgtctatgctatttggattggaattttgcagatggaggttcgtggttctcctctttcatttatctttctgatagtcgaattttgtacgtggatccttttatggggtatatggtgtatgattgtatctaattaggattgtctgctaccctttgctattgttatctgtctgatagggtgacactaaaggatcaggaaaaggcggggaatcgagtgcaaagagagatggtcaaccaagccaagtgtctcaggtaatgactcggtcttctccagttgatatggtcgtttacctaagcattagcttctccagctaatttattgtttccctgtctttactttctgaacagttctcgcaggttcctcaacaaggctcattctcacagggtccttatggaaactctcaagtaagtgttttccgacaaaagaaatgttgatacttataaatgaattcattctctacatagagcagagccggggtataaagagagaatattattaacaattaaaggatttaaggactttaatagactcgataaaaccgtcatatatgcattatccactttttgaaatctagacataggttctcatatgttccagtctctgaggttcggcaatagcatcgagcatcttgaagtgttaatggtatttgtaatctatcaatatgcagataattgattaaactcgtttgtgaatgtagggttcgaatatgatggttcaaatgccgggcacagagtagtactaggacactattcatcacaatcttccgagactcgactatgcctgttgtgtctgagaatctgagtgatccactttccatagatatggattgtggtatctcagtttttgggagagagaagatttgtatatgattgtgttgtagggagaagagtttggtttgcttatgataagaattgaaaagcaccttttttttcttttgactgttatgtttcttaggttttggtcttaagcagaagctatttatcaccacttcattggcctgttgattctttcatgcaagtgagcccgtaacttttataaaacaacatcatgatttataattatctctttgattttttggtcctaaattcgagtttcatttgacatcatccattgataaaaagaaacgaaacttgatattgaatcgttgtggtgtggtaaaattcacgatctaagtttgtgataacactccg

SEQ ID NO: 4608 - DNA, 1187 bp, Artificial Sequence
  P8223 (OPLEXA::G1816)
atttcatcacattaatttctctctatttttcttttcttacttcaatagtaatggataacactgaccgtcgtcgccgtcgtaagcaacacaaaatcgccctccatgactctgaaggtacctctctattctctatatattttctatttcctaaatccaattttattaaacatcttgaaaataaatttagttcctagctaggatcatattctctttgtatatattcgttaaaacgagggatacgtttaattacttctaaattagttacacctcgtgctgactaaaagacttatcaagattagtttctagttttaacaaaaattaatatctttttaaaaagtttatatttgtctttttttgttagtttaatattgttttgagtttaattggtttaatattgttatttgcagaagtgagcagtatcgaatgggagtttatcaacatgactgaacaagaagaagatctcatctttcgaatgtacagacttgtcggtgataggtaacaatttcttcttcttctactttttctaagattatcccagcataaaataaattttatattttagacatgtctagctaaaacaatttaatatgcaggtatatacaattttacatacgttaatttaagcatatgtactttataacatatgtacagtgtaccatgttgtaggggaagcacatggtgtccactaattttctaaaaaaagacatttaattaaagctatcacgttcattaaattatatatgtacacacatatatatagagataaaaataagaacctaatttactattcttatcagtacgtactcatgtatataaatgcttggctggctcaaaaatggaaatttttgaactgacaaattatattttattatgaaaatataaatgctaatgcttgggataaaaatgtttttttttttcttttgaattaggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctagtgtttttgtttttaagccaacgaaaaaagaaaataaaaaaattataatagatgtatagtagtggttcttgttagtttgaagaattcatc

SEQ ID NO: 4609 - DNA, 713 bp, Artificial Sequence
  P8239 (OPLEXA::G1274)
tcttcacttctctagttcttggatgctttaaacctctctctctctctctctcaattatttttttttctatttcaaaaacaaaaaaaaatgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaatccaaatctctcatcctcgttgagattgtaagataccaaca

SEQ ID NO: 4610 - DNA, 1436 bp, Artificial Sequence
  P8242 (OPLEXA::G3086)
acgaaacttccggtgtggtactgcaaacggagaaaaaaataaccaaagaagagagaaactcaaaagctactaagatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgaaactagaagtgggagtatgcgcgagtgctagccagggagggagttgtgcatagaagtatcggttcggcctttggagaaaagtcgaagatagcaaagtagagaagagatcatgaacaaagctaaatttggtggtggtggtgaaaagggtttttgtaaagttggaacctttttttggtagggaagaaagtagcaaggttgtgtaatggtccgaactccaatgct

SEQ ID NO: 4611 - DNA, 1092 bp, Artificial Sequence
  P8576 (OPLEXA::G2423)
tgctgaacaatcttgttgtggtctcttctgtgtatatcaatggatgaaaaaggaagaagcttgaagaacaacaacatggaagacgagatggacctaaagagaggtccgtggactgctgaagaagattttaagctcatgaattacattgctactaatggagaaggtcgctggaactctctttctcgttgcgccggcctccaacgcaccggtaaaagctgtagactaaggtggttaaactatctccgccctgacgtccgccgtggaaacattacacttgaagaacaactcttgatcctcgaacttcattcccgttggggaaatagatggtcaaaaatcgcacaatatttaccgggaagaacggacaacgagatcaagaactactggaggacgcgggtgcaaaagcatgcgaaacagttgaaatgtgatgtgaatagccaacaattcaaagacacaatgaagtacttgtggatgcctcgactagtcgagaggattcagtcagcctcggcctcatccgcagcagcagccaccaccacaaccaccaccaccacaggatcagccggcacgtcatcttgcatcacaacctctaacaatcaattcatgaattacgactacaacaacaacaacatgggacaacagtttggtgtaatgagcaacaatgattatatcacgcctgaaaattccagcgtggcagtgtctccggcgtcagacttaacggagtactacagcgctccaaaccctaacccggaatactattcgggtcaaatggggaatagttattatccagatcagaatttagtgagttcacaattattaccggataattatttcgactatagtggattattagacgaagatctaacggctatgcaagagcagagtaacctcagctggtttgaaaacattaatggtgctgcttcttcttcagacagtttatggaacattggagaaactgatgaagaattctggttcttacagcagcaacaacagttcaacaataatggtagcttctgaagttagaaaaaaaaaatagaaatcgttttaagttaaattatacactatagtatacgtgtgaaaggaatttgttgtaaggga

SEQ ID NO: 4612 - DNA, 954 bp, Artificial Sequence
  P8587 (OPLEXA::G2999)
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4613 - DNA, 304 bp, Artificial Sequence
  P8664 (OPLEXA::G2718)
acggtgcgtcgtaaatctttgtgtactaaggtgtcttttgagatgaatacgcagcgtaagtcgaagcatcttaagaccaatccaaccattgttgcctcttcttctgaagaagtgagcagtcttgagtgggaagaaatagcaatggctcaggaagaagaggatttgatttgcaggatgtataagcttgtcggtgaaaggtgggatttaatagctgggaggattccaggaagaacagcagaagagattgagaggttttgggtgatgaagaatcatcgaagatctcaattacgttgatggccaactc

SEQ ID NO: 4614 - DNA, 4725 bp, Artificial Sequence
  P13371 (35S::G287)
tcgacctctcaagcggctgtgtttgtcgtgggtcggtttataatcattatctcccccggaaaacttctcggagaaggagaagaatggttattccggcgacttctaggtctttttttcttctcatttgcataaatatcaagcaagctgtctctatcatttgactattgattttcttacttagtttttaagtaatatcaaattaattgtttaatacagttatagtttctatataaaaatgggttcaactaaacattcttcttctaattacgtctgctaggtttgggtttcgtgctgaattcaacaccaaggagtttcaagcttcctgcatctctctcgctaagtaaaaaatctctcttttaagtttccgttgaattcatctttgttttaacctaaaaaaattctttatttctgggtttcttcgagcttcactgaaaactttactcctggatttggtgaatgcagtgaaatcgatgcggctattgggagaaatgaagttccagggaatattcaagagctcgctttaatcctcaataatgtttgtttatatttttttgtcttgtaaaagtttcgatttttcaaggtgcttttagtttaatcttagtgctcttgtttatgtgtgttacttggtgtaggtgtgccgacgtaaatgtgatgattatcaaaccagggcggtggtaatggcgctgatgatctcagtcaaggtaaaagagttagaattagcaactccagctcaagtcaatttcggcagaaatttgctgatttggatatgtaacactgaatttgtgtttctctcatagagtgcttgtcagcttggatggttcccggagagagagactcaagaattgttggctatcatagacttggtatgttttgttccagccgaatgtggtgattagagagtaatctgatttctgtgaataatgatgtttttattcttgttcagatgtggaatggtttcagctgtcctgaaaatgtcacctcttgtgtaaatagtcccgtcactctaatatcgcaggtcattgagaggtaggcttttcatgtgttttcattcatttatttcaaactagcaaggttaccagtctgctactctaaataatactagttaactaaaaatcaaaaccttggtttgtttcaatctcctacttttctatctgtaggttctatccatgtgtgaagctggggcatattcttgtttcttttgaagctaaggtgactttatatattattcagttcttagcacctttctttttaatgtgtgttttagtcagctttgtttccttctcgcagccagaatcaaagatgatgatgaaggacttccatatttcaaagaagatgccacattctcccaaacagaaagttgtatgtattggaatttaagttatgaatgtgtcttgataccagattttgcgttgtcaatttgaatttttttggtcgcttatatagtattgtgcatatgtggtttctcctgcatatatgttttaaatgcaattagattagaagatgcatgaatatactttcaaagctatacctttcagctttgctcgtcgtgtcacttcagcattttttcgtttcgaatctttgtttatgtacctgcttcttatgctcaatatagttacggaattttgtgctcttcagggattatttgttgttcggacagaggacataagcagatctaattgtattgtacatccacaaggagtcaggtgtggttggattgctttattttttccgccggatgtttgtgaagcagtttttgtatttagccatattgatttacatatgaaaattacagctttttgttgaatggaaagggcattgacaagagagttaacatctcaatggtttgtggatttcattgtttcttggatatgttttggaagtacttactacgtactctgatgcaagtaattgtttattgtaatttcttttcaggagtctgggccgcagcttccaactaatgttactgccctgctaaaccttggggcaaatcttctacaagcaataggctgttttggaggtttctgttcaatgaagatatctttagttcctctcctcatattcagtaataatggacagatacccatttgctataggtagttacttgattgctattgctttcatggatgtcataccactgcccaacaaaccgttactgaaagattatgttcatcctgaagtcgttggatcaaactcaggtatatccaagagtgtttagtgactaagagaagaaactatgacttagaagtttattgcatttccacatatgaagtcattagatcatttagtcgtatgtattcatataatcgtattccgagaactccagatcaaacattatttgtcttttccaatttgtctgtagattgtgacataattgaggggccatcgaggatatctctcagttgtcctatcaggtatctaaggatgtttttcctatgttgctttatatctcaagaaattgctttcacagttacctcaaccttttaagatttaatcatcacaattataacagccgaacgcgtatcaaacttcctgtgaagggtcatgtctgtaaacatcttcaggtgatgcattttctgttaagcataagtaaggataggatgtttcttgttttcattacttaaatcattatgaaaagaactattccattaatacatgaatttctaggctctggttttcttcgctgttgccataatatgtcttctcaaagtatgatttttgtaagttaatacgatataaatgtgtgacatgcttgattatgaagattgctagtaaaagagataagttttggcaaatttagaatctattgaaatatttccctcatctctgttttatatgtttctttctgctgtagtgttttgatttctggaattatgtcaacatgaacacaagacgaccatcatggcgctgcccgcattgtaatcagtctgtttgctatactgatatccgtgtagatcaaaaactgagaaaggcaagtagcttatttttgttgcttagtgaatacatctttttaagtcttagattgaataaacaatcttggctaatatccacagattctagaagaagtgggacgtaatgctgcagatgtggttatctctgctgatggaacctggatggttgagacggaaaatgatgaggacgtggaacttgtgccagaaaccactcatgaccatggagacccaaatagtttcatcaacttggggcctactgttaagaatcctgccagagatgagaatgaaatggaaacatccacccaagtcgaagaacataatccttgtttatctgagattcagggtccgtcaaatgacacacataggcctgcttcagattatactatgcttaaccagtctcatacttcaaccaacacactaccacagctgccacgaactttgaatgcctttgatggtcaacaattcgtgaacttaccacaagtaataaacacccgagattcaccagcaagccaagccttacctatgacattctcaccaaccccatctccacaagatatattagctactaatgcggcaaactttggcacatcaatgccggctgctcagtcttctcagtttcaaggctcacatgttacgtcccttggaaattgtgaaggaagaacttctgatttgatggcgagatggaaccacatctatggacgtgttcaaactcaatttccacctgcacctctttcgcatcatcattattcaatgcaggtttgtcaaccattaccatagagttgttttttgttcgtatgcgtaaatatctggtgaagctacattaccattaccaactctgaagttttttcttatatgtttgcagaatcagagcccgtcccctgcacagcaaagaccagtgccatcttacattgcacatcctcaaacttttcatgtcaactacggagagaacgctgaccaaagatggatgccgtcttccattgcacatcctcaaactttacctgttaactacggaggaaatactaaccaaagaccgataccatcttccattgcacatcctcaaactttacctgtcaactacagggggaatactgaccatagatcgacgccatattccattacacatctccaaacattacttaactacggagggaacgccgatcaaagaccaatgccatcttccattacaaatctccaaactttacctgccacgtacggagggtacgcccaccaaagaccaatgtcatcttccattacacatccccgaacttcacctgtcaactacggagggacccctgaccaaagaccaatgccatcttccattacacatccccaaactttacctgtcagctacggagggaccacagaccaaatactgaatcctggtggtgcaatgggacagttctcatcacgagagttcatgaatttgactcctgctaacactgagaattggcgcccacaaagccggatgcgaggcagcgtagcacctggtacgggatatgaccatatgatcattcatcctacccgtccagttcatccacaagctcaaacacctcctgcgcctctttcaacatcttatgatggagcagatgaaattcaagcatttatagggcacccaagctatcccgttagtaataacgaaacacaagcgggtaccagttcgttgccagtggcagagggtcttgggtattcagggtcgttttggtcaatgcctcctgagacatggtgatatctgatggcttagagattgtagcacacggtcactaacacaatcagtcgc

SEQ ID NO: 4615 - DNA, 3941 bp, Artificial Sequence
  P13372 (35S::G2515)
cttcgcgtaatttctcatcaaactccacttttcttctttttaagagaatctagggtttcttctactacttcttctttcttctttaggtggtcaaatttccaagttcttcttttagctctctcttttgtttccaagaaacctgagaagaatttttgtagatatgggaagaggaagggttcagctacggcggatcgagaataagataaggagacaagtgacattttcaaagcgaaggaccggtttggtaaagaaagctcaagagatctcagtgttatgtgatgctgaagttgctttgattgttttctcccccaaaggcaaactctttgagtactctgctggttccaggtttgaatctttcctaagctaattaatttaccaacttattttaagatcgcatatttatctacataaatattagcctatatttcatgtttgacatattgggaaaagtggtatatataggtttcacatagaggagattgatttgaaattggctgagattgtttaattaattaaatcagtttatagccaattttgtttagttcttccatctctaacttagagaagatcataaaaaatgaatgattgtacaatactatatattaaatcaaaagaagtgattaatagagatgatcgcatcaaaaaataattgtgagacataacagttccacagattatatattatccaaaaaatatgatggaagaatgtgctaattgggcaaacatgattacgaaataatatacgtattaatataatttgattcttgaggacatatgtatatatgttgaacatatcatgaataaagagagatctttcatttcattgttgtgtaagtttgttcttcaacgttctggagataattaaaacatgatctacataagtttaaagagatatttaatacaaagtgtacaaaaaaactttagaattaacacctgcaggcttaggatcaaacaagtagatctaatgctcaaagttagcttactttggcactcataggagacttcattttatttatttcaaggaaaaatataataaattcaaggaaaacgaattttaaaaagggttcttgaatcaaaataattttaatgttcttcttttggaataaatctgctatttacattttacttaaaaataaaattgaatgttgactaaaataaaaataaaatgttgactataatacaaaataattttggtggttttaactaactgaacatattctggtaataacaaaacattatttatcagagaatttaatataaaagaaatgaactgtaaataatagcaatttaatttttgaaaaataaatccaattttaagatgacgatttttttttttttagtaattgtcaaaacagaacagtaaaatactaggagacataatttgtgatgacaccgtctaaattatctccaaggttcatgtaatatctaatgcggtatcattggatcaaaatgaacgacacaccaaaagaaaaacaattatctcaatatacacaaacatactaaagagggacaagaaatctactataaatagaagagtcagctttcgatcatgattgtagtaactaataatagtaaacatgaaactttgatttgattatgttaaaataaaaatttaagatatacagctaaaatcttgttggaaattggaagcatgacaagcctttgtatagagctttgtgcattgctttgtcttttggttggcggaacctaggactaacctcgatcgtcacatgaaaatatacaaacccatgaagctacttttctagcttgtaggcttaactagaatgttcaaaaatgaatttgcttgcaaacatattttaacaaaatttgagtagacttggtgtatcgattgctatagtctaatcaatacattcaattaatgtatcaaattgtttgcaaatgtagattaaagttctcgatatagagcttaaattaatttagaaatgtttcaactaaagtacaaaaatgattattcaatatcttcaatgtatttgttgagtgatgatagtatatacatcgagtgttgattgttgtttgatatactatttttttagcatggagagaattcttgatcgatatgagaggtctgcctacgccggtcaagatattcctacaccaaatttggattcacaggttcttaagcacatttaagacatatgagtatatatatatgaatcattgtttatggtatgtttatggtaaacttaactatcgtgtatcgatctttttatcatttgtagggagagtgctcaacagaatgttcaaagctcttgaggatgattgatgtcctgcaaagaagcctgaggtaaggacttattacttacgtatcatccaaacataaaatacatacctaagatatctaaatatgtacaagataagaaattgcatctttatcaaattataaggcacttaagaggagaagaggtggatggtctaagtatcagagaccttcaaggtgtggagatgcaacttgatactgccctcaagaaaactcgctctagaaaggttatttatatgtatacaaaaacattgtagtatattttctatacatgcatggatcatttgtatatacaaatgtgtatatctaataatgtgcagtttgtgtatgcataaatatacacagatatatagataaactacacctaatcatgtagtaattattgttttggtttgggagcacagaaccagctcatggtagagtccatagcacagcttcagaaaaaggtaatacactaattaagagactatcgttgttatggttgtgcctaggcctggacgtttgagtttacgggtccggttttagtttggttctattttttggtttttgagtttaggatccattcaagtaattgttttggatattgtttccacctaacttttggtatttcgagtatttttggttattcggtctaaaaataactaattattttaggtgtataaaatgtatttcgattcgctgaatatttcagtctggttcccgttctttcagttatgaagttataatccattcggatatttacgaattttggttcgtttttctattaagttcctctcggtttggttagagtttggttattttgcctaggactacttttgccatgcaaactcatgtatctgcctgtcttttttttcttttcgggtttgtacaaaacattatacttatagtagatcttcacaattagtagtctttgattttgagaaataaacacaaatacatatactagatcttgaatacttgactcgatatgagttaaactaataaatatgtgtcttttcttttgatggcataggagaaggaactaaaagaactgaagaaacagctaacaaagaaggtgaaagtgatgttagaatctttgactatatatataaccagtttcttataaaatgtagaattcacttaacttttaagagagattagtctaggcgctagtttgaactctctcaatcaagtgtcgattttaaatttatatttgaatgttaagcaatcggtgactggtaaatagtaactataacaagtattgaatttggcaggctggtgaaagggaagactttcaaacgcaaaacctcagccatgacttagcctccttggcaacaccgccatttgaatcaccccatgagcttcgccggacaatatctcctcctcctcctcctttatcttcggggtactttaaagtttgatttcacatagctacaaagatagtaaaaatataaatgataatttgttagtgttgatcaatgatagtaaggtaacatattatagtttgtatcaatatttatttatcgtgtatatgagatgaattaataaactgcttatagggatacatcacaaagggatggagttggagaagtagctgccggaaccctaattcgaaggacgaatgcaacgttgcctcattggatgccccagctcaccggagaatagaggtccgaaacaatcttgg

SEQ ID NO: 4616 - DNA, 1482 bp, Artificial Sequence
  P13386 (35S::G1554)
ggcaccacaaattcttcttgattccttgatcatctatattatatttatataatcaataaatattcttcctatacagcgagagagagagagtatataagctataaatatggcgtcctcatcagaactaagcttggattgcaagccacaaagctactctatgcttttgaaatcctttggagataactttcagagcgatccaaccacacataagcttgaagatcttctctctcgcctagaacaagaacgtctcaagatcgatgccttcaaacgcgagcttcccctttgcatgcaactccttaacaatgctgtggaagtttacaaacaacaactagaagcatatagagcaaatagtaataacaataaccaaagtgttggtacaagaccagttctcgaagagttcatacccttaaggaaccaacccgaaaagacaaacaacaaaggaagtaattggatgacgactgctcagctatggagccaatccgaaaccaaaccaaaaaacattgattcaactactgatcaatctcttcccaaagacgagattaatagtagtccgaaactcggacattttgatgcaaaacaaagaaatggcagcggtgcttttcttcccttctctaaggaacaatctttgcctgaattagctctatccacggaggtcaagagggtctctccgaccaacgaacatactaatggccaagacggtaatgatgagagcatgatcaacaatgataataactataataataataataataacaattcgaacagcaatggagtttcttctacaacgagtcaaagtaatagaaaggcacgacgttgctggtcgccggacttgcaccggagatttgtccaagctcttcaaatgcttggtggctcgcaagtggctacacctaaacaaataagggaactcatgaaagttgatggtttgaccaatgatgaagtcaaaagccatctccagaagtatcggcttcacactagaagaccaagcccaagcccacaaacgtcaggtgggccaggtccacatttggtggtcctaggtggcatatgggttccaccggagtacacctccgcacatggtggcactccgactctctaccaccaccaagtccaccaccaccataccaacacggcagggccgcctccaccacacttttgctcctctcaagaattctacacaactccaccgcctcctcagccgctccaccaccaccactttcaaacgtttaacggttcatccggtggcaccgcctctaccgattctactcatcatcaggtgacggacagtcccacagttgaagggaagtcaccggagagtggtggtggagagagaaaagggttggctgctcttagggaagaatgtgaagatcacagcaatattaatggaagtgaaataactctcaaattctaaaaaaaataaagattcttgattaattaattagagtaatgagattttagggttagggtttgtgggtgcctacgtaactt

SEQ ID NO: 4617 - DNA, 2859 bp, Artificial Sequence
  P13387 (35S::G611)
tcgaccttctctcctccaacatttcagatttcgcgacccggatcttaacccggacccgcatttgtttcggttccgatctggtttcttgacaatggcgtcagaagcttcgccttcttcttcggccaccagatcggagccacccaaagactctccggcggaggagagaggtccagcttctaaggaagtatcagaagtaatagaatcgctaaagaagaagcttgcagctgataggtgtatatcaataaagaaaaggattgatgaaaacaagaagaatttgtttgctattactcaaagttttatgaggtcttctatggaacgaggaggtagctgtaaagatggcagtgatcttttagttaagaggcaaagagattcgccaggtatgaaaagcggaatcgatgaaagtaataacaacagatatgtagaagatggacctgccagttcaggaatggttcaaggatctagtgtccctgtcaaaatttccttacgtcctatcaaaatgcctgatatcaaacgtttgtcaccttataccacatgggtttttctggacagaaatcaaagaatgactgaagaccagtctgtagtgggtcgaaggagaatttattatgatcaaactggcggggaagcgcttatctgcagtgatagtgaagaggaggccattgacgacgaagaagaaaaaagagattttttggagcctgaagattatattattcgcatgacccttgagcaactaggtctttcagactcagtcctggcggaactagcaagtttcttgtctagaagtactagtgaaatcaaggcaagacatggagtgcttatgaaggaaaaagaagtatccgagagtggcgataatcaagcagagagctcccttctcaacaaagatatggaaggagcattagattctttcgataacctgttctgccgtagatgccttgtatttgattgccggcttcatgggtgttcacaggatctcatttttccggctgagaaaccagctccatggtgtcctcctgtagatgaaaatttaacctgtggtgcaaactgctataaaacgcttctcaagtctggaagatttccgggatatggcaccattgaaggtaaaactggcacttcatcagatggtgcaggtactaaaaccacacccacgaagttctccagcaaacttaatgtgagaaaaccaaagaccttcccaagtgaaagtgcatcgtctaatgaaaagtgcgcactagaaacaagtgactcagagaatggactacagcaggataccaattccgataaagtttcatcatcgccaaaggtgaaaggtagtgggagacgagtaggtcgtaagaggaacaaaaaccgagttgctgagcgagttcctcgtaagactcagaagaggcagaagaagacagaagcctcggatagtgattccatcgccagtggaagttgttcacccagcgatgcaaaacataaagataatgaagatgctacttcctcttctcagaagcatgtaaaatctgggaactccgggaagtcaaggaagaatggcactcctgccgaagtctccaataattctgtaaaggatgacgttcctgtttgccagtcaaatgaggttgcgtcagagcttgatgcgccgggtagtgatgaaagtctaaggaaagaagagtttatgggtgaaactgtatctcgaggaagattggctacaaataagttgtggagaccacttgagaaaagcctttttgataaaggtgttgagatttttggaatgaatagctgcttgattgctagaaatcttttgagtggtttcaaatcatgttgggaggtcttccaatacatgacgtgctcggaaaataaagcttccttctttggaggtgatggattgaatcctgatggctcttccaagttcgatatcaatggaaatatggttaataaccaagtgaggagaaggtcaagatttctacgtaggagaggcaaagtgcggcgcttgaagtatacctggaagtctgctgcatatcattcaattaggaaaagaattactgagaagaaagaccagccctgccgtcagtttaatccatgtaactgcaaaattgcttgtgggaaggaatgtccttgtttgctaaacgggacttgctgcgagaagtactgcggttgcccaaagagctgcaagaataggtttagaggttgtcattgtgccaaaagtcagtgtcgaagccgccagtgtccatgctttgctgcagatcgggaatgtgacccagatgtttgtagaaactgctgggtcattggtggggatggttcgcttggggtcccaagccaaagaggcgataattatgagtgcaggaatatgaaattgctcctgaaacaacaacaaagggttttacttggaatatctgatgtttctggttggggagctttcttaaagaacagtgtaagtaagcatgaataccttggggaatacacaggagagctgatctcacataaagaggcagataaacgcgggaagatatacgatcgcgagaactgctcttttctcttcaatctaaacgatcagtttgtgctagatgcttacaggaaaggagataaactgaaattcgccaaccattctcctgaacctaactgttacgcaaaggtcatcatggttgctggagatcacagggtggggatcttcgcaaaagagaggatactggctggagaagaactattttacgattaccggtatgagccagatcgagctccagcttgggccaaaaaacctgaagctcctggttctaagaaagacgaaaatgttacaccttctgttggtagacccaagaagcttgcttagcaacaaaagaaacaaccatttttttgtcaattctttggttacaggtggaagaacgctgc

SEQ ID NO: 4618 - DNA, 771 bp, Artificial Sequence
  P13388 (35S::G2319)
tcgactctctctctgcattctctcttacacctgtctttatctgaaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtaataatttatctctgtttctctgtttttagagacttcaaatttcttagtttgctgctgatttctgagtttagttagttatagactgaacaaacagaggaaagtttatgttacttagcttaggtctagtagtaacttagctataaaaaatctgcttagctaaaaagatctgcttcttggagcacttcaactgtaataaatttatagttgtgttgactttttgaaagtgttattgatgtaactaggacctgattctgctgatactactactcctctatgttccttaggtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcgc

SEQ ID NO: 4619 - DNA, 1066 bp, Artificial Sequence
  P13392 (35S::G2913)
ctctactaaaagtctctctatagcgatgtcatcggacaacgaatcgacaccgtctcaagcgacggtagaaatgatggcgacttcgccggcgaagattaaagagtatccagaaccattggctttacatgaagttgtcgtcaaggattcttctgtcttctgggatactctcaggcggtttcactcaattatgtccactaagttcatgattcctgtgattggaggaaaagaactagatttgcatgttttgtatgtggaagtcacgaggaggggaggttacgaaaaggtagtcgtagagaaaaaatggagggaagttggaggagtgtttagattctctgcgacaacaacaagtgcttcgtttgtcttaaggaaacattatctcaatcttctcttccattacgaacaagttcatctcttcactgctcgtggtcctcttcttcatcccatagctacatttcatgcaaatccctcaacgagcaaagaaatggcgctcgtcgaatatactcctccgagtataagatatcataatactcatcctccttctcaaggttcgtcgagtttcacagccataggtacaatagaaggcaaattcgattgtggttatctggtaaaagttaagttgggctcagagattcttaacggcgttctttatcattcggcccagcccggcccatcatcatctccaaccgctgttctaaacaatgccgttgtaccttatgttgaaactgggaggagacggcgtcgtttaggtaaaagacgaagaagcagacgcagagaagatccgaattacccgaaaccgaaccggagcggttacaatttcttctttgctgagaaacattgcaagctcaaatcactttatcccaacaaggagagagagtttacgaaacttatcggagaatcgtggagcaatctctctaccgaagaacgaatggtttatcaagacattggattgaaggataaggaaaggtatcagagggagttgaatgagtacagagaaacgttgagacttagggatggtgacatgacaaacggcaaggctttttaggtgatttagttaaaacggcaagtc

SEQ ID NO: 4620 - DNA, 1861 bp, Artificial Sequence
  P13394 (35S::G1585)
ctatcaaccctaagtaatctctttagctctcgattatcatcattacaccatcatcatgtcctcctcaaacaaaaattggccaagcatgttcaaatccaaaccttgcaacaataatcatcatcatcaacatgaaatcgatactccatcttacatgcactactctaattgcaacctatcatcttccttttcctcaggtactcacaaaatttacattttcttctgttaaatttataaaaagtatattgttaattttacttgattatagaaacaagctatatgaacgatgttatgtatatatgttaagacatgcatgcatgatgatataaaccgctctatgaaacagatcggataccagatcctaaaccgagatggaatcctaaaccggagcagattaggatactcgaatcaatcttcaattccggtactattaacccacctagagaggagattcaaagaatccggatccggcttcaagaatatggtcaaatcggtgacgcaaacgtgttttactggtttcaaaaccggaaatctcgagcaaaacacaagcttcgtgttcatcacaaaagccctaaaatgtcaaagaaggacaagacggttattcctagtactgacgctgatcattgttttggttttgttaaccaagaaaccggattatatccggttcaaaacaatgagttggtggtaaccgaaccggccggttttctatttccggttcataatgatccgagcgctgctcaatcagcgtttggttttggcgattttgttgtaccggtggtaacggaagaagggatggcattctctaccgttaataacggcgttaatttggagactaacgaaaattttgataaaattccggcgatcaatttatacggcggagatggaaatggcggtggaaattgttttcctcctttgactgttccattaaccatcaatcaatctcaaggtaaattaatcatttcgaaatagtaatactgttcatatttttttcttttcgaaatagttttattacctcatttgctcaacatacatgaaaataaatattataattaatgcttaatttggtatatttcgtagatgtataattagtatactaaatttagtatatagcatatatatatcgaatctaatatcatatagttcttaccatatgcatgctggtgttatccaatgtcacatatacatagatatgtacgtacactcatttctcatatttcatatattagtgtgtatatatatatatatatatatgtatatgtatcttggtcataaaaaaaaaaaaggaatcttggtcatatatatatgaattataatacttagataggtcatagattatggtaaataaattattaaattattccatattttggaatgagtaacgcatgcatacgatattttgggaaaaagacgttttggtctttagatttgaccatttactgtgtatttttttgggtaaattagtattatttaattactttgactaacattaattaccaaaatgtgctctattgatcacaagaaaaacgagatgtaggattatccggtggtgaagacgtcggagataatgtttatccggtgagaatgacggtgtttattaacgagatgcctatcgaagtagtgtctggattattcaacgttaaggcagctttcggaaacgatgccgttttgatcaactcgtttggccagcctattcttacagatgaatttggtgttacttatcaacctctccaaaatggcgcaatctattatcttgtgagttttgtgtaatggtcttaaggtttttgtttttcttgtatgaattgctgaaagcttttgtgtttggttttgcagatttagaagatattgaaaagcaaatgttatggtg

SEQ ID NO: 4621 - DNA, 995 bp, Artificial Sequence
  P13422 (35S::G730)
attcaccaattctctcttcttatggagcttttcccttcacaacctgacttgtacttgaagatcagccgaagaagagaagaagaacaagaaaaagaaagtcaagaactacaagaacaagaagtcgaaaggagattagggtttcagagtaaagcctcagatttagacaacaagtcttcaaataatctcatccacactctccagttcacttcaaacaatgaagccaccaagattaatagtaatcaagaacacaaggaatctctcgatcaagacttgagatctatttttatgatgagaccaataagaggaatccctctttaccagaatcaagtccttgaccactactactactcatctacctctcccaatcctttcttcttcagtgaagtcaacggtcaacatgctagtcgtcgcttaatcacaaaccctaattgtagttttaatctccacaaccgtcatcggcgtcaagctcaaccgcagccgccaagattcaccgccaaaagaggagtaagggctccaaggatgcggtggacgacgaccctccacgcccattttgtacacgctgttcaattattgggtggtcatgaaagagcaaccccaaaatcagtacttgagctgatggatgtgcaagatctcacattggctcatgttaaatcccatctacagatgtatcgaaccatcaagtctactgaaaaacctacaacgtcatcagggcagtcagattgtgagaatggatcacaagtaaacagtgagagagaagcaagaaatctcacgggtctatggaataactcctcaagtgaagctcggttccagttgaaggcaaaggcatcatcaggtgtagacatttcatccaatgagaatgaatggaagaatcgaagatgtccaagcaacgaacggttgtcgtcagattcgtcaagccttacagggacaagaccagagactgaaactcccaatcttgatttcactttagctacaccaaacctctctccctaattttc

SEQ ID NO: 4622 - DNA, 1472 bp, Artificial Sequence
  P13423 (35S::G3076)
gcattgtgtatatatcgatagacgtaggtataaatattgttccaaaatgctaattttctttatagaatataaccactaatgagcaaaatgagaaacctagtagaagaaaagttcctagagttctatgagagttgggttattcaacttgagctatatcttcatcaacttttaattgctcataacaataacactatgagtgagaccgagcttcgacatttgatctcgaagctaactacacatcacaaagcttattatacagccaaatgggcagccataagagaagatgtcttagcttttttcggatcagtttggttaaacccgttagagaatgcttgctcttggttaaccggatggaaaccgtcgatggtgtttcggatggttgataggctgaggaagtcgagagtggtgcttgtggaggctcaggtgaagaaattggaggagctgagagttaagaccaagttcgatgagcaaaaaattgagagagagatggagcggtatcaggtgggtccaacatttagattcattagaattttaaaactatttttcaaacattgatttatttataaacggaatttttttaactgaataatggattgctattttcagtgattgctctattttctttgaaaattatgtttttttaaaaaaatctttaaagttatagcaattttgatgaattttctattgaatccttaacatttaaaccgaaaagcaaattatattgaaaatagtgtcaaatcaaaaatattctatatatttttttttgtttattcaaacaagggataccgaattttaatatatatatatatatacacaaaatatttttttgttagacctaattattactcatctgtgtggtgctagttggatacaattttaaattttatttgatataaaagacaacatatatgatcttgatattttacggaatggtggaatgattcaatatgtttttgtctattacattttcttcgaatcacgtttttattcatctatttttagttttttactgtttgcataatttgtgaaagaaaaaaaagtcgccatttccgtaaattttggacttaaatcaaatattttccgtttacctttatcagtaattactatacctatactgaaatgtaggaatacaaattttgtaaatcattttattttagttatttaacttgaaactgtctttaggtggctatggctgatcggaaaatggtagagctggcgaggcttggatgtcacgtcggaggagaatcggtgatggtggtggaggcagcggtgagaggattatcgatgggtcttgagaaaatggtgaaggctgcggattgtgtgcggctgaaaacgcttaaaggtatattagacattttaactccaccgcaatgcgttgagtttttggcagcggcggctacgtttcaggttcagttacgtcggtggggaaaccgaagacattatgtcactcactcctgacacaaacttaagag

SEQ ID NO: 4623 - DNA, 1459 bp, Artificial Sequence
  P13429 (35S::G2694)
ccctgttcctcttataacccctctcgtctcatgtctacctcctcctcttcttccgacaacggagccggtggaagcggcggcgttttcgaggccccatctccatcccgccctcgccgcggagccaacgatgtttggccggagccttttcttgaatctctcgccgttcaagttgccgttaacgcttccacatccgccggcctcctcgccgcagctccggctcttgccaacgtttttcgggtttgcaccacgtggcacgctgtctctcgctccgaccatctatggcaactactatctcgccaagtttgggcaagaacacatttgatgcacgacacgtggcgggacgagttcatctaccgtcatcggacggctagaaacttccggacgcgtactcacacctacttcactctccaatttgacccgtctgatgtggacgagcctgatagtctctcttgccgttgtctcaccctctcagacctctacttagccgcagggttcgccgacggaaccgtccggctttttcttttaaacaaccgactccacgtcaggaccttacggccacctctacgtgaccgctttggtagattctcacgagccgtctcaggcattgttatctccgactcaaggctcacgttcgctacgatggacggagacatccacgtggcggaaatagacggtgttggtcacacacgcacggcttacgcaggagatatagttaacgacggtgcgttggtagatttcactggctgtggacgttggtgggtcggtcttttcgcgggtgtgccaggtcgtgcctttcacatatgggactgtaacagcgaagagacaacattcgtcggtggtacactcaccgaccctgaagctgtcatgggatggcacacgttaacagagctaacaacgtcccttggccgtctcagaatctccggtaacgagacggcggtagcatgcacgagatggagaatcatggtgatcgatctaagaaaccaaggagtgatcatcggagaagacgaagagcaacgtagaggactaatagtgacaggcttcgatgccaacgacgaagcgtacgttagattggacagtagaggaaacgctagcgtgcgaagggtgaacacgcaacaaacggtgtgtgagttccgtgttagtggagcggcgcagagaagagtaatgggttgtgttaatagactgcacgcgctaatgtgcgcaggtggtataatgcgcgtgtgggaggtagagagaggagagtatctgtacagtattagggagagagtaggagaagttgacgccattgttgccgatgatagacatgtggcggttgcgtcagcttcatcaacggctcagagtattatacatctatgggatttcggtgcactgtagcgtaccagattaataatttttttttttttaacttgaagaaaaagaaactatttttctctgaaaaagcgaaaccctaaacctaggtgta

SEQ ID NO: 4624 - DNA, 1440 bp, Artificial Sequence
  P13433 (35S::G2850)
gcatcatcaactctcatacatatatggactctgctaatctccatcagcttcaagatcaattacagcttgtggggtcttcttcatcttcttcttccttagacaataactctgacccttcttgctatggagcttcatctgcccatcaatggagcccaggaggtatttctttgaatagtgtgagcttgagtcataattataacaatgagatgttaaacacaagagctcacaacaacaacaacaacaacaacacaagtgaatgtatgagtctctccagcatccacaatcactccttgatccaacaacaagactttcctttacaatggcctcatgaccaatcttcatatcaacatcatgaaggacttctcaagatcaaagaagagctttcctcatcaactatctcagaccatcaagaaggcatatccaagttcacagacatgttaaatagtccagtgataacaaactatttgaagatcaatgaacataaggactacactgagaagcttcttctcaagagtatgtcttctggattcccgatcaatggagactatggtagcagccttccctcttcttcttcttcctcttcaccttcgtctcagtcgcatagaggcaacttcagtcagatttacccaagcgtaaacatatcgagtttgagcgaatctcggaagatgagcatggacgacatgagtaacatctcaagaccatttgatataaacatgcaggtttttgatggaagattgtttgaaggaaatgtattagttcctccttttaacgctcaagagattagtagtcttgggatgagcagaggaagccttccttcttttggcctcccttttcatcatcatctgcagcaaacacttccccacctttcttcttcccctactcatcaaatggaaatgttcagcaatgaacctcaaacaagtgaagggaagaggcataacttcttgatggcaacaaaagcaggagaaaatgcttccaagaaaccgcgcgtggaatcacgctcctcttgcccacccttcaaggtgaggaaagaaaagttaggagacagaatagcagctctgcagcagttggtttcaccctttgggaagacagatacagcatctgtgttaatggaagcaattggatacatcaaattcctacagagccagatcgagactttaagcgtcccctacatgagagcatctaggaaccgacccggaaaagcctcccagctggtctcacaatcacaagaaggggatgaggaagagacgagagatcttagaagccgtgggctatgtctagtgccgttatcatgcatgacttatgttaccggagatggtggggatggaggaggcggtgttggtactggtttttggccaacgccacctggttttggtggcggaacttagccgtggacttaacaaaccgtaggactatgatgagtacatttatcggacttggagg

SEQ ID NO: 4625 - DNA, 1679 bp, Artificial Sequence
  P13435 (35S::G2)
tctctctctctctttagctctttttttttttttgttttcattaaagtttttattttattttctaccaaccaaaagcttttctctttggtttctcttatttagcttctaaccttgaggagaatataccagaggattgaagtttgaaccttcaaagatcaaaatcaagaaaccaaaaaaaaacaaaaaaaatgtgggatctaaacgacgcaccacaccaaacacaaagagaagaagaatctgaagagttttgttattcttcaccaagtaaacgggttggatctttctctaattcaagctcttcagctgttgttatcgaagatggatccgatgacgatgaacttaaccgggtcagacccaataacccacttgtcacccatcagttcttccctgagatggattctaacggcggtggtgttgcttctggctttcctcgggctcactggtttggtgttaagttttgtcagtcggatctagccaccggatcgtccgcgggtaaagctaccaacgttgccgctgccgtagtggagccggcacagccgttgaaaaagagtcggcgtggaccaagatcaagaagttctcagtatagaggtgttacgttttaccggcgtaccggaagatgggaatctcatatttgggactgtgggaaacaagtttacttaggtggatttgacactgctcatgcagcagctcgagcatatgatagagctgctattaaattccgtggagtagaagcggatatcaatttcaacatcgacgattatgatgatgacttgaaacagatgactaatttaaccaaggaagagttcgtacacgtacttcgccgacaaagcacaggcttccctcgaggaagttcgaagtatagaggtgtcactttgcataagtgtggtcgttgggaagctcgtatgggtcaattcttaggcaaaaagtatgtttatttgggtttgttcgacaccgaggtcgaagctgctagagcttacgataaagctgcaatcaaatgtaacggcaaagacgccgtgaccaactttgatccgagtatttacgatgaggaactcaatgccgagtcatcagggaatcctactactccacaagatcacaacctcgatctgagcttgggaaattcggctaattcgaagcataaaagtcaagatatgcggctcaggatgaaccaacaacaacaagattctctccactctaatgaagttcttggattaggtcaaaccggaatgcttaaccatactcccaattcaaaccaccaatttccgggcagcagcaacattggtagcggaggcggattctcactgtttccggcggctgagaaccaccggtttgatggtcgggcctcgacgaaccaagtgttgacaaatgctgcagcatcatcaggattctctcctcatcatcacaatcagatttttaattctacttctactcctcatcaaaattggctgcagacaaatggcttccaacctcctctcatgagaccttcttgaatcttttatatttttaaggtttattattatataagaaaaacaaaaatgaacctttgaaatccccacatgttcttggtcatttcattaatcatcggcttatattttgcttattttcccctaaatcctcttgttaacttaggcgaacaaaaaaaattaatggaaatctttttccctccatcggttacaaaaata

SEQ ID NO: 4626 - DNA, 1058 bp, Artificial Sequence; identical to SEQ ID NO: 115
  P13436 (35S::G155)

SEQ ID NO: 4627 - DNA, 1659 bp, Artificial Sequence
  P13437 (35S::G309)
accggtccggtaattcccgggatatcgtcgacccacgcgtccgccacgcgtccgtgcaaatcaattttaatgaagagagagcacaaccaccgtgaatcatccgccggagaaggtgggagttcatcaatgacgacggtgattaaagaagaagctgccggagttgacgagcttttggttgttttaggttacaaagttcgatcatccgacatggctgacgtggcacacaagcttgaacagttagagatggttcttggtgatggaatctcgaatctttctgatgaaactgttcattacaatccttctgatctctctggttgggtcgaaagcatgctctcggatcttgacccgacccggattcaagaaaagcctgactcagagtacgatcttagagctattcctggctctgcagtgtatccacgtgacgagcacgtgactcgtcggagcaagaggacgagaattgaatcggagttatcctctacgcgctctgtggtggttttggattctcaagaaactggagtgcgtttagtccacgcgctattagcttgtgctgaagctgttcaacagaacaatttgaagttagccgacgcgctcgtgaagcacgtggggttactcgcgtcctctcaagctggtgctatgaggaaagtcgcgacttacttcgctgaagggcttgcgagaaggatttaccgtatttaccctcgagacgatgtcgcgttgtcttcgttttcggacactcttcagattcatttctatgagtcttgtccgtatctcaagtttgcgcattttacggcgaatcaagcgatacttgaggtttttgctacggcggagaaggttcatgttattgatttaggacttaaccatggtttacaatggccggctttgattcaagctcttgctttacgtcctaatggtccaccggattttcggttaaccgggatcggttattcgttaaccgatattcaagaagttggttggaaacttggtcagcttgcgagtactattggtgtcaatttcgaattcaagagcattgctttaaacaatttgtctgatcttaaaccggaaatgctagacattagacccggtttagaatcagtggcggttaactcggtcttcgagcttcatcgcctcttagctcatcccggttccatcgataagtttttatcgacaatcaaatcaatccgaccggatataatgactgtggtcgagcaagaagcaaaccataacggtaccgtatttctcgatcggttcacggaatcgctacattactattcgagcttattcgactcgctcgagggcccgccaagccaagaccgagtgatgtcggagttattcctaggacggcagatactaaaccttgtggcatgcgaaggagaagaccgggtagagaggcatgagactttaaatcagtggagaaaccggttcggtttaggaggatttaaaccggttagtatcggttcgaacgcgtataagcaagcaagcatgttgttggcactttatgccggggctgatgggtataatgtggaagagaatgaaggttgtttgttgcttggatggcaaacgcgaccgcttattgcaacatctgcgtggcgaatcaatcgtgtggaataaaaataaataatgggaaaagtgaaaatgtgctatatactttattgcattgctgat

SEQ ID NO: 4628 - DNA, 1531 bp, Artificial Sequence
  P13443 (35S::G2071)
ttctctctctcgcagctcttctctattttcagcaatcgcctataatattaggtaaagctaaaagggtctgattcgtttgttttttcactgaagaatttggaaggaagtgattccgttgtgaaacagaaaagaagtatgggtactcacattgatatcaacaacttaggcggcgatacttctagagggaatgagtcaaagccattggcgaggcagtcttcgttatattccttaacgtttgatgagcttcagagcacattaggtgagccggggaaagattttgggtctatgaatatggatgagttactcaagaacatatggactgctgaggatactcaagcctttatgactactacatcttcggttgcagccccgggacctagtggttttgttccgggaggaaatggtttacagaggcaaggctccttgaccttgcctagaacgcttagtcagaagactgtcgatgaagtctggaaatacctgaattcgaaagaaggtagtaatgggaatactggaacggatgcgcttgagaggcaacagactttaggggaaatgactctggaagatttcttactccgtgctggcgttgttaaagaagataatactcagcagaacgaaaacagtagtagcgggttttatgctaacaacggtgctgctggtttggagtttggatttggtcagccgaatcaaaacagcatatcgttcaacgggaacaatagttctatgatcatgaatcaagcacctggtttaggcctcaaagttggtggaaccatgcagcagcagcagcagccacatcagcagcagttgcagcagccacatcagagactgcctccaactatctttccaaaacaagcgaatgtaacatttgcggcgcctgtaaatatggtcaacaggggtttatttgagactagcgcagatggtccagccaacagtaatatgggaggagcagggggtactgttacagctacttctcctgggacgagcagtgcagaaaacaatacttggtcatcaccagttccttacgtgtttggtcggggaagaagaagcaatacgggcctggagaaggttgttgagagaaggcaaaagagaatgatcaagaatcgggaatccgctgctagatcaagggctcgaaaacaggcttataccttggaattggaagctgagattgaaagtctcaagctagtgaatcaagatttgcagaagaaacaggctgaaataatgaaaacccataatagtgagctaaaggaattttcgaagcagcctccattgctggccaaaagacaatgcttgagaagaacccttaccggtccgtggtaagaaggtgaagtcaaagcaagaagaacctgctaatgtaatacaggaccactcaaaaggaagacactgggagagtaatatgtaatagaagatagtgctactgtacaggagaaattacagagacgcttacaatgtagaaatcttttgagctgaatttaactaagagtgcagtctgtgtagagtatgagagctttcaatatgaattcataattttcataaa

SEQ ID NO: 4629 - DNA, 1104 bp, Artificial Sequence
  misc_feature (1052)..(1052): n is a, c, g, or t
  P13446 (35S::G2319)
aaaaataaccgatgagctcgtcgccgtcaagaaatccaacgaacgccgaagcacctccgccaccaccaacatcgacggatgctgtggcagagggttcgtctaagaaagtgaggaaaccatataccatcaccaagtcaagagagagctggacagaggaagagcacgataagtttcttgaagcacttcaactgtttgatcgtgactggaagaagattgaagattttgttggttcaaagactgtgattcagataaggagtcatgctcaaaaatactttctcaaggttcagaaaaacgggacattagctcatgtgccacctcctcgacctaagcgcaaagcagctcatccgtatcctcaaaaggcatcaaagaacgctcaaatgccacttcaagtttccacgtcttttactactacgcgaaatggcgacatgccgggatatgcttcatgggatgatgcctcaatgctgctaaacagagttatttcaccacaacatgaacttgctactcttcgtggagcagaagctgatattggatcaaagggcttattaaatgttagtagcccttctacatctggcatgggaagctcaagccgaacagtatcaggttctgagattgtaagaaaggctaaacagcctccagtgcttcacggtgttcctgattttgctgaagtttataatttcattgggagtgtctttgatcctgaaacgagaggccatgtggaaaagctcaaggaaatggatcctataaatttcgaaactgttctgttattgatgagaaacctcacatttaacttatcaaaccctgatttagaatccacttcggattgtaatgatgctgcagaggaaagtcctcttatcatatgacaacgtgacgaccgagctcccaagcgttgtttcccttgtcaagaactcaacaagcgacaaatcagcataacaaaaatatgagccatcagctagcaagtttactcattgggttcccatggttaataaactttgggggtatacgtcactggaatcacaatcgtgtcactgcatcatcatgtggggaattgtgtnaaaagtctttgttggtttgaggagaaacattagccaagtttgaaactttagg

SEQ ID NO: 4630 - DNA, 2343 bp, Artificial Sequence
  P13690 (35S::G1798)
atatcgcaggaacaatggtgagagggaagatcgagatcaagaagattgagaacgtgacgagcagacaagtcacgttctcgaagcgaagaagcggtctatttaagaaggctcatgagctttcggttctatgcgatgctcaagtagccgccattgtcttttctcagagcggaagattacacgaatactctagctcccagtaagatattctttcatcaaattatttcaaaatatttacacatgtctatttccaaaatctttctctagctacacatagatttgttgagtatctagaacttctgtagtgaatagtataatatatctctggttaaatcgtactagagattttgcaataatataggcgctaaagatttggccccctttcttttggtgctagctagttcctgactttgcccaacaatgccttgtcacattctaattttagaatttaagttttgtaagtacttagcttctggattttatttaagcaaacttaagaatttttactacttaagagagtttcttcaagcacgagcaagtggattgtattagggttttcagaaaaaaagtttcttgaacagtgaacctcgtattccttggaacttaaactgttacccacacacccacttggcatctggttttattagaatatccagcataaatgaatatccgaaaatgtagttacattaagtacagaaattgtaaatataatgcatgatgagaagatttaaaaaatatctcgggcatccaaactttttcactagatttacaatcatgaggtcggtacattgttcattttataaatcccttttgttttgtggttaatagaattggtttaaagattagtactatacaatctttacagagtataatttattttgtataacttccctttgtttcatttttcatttcatgtttaacaatctttgtgcagcaaaaaccttccttcactaggtttggtgattgcaaaaattaaaagtattcgattgtatgagtgttatctaaattatagacatctacattaatcaaaatattggtggacaaatctatcatagaagctaagtcggtataaaagataacatgtagatatatatatattaagaatattcgtccataatatttcaatcttatgatccgtcatcatcattcatcactgacaaatatcttcttgtgaattaacttttcaggatggagaagattatagatagatatggcaagtttagtaatgccttctatgtggcagagaggcctcaagtagaacgatacttgcaggttcattctctatattcatatatattctttatgttagtttcttcatttatttaaaaaaaaaatgtacagtatgtattaattcagatggtaatcgactatttttggggttgtattattgtgtaggagctgaagatggaaattgatagaatggtgaaaaagattgatctccttgaagttcatcaccggttcgcatcttactattcttacggttaattactctgtgcattgtatatttgtatataactaaactttgtttcagtcctaaaatatactgaaatttattatctcttgattcttgaatgccactatatatgaagtaagctgttggggcaaggtttggattcgtgttcagtgacagaacttcaagagattgacactcaaattgagaaaagccttcgtattgtcaggtcaagaaaggtacaaacactcggacacaaatatatatataacatatacacacatgttaatgatgtaattatgtcttcgttggttgatcttggtgcgtaggctgagttatatgcagatcaactgaaaaagctaaaagaaaaggtaaatttttttaaatgagtaacttatatacaagttttaatttgtgggatcggttgtattttctccatgtgattttatttttaatcgatctttcttgctcggattctaggagagggagctcttgaacgagagaaaaaggctgcttgaagaggtaaatatgcaccactcatcaaaggttacatataaaaatacacatgaaatttagttatgtctcttcgtttaggtagaggcttagattcatcgcacttaaaacttctttcttataagaataatcatagttcatagaggccttgattgtttgtttgtgtttgcatttacgttttacatgacattttcagcaaaatagagaaaggttgatgcgaccggtggtgccagcaactttacaaatatgtgataagggtaatactgaaggtggtcacagaaccaaacattcatcagaggttgaaaccgacctatttatcggattgcccgtgactcggctataacatattactttggttccatgtttgtacactataatgcttc

SEQ ID NO: 4631 - DNA, 1722 bp, Artificial Sequence
  P13693 (35S::G2035)
gatagagctagagagtactgggtctgtgtaaagttgataactttttttggtttagagagagaaaggacagagctttacagagatggagatgaagcagatgaagtttcttactcaccaagctttcttttcctctgttcgatcaggagatcttagtcaacttcaacagttagttgacaatttaaccggagatgagctaatcgatgagtcatcgccgtgttctgctgtggctgagcttatgtctgtgcaaaacgacgccggagagaccgccgtctatatctccgccgcagagaatcttgaagacatttttcgttacttgattaggttttctagtttggaaacagttaagatcagatccaaatccgacatgaacgcttttcatgtcgctgccaagcgaggtcacttgggaattgtgaaggagttactgagactatggccagagctttgcagaatctgcgacgcttccaacacgagtccgctttacgcagctgcggttcaagatcacttagaaatagtaaatgcaatgcttgatgttgatcctagctgtgcaatgattgtgagaaagaacgggaaaacatctttgcacactgcgggaaggtacgggcttcttcggatagtgaaagctctcatagagaaagacgcagcgattgttggtgttaaagataagaaaggtcagactgctcttcacatggctgttaaaggacgaagtttggaagtagtcgaagagattttgcaggctgattacacaatattgaatgagagagatcgaaaagggaacactgctttgcatattgctactcgaaaggcgcggccacagataacgagcttattgctgacctttacggcgattgaagtgaatgcgattaacaaccagaaagaaactgctatggatttggcggataagctgcaatatagcgaatctgctttggagatcaatgaggctttggtagaagctggggctaagcatgggaggttcattggtcgagaagatgaggcgagagcattgaagcgagcagtgagtgatatcaaacacgaggtgcaatcgcagcttttgcagaatgagaaaaccaaccgtcgtgtctctgggatcgcgaaagagctgaggaaactccacagagaagcggttcagaacacgactaactccataacggtagtggcggttctgtttgcttccatagcgttcttggccatattcaacttgccgggtcagtatttcacggaggggtcgcatgtgggacaagccaatattgcagggagaaccggattccgcgtgttctgtcttttaaacgcgacatctctgtttatatcgttagcggttgtggtagttcaaataactttggtggcgtgggacacacgggcgcagaagaaagttgtgtctgtagtgaataagctaatgtgggcagcttgtgcttgcacattcggagcatttttggcgattgcatttgcggttgttggaaaggggaactcgtggatggcgattaccataacgttgcttggagcaccgatcttggtagggacattggcaagtatgtgttatttcgtgtttcggcagcggtttaggagcggcaacgattcacagagaaggattaggagagggagtagtaagtcgttttcatggtcttactctcatcatgtatccgattttgaagatgaatcagatttcgagaagattattgctctttgaattaagtttcttaagcgtctttgtatagatcgtctcttctc

SEQ ID NO: 4632 - DNA, 3238 bp, Artificial Sequence
  P13700 (35S::G2492)
gctgcaagagtttcgccgaggacgattgagaattttgattttcgaaaaatggattctgtggaggaagaaggtgttgttagggttgaagaagagaacggacgcggtggtctccgtaggcatcggagggtttctacgaagctggcgaattacgtagatcctccgactgacgacgaagaagatggaggacccaagcgaaagggcaaaaggggtggaaatagggctccgaaaaagacaccgaagaaagacgaggagatgcaaaagaacgaaattgatgaagcaaaccgagtcactggtctggtgaaggaaaaaagagccgcgactaagattctgaatcgcaaagactccattattgaagtaggagaagcttctggaagcatgcccaaggaagtaaagggaattaggattgggaaaaggaagggagaaatcgatggtgagattccaactaagccgggcaagaagccaaagactacagtagacccgagaatcattggttacagaccggacaatatgtgccatcaatgtcaaaagagcgataggattgttgaacggtgtcagacctgcaatagtaagcgttattgtcatccatgcttggacacttggtacccccttatagcaaaagaagatgttgccaagaaatgcatgttctgctctagtacttgcaattgcagagcatgcttgcgtctagatactaaattgaaagggataaattcgaacctcatagtcagcgaggaagaaaaggtccaagcctctaagtttattctgcagagccttctcccacatctgaaaggaataaatgatgaacaagttgctgagaaggaagttgaggccaaaatatacggactgaagtttgaagaggtgaggccccaagacgctaaagctttccctgatgaaagactatactgtgatatctgcaagacttctatctatgatctccataggaattgcaagtcctgtagttttgatatctgccttagctgttgccttgagatccgcaatggaaaggctctggcatgtaaggaggatgtgtcttggaattatattaaccgaggtttagagtatgaacatggacaagaaggaaaagtgattgaaaagccggcgaataagctagatgataagttgaaagataagctggatggtaagccggatgataagccgaagggtaagccaaagggtaggccaaagggtaagccggatgataagccgaagggtaaactgaagggtaagcaggatgataaaccggatgataagccagatgagaagccggttaatacagaccatatgaagtacccttctctgtggaaagcaaatgaagctgggatcattacttgttgttgtggtgctggggagttagtgctgaaacgactacttccggatggttggatatctgagttggtcaacagagttgaaaaaactgctgaagctggcgagcttttgaatttacctgaaacggttttggagcgatgcccttgttctaactctgacagacatattgacatagacagctgtaatttgttaaaagctgcttgtcgagaaggttcagaagacaattatctttactctccaagtgtatgggatgttcaacaagatgatttgaagcattttcagcaccattgggtaaaaggcgagcctgtgattgtgagaaatgtgcttgaagctacatctggtttaagctgggaaccaatggtaatgcatcgtgcctgccgccagataagccatgtccagcatggatcacttaaggatgttgttgctgttgattgtttggacttctgtgaggtaaaagttaatcttcatgaattttttactggatacacggatggccgatatgatcgaatgggttggccactagttctgaaactgaaagattggcctccagctaaagtcttcaaagataacttgccacgtcatgctgaggagttcttatgtagtttgcctttgaagcattacactcatccggttaatggacctttgaatctcgctgtcaagcttccccaaaattgcttgaagccagacatgggaccaaagacgtacgttgcttctggatttgctcaagaattaggccgtggagattctgttactaagctccactgcgacatgtctgatgcggtgaatattttgacgcacatatctgaagtgcccaatatgcaacctggaattggaaatctgaaaaagaagcatgccgaacaagatctcaaggagctgtatagctcagtagctaacaaggaggaaatgatggagattcttgaaaattccagacaacaagtccaaaatgttgaaactgatgatggagctctttgggacattttccgtagagaagatattcctaaattagaaagttacattgagaaacatcacaaggagttcagacatctctactgctgtcctgtgtctcaggttgttcatcctatacatgaccagaacttctatctgacgcggtatcatataatgaagctgaaagaagaatatggcattgaaccttggaccttcaatcggaagcttggtgatgctgttttgatacctgtaggttgccctcatcaagttagaaatttgaagtcctgcaataaggtagcgcttgacttcgtctcacctgaaaatgtcagcgagtgtttacgcttgacaaaacagtatcgtctacttccaccaaatcattttgcaaaagaagacaagttaggggttaagaagatgatagtccatgcagttgataaagctctcagagacttaagtggagagaagtctccagaacctgaagagaagaaacaaaatatgagagggccgaagaagggggcagccaaggcagttgccaaggctctcaaagacttatctccaagtgaaaagaagtcttcggaagcagctgaagaggagatatcaaatgggatagtcaatgcaatcgataagggtctcaaagacttacctccaagtgaagagaagtcttccgaagccaaagtggagatatcaaatgggatagtcagtgcaatggataaggatctcgaacacatatcttcaagcgaaaagaagtctacggaagaggaaggggtgaaaagaccaaatattgtgaggacatatgagcggagaaaaaagctgggaagtgaagtaaccaacgcatacattgacagattagaaatggagaagatgtagtagtagtagtagttttcaattaacatcatcttttgttatagctttagcaaactcttttgctactttcatatctctaagttaaacagagtagtactaagggatagac

SEQ ID NO: 4633 - DNA, 1206 bp, Artificial Sequence
  P13710 (35S::G2539)
cagccatcgactaagatttgaaatctttaacgtgaaccagctccgatggcgattccacaaagaaacaagcgcaaagcaagatcctcgccggaacggctaacacaaccgccggaactaccacacaactccgacgttccttcttcttcgtcttcttctgccgctgataatttcttttcttggtcgacgaaacagtttgctttcccgccaggttatagatttgtaccaaaggaccaagaactcatctttcattacttgaaacccttttcgcaaggcaataaatgctcattgctcaatgttcctatccatcgtgtgaacatctacgagtcaaatccacaacatctttcaggtttgtctccgtcaatggctctgttctttattctctaatcgtggtttatgtatataaatggctctgttcttttgaattcaatacagagaaatatgagaagggtaatgataaagattggttctatatatcggagaggaccaagaccggtaaggctggaagaagtaataaacgtgtcgacaatggaggatattggagcgcaactgtagctgcccaaaagatcaacgctggaaatggcatagtcggctacaagacttcactagagtactatgttgggaaacaatcaaatagtgtcaaaggggattggttaatgcaagagtactggtttgagtcttctgatgataacaacaacgagaaggtgagggtaagtgtctttacttggattccaagttattaggattcgtgacttttggatttattgtgttttgttttggttggtgtgtataggtggatcatgctttgtgcaagatttatctgactccagcggcagcaaagaagaagaaagctgaggaagcagagaatgagaagctgaagaaagaagaagacgttgagcagctggatttgaatcaaccagaccaattgcagctgcaacagcctcatgatattgtgtatcaaccgcagtattgtttacttccagaacatcatcagccgcagccttttcctgataacttttctgagttgatcagctttcaacagcaaccagtgatgatcccagacgattttgaagatttcttggctgaattcactaaaccacattcactggatggagatgaagaattcaacaattatggtttgtttgaaggcttctttgacacagaaggaatgataaaacattaaactaactgatctcaatctgctcatac

SEQ ID NO: 4634 - DNA, 1447 bp, Artificial Sequence
  P13712 (35S::G2757)
cccttacccaccgctctttctactttcactaatttattcttcgccgccgcaatgacaatacccgatgatggatctcccgtcgccatggccatcgattcttccaccgccgtaaccgtcgccaccaccaccactcgaagagttcctcctccgtgctggaccgacgaggaaaccgctgcgcttgtcaatgcctacaaggataaatggttcgccctccgccgcgggaacctccgtgcggctgattgggatgacgtcgccgcggctgtttcgtcctcgtccaccgttggaggtccgccgaaatcagcaatccaatgtcgacacaagatcgagaagcttcggaaacgttatcgcggcgaaaaacaacgagctcttaatcgaccaggcaagttctcttcctcttgggatttgttccctatcttggatgctatgggattcgctccggtgactccggcagccgtagaaacttacgatcccgatgtggatcatgatgatgagagtaacggtttggatggatttagggttagatcgaagaggtctgggaagtttagcggtggttactctgattcacctcgagaagtaggagatggatatggggttagatctagggcaaggagtaacatgaaaatgtatggtggtttcaagtctgagtttgattcagatcacgattcaggaagtggatttggattgaaaaggaaatacaatgggaatccaaaggttagtgctgatttcgatgctgattctgatgatgagattgtgttagtccccaaggcaactaggcttaggactcatggcaagccttcctctggtgattttagccatggcagtggtggtgggtttccgttgaagtcgtttggtgatcggaattttgcttctcatgggtttaaacctaagaatttcagtaagcctgaacccaatttctctcaggatctggattatgatgatgagtttgatgatgatagagcagagagggaaggattcaacccgaggattcaaagttctaggagctcttcgcgggtgaatggctacagcaggaaggatgggagctatcctcgaaacactggtgcttccaatggctatggatcgtcttctaggttcaagcatgagcaaatgaatgcagcagcagaagttgagtctgacccgatcgatgaagttgtttcttctgttaagatgttgacagaaatgtttgtgagggtggagaattcgaagatggagatgatgagagagatggagaagtcgagaatggagatggagctgaagcattgccagatgatgcttgagtcacagcagcagatcataggcgcgtttgctgaagcgttgagcgagaaaaagagcacaaatgcaaggaggccggtttcgtagtagcaaagtcgcttattaaagaggaatgaaacggttcataatatggattttcatatggtataatgatcaaatagctttcgagtgtagtacg

SEQ ID NO: 4635 - DNA, 1130 bp, Artificial Sequence
  P13733 (35S::G2106)
cctcttcttttatgttcatcgccgtcgaagtttctccggtaatggaagacatcacacggcagagcaaaaaaacttcggttgagaatgaaaccggcgatgatcagtcagcaacatcagtagtccttaaagctaaacgcaaacgccgatcgcaaccacgagacgctccaccccaacgtagctccgtccatagaggcgtcacaaggcatcgatggactggaaggtacgaagcacatttgtgggataagaatagttggaacgaaactcagaccaagaaaggaagacaagtatatttaggggcatatgacgaggaagatgcagcagcacgtgcctacgacttagcagcattgaaatattggggacgagacaccatcttgaacttccctgtaaattttctcggaatcctattgtgtaattatgaagaagacatcaaagaaatggaaagccagtcaaaggaagagtatattggatctttgagaagaaaaagtagtgggttttcacgaggtgtatcaaaatacagaggcgttgcaaagcatcaccacaatgggagatgggaagctcgaatcggaagagtgtttggcaataaatatttataccttggaacttacgcgacgcaagaagaagcagctatagcgtacgatatcgcagctatcgagtaccgtggactcaacgccgttactaacttcgacatcagccgttatctgaaactcccggtgccggagaaccctatcgataccgcgaataatctcctcgagagtccgcattctgatcttagcccatttataaaacctaaccacgagtctgacttatcacagagtcaatcttcgtcagaggacaacgatgatcggaaaacaaagctcttgaagtcgtcacctttagtggcagaggaggtaatcggaccatcgacgccacctgagattgctccgcctcgtcggagcttcccggaagatatccagacgtatttcgggtgtcaaaactccggcaagttaacggcggaggaagatgatgttatcttcggtgatttagattctttccttacgcctgatttctacagcgagttaaatgattgctaaagtgttgttcttctgataagttttgttttttagttgttcagaatctcggttgtgaagggg

SEQ ID NO: 4636 - DNA, 2162 bp, Artificial Sequence
  P13734 (35S::G148)
ccaacattgagagatattaaagacaagaaacaacgtagaaagaagagagagagcgagtgagagatgggaagaggcaaagtggaagtgaagagaattgagaacaagatcactagacaagtaaccttctccaaaagaaaaagtggtttgctcaagaaagcctacgaactctctgttctttgtgatgcagaggtttctctcataatcttctccaccggtggcaagctctacgagttcagcaatgtcgggtacgtatatccattcattcaagatcattaattcggttttcctaatgatgaaaacctaggttttcatgggtaatatgattaagatcatccatgtttgatttgtgtctgttcttaagatcaagaaaccaaattctgtcttgtgggtatctgaaaaaggttatgtctttttattctaaccctaactagttaaggttgatcaccatccatcgatctctcaggatccatcggacatatgggtcagtttagcttttagatccggtaaatcttttgaaagaaaacttctttgttttattttgggttttaattgttatcaccagctttgatatgtgtatgtccttaagatccatgaaacctcatatatacgttttgcctctttaaatagatatgtctttctaattctaattagagaaattaattagggtttatcatgggtagccgtagatctataatccattacgcagatatatcttcccagagatttttgtgtaattagaatttcctttagacatgcattaaaagttaacacagaacttaaggttttcgttctttggttttgaatttaagcaaattcagattattaattaaaatatcttgtggtttcttttgttttataaactgtagagttggcagaaccattgagaggtactatcgctgtaaagacaatcttttggacaatgatacgcttgaagatactcaggtcaatcattttttttcttaagtatgttcattttatctttatatatatacggaatttgacctttgttcattctaagtgtatacatagtcaaactaactattatattataacgatgtataaaataaatagagctaagataaattgtagttaatcttctgctttttggtgcagggcttgcgtcaagaggtgacaaagctcaaatgcaaatacgaatctcttcttcgcactcataggtttaactaatcgtactcctcgtaatccattacttcctataattgtacatttcctaatttctgctactaataatcgttttgaatcgttgaaaaaggaatttggttggggaagatcttgaagggatgagtataaaggaattgcagacgctggagagacagcttgaaggagctctttccgcaacccgaaaacaaaaggcatgacatatttcatacgtagaccaatttttcttgcgcatcatttagacctgcaaaatacattattgaaatgtatatctttatatgcatgtatgtatatagacgcaggttatgatggaacaaatggaagagcttcggagaaaggcaagtactcgaaatgatgttctacaatatatgcatgcattgtatgtaaatgtactcatgtgtatatcatttttgtatttggaatggcaggagagggagctcggagatataaacaataagctaaaggttaatgtttttaactggacatccaaattatatatcaagtctttcttagttactatgattttgtgttagttaattagtgtattgtctactcataaatcttataaaatggataatcttcataatcagcttgagacagaagatcatgattttaaaggctttcaagacctactgcttaacccggtgctcaccgccggttgttccactgatttttccttgcaatcaactcatcaaaattatatatcggattgcaaccttggatattttttacagattgggtacgtaataatcgatatttttgcttctctactgatgaaatacaagtcatggttttatgaataaatttggccttattggatacatatataatatgaatatgatacatatgtaggtttcaacaacactatgagcaaggtgaaggatcttcggtgacaaagagtaatgcaagaagtgatgctgagaccaactttgtccaatgatgggtttcgttgtcttggtttggactcattgagtcacgacgaagcg

SEQ ID NO: 4637 - DNA, 1098 bp, Artificial Sequence
  P13746 (35S::G3084)
caattctgacttcacgataatttcaggtttttgtgttggctgaccagatgtattgcagcgatcctccccatcccttgcacttagtggcatcagacaaacaacaaaaagaccacaaactgatcctttcctggaaggtaatgtgttcttgtcttttgtttgttccctgtctgcaatgatgtctcttaactctcctgacactcttagccttagctgcttgatataaatcaacatcattctcacctttctatgtatctgttatgtgctgaatatgtatttgttatagaaaccaacaatggactcagacccactcggtgttttcccaaattctcccaagtatcatccatattactcgcagaccacggagtttggtggcgtaatcgatttaggtctcagcctgagaaccatacaacatgagatttaccactcatctggccaaagtgagtttctttgccgtttccattagtatttccattacctttaatttcttggtaaattttttcaactctgagacggtgtttacttatgagttatgacatgtggcaaaggatattgtagtaatgaaggatacagacggaagtggggttatgtaaaggtcaccatggatggtttggtggtaggtcgcaaggtctgtgttcttgatcatggaagctattcaactcttgctcatcaactcgaggacatgtttggtaagtttttcatgggaagcttgggattcaaagatgagtaagtactataagtagtaatgttcctagtaggcttataccggatgttcattacaatctgtagggatgcagagtgtgtcgggattgaggttgttccagatggagtctgagttctgtttggtctacagagacgaagaaggtctgtggagaaatgctggggatgttccatggaagtaagctcttgatactttctttgtagattactgaaataaagcgtttacatgtgttgtgatttgtaaatgacagtgagttcatagaaagcgtggagcggctgagaatcacaagaagaaacgatgctgtacttcccttttaatattagcttctctctttcttcactctttgttataatttccaagtcagccttgaatcggaaatg

SEQ ID NO: 4638 - DNA, 1335 bp, Artificial Sequence
  P13786 (35S::G1033)
gattcaattcgttggttgtatagttgctacgatgaaaacagcaaaggggaaagataaagttaagaccacaaaggaagccttgaagccagttgatgacaggttaatcccattatcacttggtaacttaaacattaataacgagaaattatggctattgagaaaagtatatcttcttgctaaatcagcttttaaagtagctttgcaaatctgacttagctgaaacagttagtaatcatcatgcttgaagccgttgtttactttgtagcttaggttggacagactggtttaacattgttgcttgtgatttggtctcatatttagttcctgtttaattttcagaaaggtgggaaagaggaaggcaccggctgagaagcctactaaacgagagactcgtaaagagaagaaggctaaaaaggacccaaacaaaccaaaaagagctcctagtgccttctttgtctttctgtaagtatttgtgtatgattttcactctaggagattctcacttgtattgttgaacttcatataaattcttactgttttttttgtttctttgtttcagagaagattttagggtcacgttcaagaaagaaaatccaaatgtgaaggccgtctctgctgtaagcatttggcagattccttgatagtttacatgtacggtagtctttactaggtgaagtcctcatggtctcaccttctcttttccttgtcaaggttgggaaagctggagggcagaaatggaagtcaatgtctcaagctgtaagtatctttgaaacttccctgtctgatactgtgaggaaaatagtgtgagattgacatgagtttcacttcttcctttgtaaaggaaaaagctccatatgaagagaaagctgcaaaaaggaaagctgaatatgagaagcaaatggatgcatacaacaaaaacttggtaagccctaagccttactctcatatatacaaactcgtacatagctaactctgatttccttgcaatggggaacaggaggaagggagtgatgaatctgaaaagtctagatctgagataaatgatgaagatgaagccagtggggaggtaacaattccactaagcaatgtagagtttctctatataatgtcttttattcatgacccattttcttctgtacctggtgcttgctttctgaagatgtatgtttggcttaatatttctctgcaggaagaactattagagaaggaagcggcaggtgatgatgaagaagaagaagaggaagaagatgacgatgatgatgacgacgaggaagaagactaaatcagggatagaaatcagattttgtatctcaagcttaactgcagatccttaag

SEQ ID NO: 4639 - DNA, 1351 bp, Artificial Sequence
  P13789 (35S::G1825)
gagtaattgatctcgagagctagctaaagacactctcgccggagagacatggccgggagatcttcgccgggaaaatgctccacgtggcttgacctgaacagagaagaaacagtggagaagaacaatgaagaagagtcatcagtggaagacgaagaccaaatcacgaataacgttagacagtatattcggtccaacatgcctcggcttcgttggacgcctgatcttcatctctccttcgttcgtgctgtccaacgactaggcggtccagacagtaggattcttgttctctctctccacgtctctttctctctttctctctctcagctttgtaatgtaattgttgtatgattttaaaggagcgacgccgaaattggttcttgagatgatgaatctaaaaggattgagtattgcacatgtcaagagtcatttacaggtaatcttcatcgtctgttattctaagattatctcagttttgttcatctttttcaatgttttcatgtttctgatttcaagatgtatcgaagtaagaagctcgagccgtcttctcgccctggtaagttagttttgatccgcagacatttaccattccttcactgggtttcataattgatggaaatgacttttgaacaggatttggagctttcatgagtggacaaagaagctatttgatggacatgatcgactctcgatgtatccctcatagcgatttaagacatgcctataactctaaaaccgttccttcgaggtcatacaaagaaacaagttccagttactaaaatgtttcacatttgtatatccgatccgaccaaggaagttaaaattgcattcttttctgtagggtactcaatcaagacgcggtcgttacaaatcttggaggtaactttcttatgcgaccttcgagctggtttagcgggttatgcagaaatgaccgagacagcacagagaacaagactctgcctctactcgaggtaactacctactttcgttttaagagttatagaggaacagttttgttaaaaaccgaggaaggtactgtaatcttggtgaaatcttatgcagattaggaagaagaacaatgagaaaagagtccgagatgaagaagtatcatcagtcaaacgattgaaatcaatgtccggaggtgggatacagttgcctgagtttggaaattgcaggcaaaaaccaacagatgatatcaacacaatgctctcgctctctctgttgtcgacatcatcagaaccgtaaccaacatactagagagatgaagtttaactttaaaagagattcaagagtagagacttttgttttccttagccgtttcatgggatgagtacttagccaggatctggatcag

SEQ ID NO: 4640 - DNA, 1043 bp, Artificial Sequence
  P13792 (35S::G2993)
ccttgtggttattctcaagaaaggtttcattttgagataaagtttgctgctctttctggttgtggatagatcaaaagaatggagattgcaagtcaagaagatcctattccaataaacactagttatggtaatagtggaggtgggcatgggaacatgaaccatcatcatcatgccaattctgcaccatcatctctcaacattactacttcaaacccactactagtctcctcaaatagtaatggtcttggtaaaaatcatgatcattctcatcatcatcatgtgggttacaacatcatggttaccaacatcaagaaagagaagcctgtggtgataaagtacaaggaatgcctaaagaaccatgcagctaccatgggaggcaatgctattgatggttgtggagagtttatgccaagtggtgaagaaggttccattgaagctctcacttgctcagtttgcaactgccatagaaactttcatagaagagaaaccgaaggtgaagagaaaacattcttttccccttacctcaaccaccaccaaccacctccgcagcagagaaaactcatgttccaccacaagatgatcaaatcaccattaccacaacaaatgataatgcctattggcgttacaaccgctggatccaactcagagtcagaggatcttatggaggaagaaggcggaggaagcttgacattccggcagccaccaccaccaccatcaccgtatagttacggacataatcagaaggaaaggtttaggacaaagtttacacaagagcaaaaggagaagatgattagttttgcggaaagagttggttggaagattcagagacaagaggaatctgttgttcaacagctttgtcaagagattggaattaggagaagagttcttaaagtttggatgcacaacaacaaacaaaatctctccaagaagagcaacaacgttagtaacaatgtcgacctttctgctggtaataacgacattactgaaaatcttgcttctactaatccttagttaagttcagattgttgttatataacttcact

SEQ ID NO: 4641 - DNA, 820 bp, Artificial Sequence
  P13799 (35S::G3017)
caagggtttgtgttttacccttccggggaaaccattgaagatcataattctttgatggatttcaatgcttcatcattcttcacctttgataatcaccgaagccttatctctcccgtgaccaacggtggtgccttcccggtcgtggacgggaacatgagttacagctatgatggctggagtcatcatcaagtggatagtattagccctagagtcatcaaaactccaaatagctttgaaacaacgagcagttttggattgacttcaaactccatgagtaaaccggccacaaaccatggaaatggagactggttatactctggttcaactattgtaaacatcggttcaaggcacgagtccacgtcccctaaactggctggcaataaacggcctttcacgggagagaacacacaactttcaaagaagccgagtagcggtacgaatggaaagatcaagcctaaggcaacaacttcacctaaagatccacaaagcctagcagccaagaaccgaagagaaaggataagcgaacgcctcaaggtattgcaagaacttgtaccgaatggtaccaaggtggatttggtaactatgcttgagaaagcaattggctatgtaaagtttcttcaagtacaagttaaggtacttgcagccgatgagttttggccggcacaaggagggaaagctccggacatttctcaagttaaagaagctattgacgcaatcctctcatcatcacaacgagatagtaactcaactagagaaacaagtatagcagaataattccgaccaaaacaaaaagtatagcagaataattagttactaaatg

SEQ ID NO: 4642 - DNA, 1134 bp, Artificial Sequence
  P13803 (35S::G1957)
caagaaccatctcgtaaatcaagatttctccaaggaaaatcagataagtcataatggatctatccctggctccgacaacaacaacaagttccgaccaagaacaagacagagaccaagaattaacctccaacatcggagcaagcagcagctccggtcccagcggaaacaacaacaaccttccgatgatgatgattccacctccggagaaagaacacatgttcgacaaagtggtaacaccaagcgacgtcggaaaactcaacagactcgtgatccctaaacaacacgctgagaggtatttccctctagactcctcaaacaaccaaaacggcacgcttttgaacttccaagacagaaacggcaagatgtggagattccgttactcgtattggaactctagccagagctacgttatgaccaaaggatggagccgtttcgtcaaagagaaaaagctcgatgcaggagacattgtctctttccaacgaggcatcggagatgagtcagaaagatccaaactttacatagattggaggcatagacccgacatgagcctcgttcaagcacatcagtttggtaattttggtttcaatttcaatttcccgaccacttctcaatattccaacagatttcatccattgccagaatataactccgtcccgattcaccggggcttaaacatcggaaatcaccaacgttcctattataacacccagcgtcaagagttcgtagggtatggttatgggaatttagctggaaggtgttactacacgggatcaccgttggatcataggaacattgttggatcagagccgttggttatagactcagtccctgtggttcccgggagattaactccggtgatgttaccgccgcttcctccgcctccttctacggcgggaaagagactaaggctctttggggtgaatatggaatgtggcaatgactataatcaacaagaagagtcatggttggtgccacgtggcgaaattggtgcatcttcttcttcttcttcagctctacgactaaatttatcgactgatcatgatgatgataatgatgatggtgatgatggcgatgatgatcaatttgctaagaaagggaagtcttcactttctctcaatttcaatccatgagaag

SEQ ID NO: 4643 - DNA, 1513 bp, Artificial Sequence
  P13804 (35S::G1557)
ggtgaattttcatcgaatcgcgagtttcagtaagatataaaacagatgaagaacccaatcgttagatcttatgttagatcaaaagtgccgcggttgcggtggaactctgatcttcataactcttttgttcaagctgttgaacaactaggtggagaaaatagtaagtggtttcctttctcttctcctaaaactataattatgatttaatttctcttaaatgtttcaaaaatcattcacaatttctgtcattatatatagaacaacttttgaagattactttatcaattataaaacttctgttcttgtgaagttatataatttttaccaatcttgaattcattcaagttcaagataaatgaattcggtttacaatccctaaaattgcaggagcaactcctaaaatggttttacagttaatggatgtgagaggactcacaatatcacatgtgaagagtcatctccaggtcctaacatttaatatctatatacatccatatacttatacaagcatatgtctttatacatatcattatatatgtgtatatatgaatagtatcatattttataagttctggtttgaatattgaaccatatatctttcaacttccaacagatgtataggggcatgaagcttgaagaatccatgcaaggttgataaatatgatcattacatcttaaagtaaattatataaatatgtatgtattgtacatgtgtatataggaccatataaactgatttatacatatatgtatataatatagaaacacattcaatctttgacagaagagatattagcaaagagaagtgttagagtgacaggacaagtaacttggtggcaatttcaacattaccttcataactaccaacgtcttcagggcaatgccaactttttccaaaatcaacaaaggttcgtgtagttattaataaaaatattttagttgatatatatataggttttaacgtgaagcagagagctatatattttcttaataaaagtttcttgtaggcaagaagcgggaatatatgaaaaaattataacatttggacaatcaagtaatgaaactaaggaagtaccaagtgactactttacctgcaagtctctctatgaaacatccagagtaattatcctttttttcatatgcatttatttaactatttaccatgtgtacaagtcatctatgtgttcatctgatttccgaatatatacatgtaaatttagaaatactcttatattatactgcttataaataacaggctccacaaaataaaacgagagatgatgatgaaaatggtgaagctgttgttgctattgaagatgatggtaatgttgttgatgaacatgatgatgaggatgctaatgatgatgaggttactttgtcactaaactcaataaaagtttcaaaaagtgaagaagaattgtcccttgagctcactcttggtctcaaagcataacatgttttgattttgatttttttttttttgtagaaaccgttggaagtatgttgtaggatg

SEQ ID NO: 4644 - DNA, 1225 bp, Artificial Sequence
  P13807 (35S::G2702)
ccatctttccttgcttcttacaatctctccaatttcaaatctgtatactcttcttcaaaaaggctccaccagtccaaaatgatgatgaggaaaccggacattactacgatcagagacaaaggcaagccaaatcatgcatgtggtggtaataacaacaaaccgaagctaagaaaaggactttggtcgcctgatgaagatgagaagctgataagatacatgttgactaatggacaaggatgttggagtgacatcgctagaaatgctggtcttttacgttgtggtaaaagttgtcgccttcgctggatcaattacttgaggcctgatcttaaacgtggatccttctctcctcaggaggaggatctcatcttccatttgcattccattcttggtaacaggtaaactttacaatgagtctcagatttgaaacaatttggccctaaatgattttagtgcataactgtttacattttatcgtcaggtggtctcaaatagctactcggcttccaggtagaacagacaacgagatcaaaaacttttggaactcgacattgaagaagcggcttaagaacaacagcaacaacaatacttcatcaggatcatcacctaacaatagtaatagtaattccttggacccaagagatcaacatgtggatatgggaggcaactcaacttcattgatggatgactatcatcatgatgaaaacatgatgacagtggggaacaccatgcgcatggactcttcctccccattcaatgttggaccaatggttaatagtgtgggcttaaaccaactttatgatcccttgatgatatcagtgccggataacggatatcaccaaatgggaaacacagtgaatgtgttcagcgttaatggtttaggagattatggaaacacaattcttgatccaattagcaagagagtatcagtagaaggtgatgattggttcattcccccctcggagaataccaacgtcattgcttgtagtacaagcaacaacctaaacttacaggcccttgatccttgcttcaatagcaaaaatctttgtcattcagaaagcttcaaggtagggaatgtgttggggatagagaatggttcttgggaaatagaaaaccctaaaatcggagattgggatttggatggtctcatcgataacaactcttcttttcccttccttgatttccaagtcgattgacaatttctctcttttcatttcattctatcttc

SEQ ID NO: 4645 - DNA, 1949 bp, Artificial Sequence
  P13813 (35S::G133)
ctcttcaacaaaaagattaaacaaagagagaagaatatggcgagagggaagatccagatcaagaggatagagaaccagacaaacagacaagtgacgtattcaaagagaagaaatggtttattcaagaaagcacatgagctcacggttttgtgtgatgctagggtttcgattatcatgttctctagctccaacaagcttcatgagtatatcagccctaacaccacgtacaccatctctctaaacaccactcttaaattaagctaattgagttgctttgttttcttataattaaccactacttttttggtgattttgttggttatagaacgaaggagatcgtagatctgtaccaaactatttctgatgtcgatgtttgggccactcaatatgaggtttttttccttcttagatctttcttcttcttcttgatatgtgtttcgctggttggttaaattcttgatgcgttttgctgcagcgaatgcaagaaaccaagaggaaactgttggagacaaatagaaatctccggactcagatcaagtatttgtttctctctcttctcttagatgaggagttttactaaaaaaaatgagtacgaaaatatacatatttttaaaattgtaggcagaggctaggtgagtgtttggacgagcttgacattcaggagctgcgtcgtcttgaggatgaaatggaaaacactttcaaactcgttcgcgagcgcaaggttctcttcatacttttcccttacctagggtttcaattaatcctatatacccaagcttcagttttgaattgaattattaaaaaatgaattttattgttgtatatatgttttagaaaaagaaacattttgtttactgttggataatatatgttaattgtattgtactgtacagttcaaatctcttgggaatcagatcgagaccaccaagaaaaaggtcacatcttctatgtccactcacttttccattttatcatatttatttgtctcaacaattttgtgtcaattgaatttatcaacttactaaaactgttgataacacttttcttggacaattatatttgtgtgtgtgtgtgtgtgtttaagctaatggataaagaaaataccaagtatactatatagtgatgtcataataacttgggtatatatcttcataatttttttgggagggaatatttcttcatcatttctcttgtggtttacacaattgcagaacaaaagtcaacaagacatacaaaagaatctcatacatgagctggtaatatctctttctgtttttctcaaatgttggtttaggcataatacattcatggaatacggagccagttaaaaagatatctagaaatgtagtgtagattgatcagtcactcttatgttttcttgtgattctcttatcgaaatatctcctagttaaatcatatatcaaatgtcatgtcatttcgaattaataatattggttttagttatgtggaatatggcttaaaacatgttttggtgaattaggaactaagagctgaagatcctcactatggactagtagacaatggaggagattacgactcagttcttggataccaaatcgaagggtcacgtgcttacgctcttcgtttccaccagaaccatcaccactattaccccaaccatggccttcatgcaccctctgcctctgacatcattaccttccatcttcttgaataattaaaggctaaaaggtttgctggtgccatcattgtctatctaattatttagtaactacttaaaacataaggcatggtgttgctaaaaccttaaactgtcatgtttcttagttatgtattttaaagcctaaagaaatatggattgtgtgatcagtagtgcttaggcttattgtgtgtggaatgttttcaagacttttatcatgtatcgtattattatattgaccactctacttaattatgctacaaatttactc

SEQ ID NO: 4646 - DNA, 1141 bp, Artificial Sequence
  P13821 (35S::G2983)
atgcatagcatttgctagttttaacatatagcaatgaaggttcatgagttttcgaatgggttttcttcatcgtgggatcaacatgactcgacatcatcccttagcctaagctgcaaacgcctccgtcctctcgcccctaagctctccggcagccctccctcccctccttcttcttcctccggcgtcacttcagccacttttgaccttaaaaacttcattagacccgatcaaaccggtccgacaaaatttgaacacaaacgagaccctcctcatcaagtcagttccattattgtacttcgtacattttacatcgtttctttcgtttgaaaaaagaagaagaattcactctagaagaattttgataattgcggcatacctaatactttgacatttataaattataacgactggagtggttccttttattattaattttatttatttattttaatgtatgattcctaacaaatgtaatgaaataatgtgtgggttcagttggagacgcacccgggagggacaaggtggaacccgactcaagaacagatagggatacttgagatgttgtacaaaggtggaatgcgtactcctaatgctcaacagattgagcatatcacattgcaactcggtaagtacgggaaaatcgaagggaaaaatgtgttctattggttccagaaccacaaagcccgcgagagacagaagcagaagaggaacaacctcatcagcctaagttgccaaagcagcttcacgaccactggtgtctttaatccgagtgtaactatgaagacaagaacatcatcgtcactagacattatggtaggaatttaaggattttgtatagttttgtggttttgatcaactatatttaaggataatttttatgattgtgtagagagaaccaatggtggagaaggaggagttagtggaagagaatgagtacaagaggacatgtaggagctggggatttgagaacttggagatagagaacaggagaaacaaaaatagtagtactatggcaactacttttaataaaatcattgacaatgtaaccctcgagctttttcctctccatcctgaagggagatgaagtcatgaaggtgaggcagaaaattgtggaattcttatgtagatctggtttaggttc

SEQ ID NO: 4647 - DNA, 1278 bp, Artificial Sequence
  P13824 (35S::G961)
aacctcacatgctctattcttgcttgatttttgagttaatcttgaatctctttgatgatgtcaaaatctatgagcatatcagtgaacggacaatctcaagtgcctcctgggtttaggtttcatccgaccgaggaagagctgttgcagtattatctccggaagaaagttaatagcatcgagatcgatcttgatgtcattcgcgacgttgatctcaacaagctcgagccttgggacattcaagagatgtgtaaaataggaacaacgccacaaaacgactggtatttctttagccacaaggacaaaaaatatccgacgggaacgagaactaacagagccactgcggctggattttggaaagcaactggccgcgacaagatcatatatagcaatggccgtagaattgggatgagaaagactcttgttttctacaaaggccgagctcctcacggccaaaaatctgattggatcatgcatgaatatagactcgatgacaacattatttcccccgaggatgtcaccgttcatgaggtcgtgagtattataggggaagcatcacaagacgaaggatgggtggtgtgtcgtattttcaagaagaagaatcttcacaaaaccctaaacagtcccgtcggaggagcttccctgagcggcggcggagatacgccgaagacgacatcatctcagatcttcaacgaggatactctcgaccaatttcttgaacttatggggagatcttgtaaagaagagctaaatcttgaccctttcatgaaactcccaaacctcgaaagccctaacagtcaggcaatcaacaactgccacgtaagctctcccgacactaatcataatatccacgtcagcaacgtggtcgacactagctttgttactagctgggcggctttagaccgcctcgtggcctcgcagcttaacggacccacatcatattcaattacagccgtcaatgagagccacgtgggccatgatcatctcgctttgccttccgtccgatctccgtaccccagcctaaaccggtccgcttcgtaccacgccggtttaacacaggaatatacaccggagatggagctatggaatacgacgacgtcgtctctatcgtcatcgcctggcccattttgtcacgtgtcgaatggtagtggataacggaaatggagggaaagagagagaggcacacacacataagacatttcacatttgtgtaaaaagatataatcataccatatagttgttgaaacatataaaagaaagtcagatttgtgataattacag

SEQ ID NO: 4648 - DNA, 1146 bp, Artificial Sequence
  P13836 (35S::G246)
tctttacatggcaaggtttaagaaacattcaacaactattctataactcacacattttaatacgataaacagagaaatatcacacaacaatacattatgtatctgtttatgtataaatgtaacatagttttggaggagactcatgtttttcaaaataccccttgtgatgtttcattgcagaggccatttaatgggtttggagaaaacaatgcattaccattgagaaagatgcatcaagaggagaagaagaagaaacataggggtggacactggacactttcagaggatctcaaactcaaagagcttgtggcggtttttggtcctcagaactggaaattcattggagagaagatggaaccaagaacaagtaaaatattgttttttttttctttcgtacttactctatttttggacatgaaagttgaatctttttttcttgtttttctatgtgtttgaaggtctaagttgtagacaaaggtggtttaaccagctcgatccgaagattaacaaaagaaatttcactgatgaggaagaagagaagctgcttagagctcacatattatatggtaacaaatggtctaagatcgctaagcttttcaatcgaagaacagaccatgctgttaagaatcattggcacagtctcatgaatagaatcattaggaagcaatcagcttctgacataagatctttcgataacatccagaattatcaaacctccaactttcttcctggtttgtgtctccttaatactaaacaatagatttaaaacaccacacagcaatatgggttcaattctgagttcttgatgtttatttttcttattgtgtggtttacaggtagtgtaagtcatgaaagtactaacctcaatgctcaatatctccaagaaaagaattattcttcatgcatgccattgcaacactcatgtcatcatcatcacttctctaccttccctgcaaattccttggccttattcacacctcatgtctccatctctcaaccatcatcatcatcgttactatcatcatcagaagcagaagatataatgactacaaaaaccccgaggtatatagattttctcggggtaggagattcttgaagaaactacttaagaacttcctaactgtaaccttaattccaatgatgagg

SEQ ID NO: 4649 - DNA, 1904 bp, Artificial Sequence
  P13846 (35S::G2041)
tcgacgagttgagagccatactttcactataccagttgcttcctcagatatgccatcggctgaagaaagtgacaatgtctggtctttaatacctcagcttaagagaaaactgcatttgcaccagaaaaaagcttttgagtttctctggaagaacctagccgggtcagtggttcccgcgatgatggatccgagttcagataagataggtgggtgtgtagtttctcatactcccggagcaggaaaaacatttctaatcatagcttttctcgcgagctacttgaagatatttccgggtaaaagacctttggttcttgctccaaaaacaactttgtacacttggtacaaggagttcatcaaatgggagattccggtccctgttcacttgctccatggtcgtagaacctactgtatgtccaaagagaagaccattcagttcgagggaattccaaaaccaagccaagatgttatgcatgttcttgactgtttagacaaaatccagaaatggcatgcacagccgagtgttcttgtaatgggttacacatcgtttctaactttgatgagggaagattcaaagtttgctcatagaaagtacatggctaaagtactgagagagtctcctggattactggttctagacgagggacataacccgaggagtaccaagtcgagattacgaaaggccttgatgaaagttgatactgacttgaggattctgctttctggtacattgtttcagaacaacttctgtgagtacttcaacactttgtgcttggctagacccaagtttgttcatgaggttctagtggagttggacaagaagttccagaccaaccaagccgagcaaaaggcgcctcacttgcttgaaaatagagctcggaagttcttccttgacattatagccaagaagattgacacaaaagtgggcgatgagcgcttgcagggtctcaacatgttgaggaatatgacgagtggtttcatcgataactatgaagggagtggaagcggaagtggtgatgttctcccaggtttgcagatttacacattgttgatgaattccactgatgtacagcacaagagtcttaccaaacttcagaacataatgtcaacttaccatggatatccactcgagctcgagttactcataacgttagctgctatccatccttggttggtcaaaaccacaacctgttgcgccaaattcttcaaccctcaggagcttttagagattgagaagctcaagcacgatgcaaagaaaggatcaaaagtcatgtttgtgcttaatcttgtgttccgggtggtcaagagggagaaaatcctcatattttgtcacaacattgcgccgatccgcctgtttcttgagctgttcgagaatgtattcaggtggaagagaggccgagagctcctgaccttgacaggggatctcgagctgtttgaaagaggcagagtaatagacaaatttgaagagccaggaggccagtcccgtgttctgctggcttcgattacagcctgtgcagaaggcatcagtctaaccgctgcttcacgggtgatcatgcttgattcagagtggaatccttctaagacaaagcaagcaatcgcacgtgcattcagaccgggacagcagaaagtggtgtacgtttaccagctcttgtcgagaggaacacttgaagaagacaaatacaggaggacgacctggaaagaatgggtctccagtatgattttcagtgaagaatttgtggaggacccatctcaatggcaagctgagaagattgaggacgatgttcttagagaaatcgtggaggaagacaaagtcaaatccttccatatgatcatgaagaacgagaaagcttcaacaggtggctgattgctgaatttttccagttcaagtttctgtttcaccatgccgc

SEQ ID NO: 4650 - DNA, 2435 bp, Artificial Sequence; identical to SEQ ID NO: 1667
  P13851 (35S::G2754)

SEQ ID NO: 4651 - DNA, 2734 bp, Artificial Sequence
  P13862 (35S::G1772)
caccggaactgtgatctcaccggaatatccctcctttatttatcctctactcatccgttttactctctccctccgtcgatcttctctttctcttgatcgcctccgtccattctttatcatttcttaattcagaattgtgatcgatggatgattattttagcgcggaggaagaggcttgctattactcctccgatcaagattctttggatggaattgataatgaagagtctgaattgcagcctctgtcctctaaaagatcaaacactcaggttctcttatatacactcttcttcctctcttcattcttctatctctttcttcttaatatccgtgattgtttcatatttggttgttattggtaattctcttccccctcaatttttgtgggttgttgatatttcgtgaaaattttgaaccttttcaaagtgaatttcattgcaattgtgagattgaaaatctggttccggcatcattgttcatctgaatttctcatttttcacagtgtttaggattctaatttattgcagaattgttctgttctgttcttctctgtttgaaattagggtttgttaacagttattctacaattttgcaggtcatcactcaggaatcgcttctagcagcacaggtaaaatcagcagagatgattttactctcgggtttaattttaagctttagtttggtttgagttattggttttctgatgcagagagaagatttgctaagggtgatggaattgttatcaataaaggagcaccatgcacggactcttcttattcattaccagtgggatgtggagaagttgtttgctgtgtttgttgagaaaggaaaagatagcttgttttctggagctggtgtcactgtcttcgattatcaatatggcaactcttcctttcctcagtcttcacagatgagttgtgatgtttgcatggaggatttaccaggtgatcacatgacaagaatggactgtggccattgcttttgcaataattgtgagtaccctcttgctgtaatttgttgcaaaggttgacatatgatgtaacacagttcttgtttcgttttaggttggacggagcattttactgtgcagataaatgaaggtcagagcaaaaggattagatgcatggctcatcaatgtaatgctatttgtgatgaagatattgtcaggagtctagtcagtaaaaagcgtccagatctagctgcgaagtttgatcgttaccttcttgagtcgtacatcgaagataacagaatggtcaagtggtgtcctagcactccgcattgtgggaatgctatacgagctgaggatgacaagttgtgcgaagttgaatgttcttgtggtcttcagttctgtttcagttgtctgtgtcaagcccactccccttgctcttgtttgatgtgggagttatggagaaagaagtgtcgagatgagtctgagacaatcaactggataaccgttcacacaaagctgtgtcccaaatgttacaaacctgtggaaaagaatggtggatgcaatctcgtgaggtgtatttgtgggcagtgtttttggtaagaactcgagccttgtttcctcaatgcttttttttcctattttgcatttgttttttctatgctttgagacgatcaaatgtcaaatggtggaagtgtctctcatgtttggttattaaaatgtacagttggctatgtggtggagctactggaagtgatcacacttataggagtatcgctggtcacagttgtggtcggtaccaagatgacaaagagaagcagatggaaagagcgaagagagatttaaacaggtatacgcattatcatcaccgatacaaagctcatacagattcatcaaagctagaagataaacttagggatactatccatgagaaagtgtcgaaatcagaaaagagggagttgaagcttaaagacttcagctgggtcaccaatggactcgaccggttattcagatcaaggcgagttctttcatattcgtatgcttttgcatattatatgtttggtgaagagatgtttaaagatgagatgacccctgaggagagagagataaagaagaatttgtttgaggatcagcagcaacaacttgaaagtaatgtggagaaactttcgcagttccttgaggagccctttgatgaatttagtaatgataaagttatggcgataaggattcaaatcatcaatttgtctgtcgccgtcgatacactctgcaagaaaatgtacgagtgcattgagaatgacttactcggatctctccaacttggcatccacaacatctcaccttacagatcgaagggaatcgaacaagcagctcagttttatgcttcctggaattccaaagatgctgacaaattccaacctttggatagtggtacaagcggtaatcaactctcggtgaacgatgatcattgtattctagtaacgaatcaatgaatcaaaatcctaatgagtgataaatatttttatacaggagtgacatcgaggcctgagcaagcttcaggatcaaggagctcggaagacaccatttgctcatcttcacagaaacgtcccaaaaaagaaggaagtttcttaaacaacaaagtcactttattggatttgaacttgccagctgatttcgtcgaccagaactgaactcaaatcctctcttgcttagtccaaatgagatatgatgacatagcaaaaggtgtttgactatatatctatcaccttcaagactcgtgactctggactg

SEQ ID NO: 4652 - DNA, 2621 bp, Artificial Sequence
  P15001 (35S::G1037)
aatctttcgtttctgggtctgttgaaaaacgatgactgttgaacaaaatttagaagctttggatcagtttcctgtaggaatgagagttcttgctgttgatgatgaccaaacttgtctcaaaatccttgaatctctccttcgtcactgccaataccatggttcctctctctctctctctctctctctctctctctctgttttcttggatctgtttttcatcaagtttttagattttatgtctctttgatctgtgatttgatccacatatggtggaatcttttgatatctatctacctaacttcttgtatacacaaatctaaaaaaaacttagctttttttattccattgttagattttgtaagatttgacatttgtcagagagaaagtttcattgttgaattgaattaaaagtttaagactttatggaatctgttgcagtaacaacgacgaaccaagcacaaaaggctttagagttattgagagagaacaagaacaagtttgatctggttattagtgatgttgacatgcctgacatggatggtttcaaactccttgagcttgttggtcttgaaatggacctacctgtcataagtaagtcttattattattattattttctaattaaacttttgtcatttatttccttaatgactcactacaggaataaagttttgatctctagacttggttttgtgatgatgattttcttgttgttgcagtgttgtctgcgcatagtgatccaaagtatgtgatgaagggagttactcatggtgcttgtgattatctactgaagccggttcgtattgaggagttgaagaacatatggcaacatgtcgtgagaagtagatttgataagaaccgtgggagtaataataatggtgataagagagatggatcaggtaatgaaggtgttgggaattctgatcagaacaatgggaaaggtaatagaaaacgtaaagatcagtataatgaagatgaggatgaggatagagatgataatgatgattcgtgtgctcaaaagaagcaacgtgttgtttggactgttgagctgcataagaaatttgttgcagctgttaaccaattgggatatgagagtaagcttatcaatatgtcacttgatatgagagtaagcttatcagtatgtcacttaagttctgttttgtgtgtgttgttttgattgcagaggctatgcctaaaaagattttggatctgatgaatgttgagaagctcactagagaaaatgtggccagtcatcttcaggttacaaagaatctttcatgtttttaacttgcgtaacccgaagatttgttttttaacacctcggaagcttatgactttgttcgctgtggtttgcagaaattccgcctttacttgaagaggatcagtggtgtggctaatcagcaagctattatggcaaactctgagttacattttatgcaaatgaatggacttgatggtttccatcaccgcccaatccctgttggatctggtcagtaccatggtggggctcctgcaatgagatctttccctccaaacgggattcttggcagactcaatactccttcggggatcggtgtccgcagcctttcttctcctcctgcaggaatgttcttgcaaaaccagaccgatatcggaaagtttcaccatgtctcatcacttcctcttaaccacagtgatggaggaaacatacttcaagggttgccaatgcctttagagttcgaccagcttcagacaaacaacaacaaaagtagaaacatgaacagtaacaagagcattgctgggacctccatggcttttcctagcttctctacgcaacaaaactcgctcatcagtgctcctaataacaatgtcgtggttctagaaggtcacccacaagcaactcctccaggcttcccaggacaccagatcaataaacgtttggagcattggtcaaatgctgtatcctcttcgactcaccctcctcccccggcacataacagtaatagtatcaatcatcagttcgatgtctctccattaccgcattctagacccgaccccttggaatggaacaatgtgtcatcaagctactctataccattctgtgactctgccaatacattgagttctccagccttggatacaacaaatccccgagctttctgtagaaacacggacttcgattcaaacacaaatgtgcaacctggagtcttttatggtccatccacggatgctatggctctgttgagtagtagtaacccgaaagaagggttcgtcgtaggccaacagaagttacagagtggtggattcatggttgcagatgctggttccttagatgatatagtcaactccacgatgaagcaggtgtgacattaaagcttttgccaatattaaccattctgatttggagattattgtgatttctgacatgaagattttgtgaatgtgacaggaacagagccagggagatttgtctggaggagatttgggatatggagggtttagttcactcagaacatgcatatgagagaacaaacatttagacataaatcaaatatcatcatcttgtttgtctctttttctcgctaatcttttgtgtattaaaattgtaaactatttgttttcccactggttctagcaattta

SEQ ID NO: 4653 - DNA, 963 bp, Artificial Sequence
  P15002 (35S::G2111)
atttgatactagacatacaaattcctttttattgttgtcattaccatgacgaggaagaagctaaacctatcttacatcaccaatgagtcaatgagaaaagcaacattcaataagagaaagaaagggcttgtgaaaaaaatccacgagctttccgttctctgcggaatcgaagcatgtgcagtgatttatagtccgttcaactcaaaccctgaagtctggccatcgaattcagaagttaaaaatgtaatggaaaattttgagatgttgacaaagttggagcaagagaagaaaatggtgagccacgaaggttttatcagacaaaacatctcaaaaactatggagagtaacaacaaaaagatgatcgataatgcggagaggacgatgaaagaagccatgttccaacttcttagtggaaaaggggagaagcttaatttgactgatagaaaccgtgaagatttgtgtaagtacattgatcaatatcttaaagaactttatcaccacaaaaacaaaaccataaatcaatcacatattgaacctggagaatcttcgggagctacaaatgccatgacaccaacatctgttgttgaagtgagttcttattcctttccaattatctcgatgttttcaactctccttgactaatcaatgatttctcgtctttgaagcctattatctcttcaatccagcgaccaaatcaggttaatatcttctccagtaattttctatctagtgatgctgaccagtaaagttattctctagtgataaatccatttggtgtttatgatcagaatccaaattttaatcatcttagtcataatcaatatcaatatcaacaacagtttggatatccgattttggttcaagatggaatttacaatccgagtcaaattcagaatcaacatgaggaatggctggatgatcatatgatgaatcattctaaggaaataagtcatcctttgatgg

SEQ ID NO: 4654 - DNA, 2268 bp, Artificial Sequence
  P15009 (35S::G380)
ggtttctctcttcaacaatcgtctccccattaggcacattgttgagggcagggtagtctcgtgagttctcttctcctgagtgtaactgtggttaaaagcttagccaagatgcagggggagagggccagtcttggctatttatcagaggccttgaactttgagcatggttcttcttcaagtaatggtgtgatagatcattgggagaatattcacagtcttggtgataatgacttgcaggattacatgattgcaaattctgaatcaaatacttcgcttgcaaactcagtttatcacgagcaacagggtttacgcagatttagccttggtgaggctagctctagtggcacgaaggatgaagcttccagtcacaatgagcaacgaatggaaacaagatgctttgacggacgaggaaatgaaataattgatttagacccagtgtttgcgcagccatcaggcacaaatcaacctgttcagaatgtcaatctgaatgcagagtatatagaaattcacgaggatattaatccatatagaggtcggtctggcttcatagaagctaatggaccagggaccagggtctcacaacctggcagatcttttgaagagaacggtgttggaacaggttcttctgtagagggacgtcgtgcatcctgcaaaagaaaagctcttgaaggcagtattagtcaatcttcttcaggaggttatcatgatttccagcgtggagaaagcagttcgtggaccccaggttctacggtttttaggccaggaaatggtttaaacatatctggctcccttgacaatggaccaagaggaatggtctccggtactgtaccaaattttcctgtttctgcaccaaattttcctgtttctgccattgcagagagctccagtagaaatatatgcgtcaggagtaatccctcagatcatcaagaaactgtaaacccatctacctttgctgcgggaactgttgtcaggcggcctgtccctccatcccagttgaacttgtcaagacacttaccagcagatcagcattcattggacttgagacctggacagtcttttgtcgtttctcgtaacccaaattctactcctgtgagcataccacctggttcaaggactatgctaccaccatttcggtggactgggagctcactagtgggtggaacatcgaactctactgcgcccgttgagagaaatcttcatctagatgaaaccaggtcaagaagcatacccgggaatactcttgagattcccatgtttgcagctcctgaggtaggaaattttgcccgtagtcagagtagcagaaatgtaacaaatggaaacctgaatagtgcatcatcagtgtccaggacaggctcaacaacaagtgttccaccaccaccaccaccatcttctaatctagcgtggacttcttaccagaattcaccacattatcaaagaagaaggactgaaaggtctgaacttgcacgtaggtccttgctttcttcccttgcagcagatgctacaaaccagagatctggtgatcatccaacacttcgttcgttggcccctcctgcctcttcggatgggcttgtgcttcagcctggtggtgataatagtcagatgcataatcgggcttactcgagagcaggtccgttgtttgataggcaaggggatagtgtggttggtattcctcatcctttgcgggccttggcagctgcaagcagaggaagaagcagacttatggtgtcccagatgcagaatgtcttggatgtcatgcgtagggatgctaataataacaacttgcggcttgaggacgttatgcttctaaatcactcagtactatttgatggggctactggtcatgaccggtatagagacatgcgacttgatgtggacaacatgtcatatgaggaattgttggcactagaagagcggattggagatgtttgtaccggtgtaaacgaggaaaccatatcaaaccggttaaagcaacgaaaatacaaaagcaacacaaaatctccacaagatgcagagccatgctgtgtttgtcaggaggaatacaccgaaggagaagacatggggacactagaatgtgggcatgaattccatagccaatgcattaaagaatggctgaaacagaagaatctttgcccaatctgcaagactacaggcttgaacaccgcgaagaagcggaggatagcatgatgatttctcgaaagagctttttttttttcttaactattcaattttataatcaaaaatgaaagaaacagaaggtaccctaagccc

SEQ ID NO: 4655 - DNA, 874 bp, Artificial Sequence
  P15010 (35S::G744)
cgtgggagactggtagatgaacaacttatgtcaacaatgataaattcacaccattggcaggttttattcttactcatctgaatgtgtatggttaaaacagaacattgaaaagtactactgaaagttactatatgaacatgtaaatatagtttttgaagtgtttgaaggatgtctcttatgatcaacgctggcccaaacttctttcagtgtcctgagactatataagaagagctagagtccttagatttccaagatctgtaaattttgttttatatacttttgttcctgcatcttactgtttcgcttgatgtttggcaatcacctctagtttgaatcgatgcagaaagactgatgtaaccagctttgtctaccttttatagttaaggatttccgatgtaagttatgaagagcgggaggatgtttatggtgaactggaagctagaggcttatcgggtgactctttaaggaaactaccatgctatataatgtcaagtgaaatggtcaggaggcaggtcactcactgcacaatttgtctgcaggtttgtctgcttcttggtttttatatgaattgattgaactatcatggccctttcttcatcttataccttggcatttacaggacatcaaaacaggggaaatcacacgaagcttaccgaaatgtgatcatacgtttcatctggtatgtgttgataaatggctcatcagacacgggtcatgccccatttgcagacaggcagttaaagattaaaacacgactgttgccgagctgtgtacatagcaaaaacacattatccttatatgttgttgtaacttgtaagtctaaaacccctttcttctgtatttttcctcatttcatttagagcaatgctcagct

SEQ ID NO: 4656 - DNA, 1570 bp, Artificial Sequence; identical to SEQ ID NO: 581
  P15012 (35S::G752)

SEQ ID NO: 4657 - DNA, 1197 bp, Artificial Sequence; identical to SEQ ID NO: 673
  P15014 (35S::G905)

SEQ ID NO: 4658 - DNA, 1511 bp, Artificial Sequence; identical to SEQ ID NO: 823
  P15018 (35S::G1108)

SEQ ID NO: 4659 - DNA, 500 bp, Artificial Sequence
  P15019 (35S::G1113)
tctttctctcacactcatgggtcttccaacagatttcaaagagcttcagattccaggttacgtactaaaaacactttacgtcatcggtttctttagagacatggtcgatgctctttgtccttacatcggtctaccaagttttcttgaccacaacgagacctctcgatccgacccgacccgactcgctctctccacgtcagcaactcttgccaacgagttaatcccggtggttcgtttctccgatcttttaaccgatccggaagattgctgcacggtttgcttatccgattttgtatccgacgataagattagacagctgccgaagtgtggacacgtgtttcatcatcgttgtttagaccgttggatcgttgactgtaataagataacgtgcccgatttgtcggaaccggttcttaccggaggaaaagtccacgccgtttgattggggtacttcagattggtttagagatgaagtggagagtaccaactaataatgatggt

SEQ ID NO: 4660 - DNA, 869 bp, Artificial Sequence; identical to SEQ ID NO: 1127
  P15024 (35S::G1730)

SEQ ID NO: 4661 - DNA, 1121 bp, Artificial Sequence
  P15028 (35S::G1740)
attggttcttcttttgcatcattcttacaaaatccccaaaatcattcgaaacccctgagtattctccttaactctaagaaataaatttctgaatggatgcatcgtcttcaccgtctccttccgaggaaagcttgaagcttgagcttgatgatcttcagaaacagctgaacaaaaagctgagattcgaagcatccgtttgttctattcataatcttctccgtgatcactactcttcttcctctccttctctccgcaaacagttctatatagttgtatctcgtgtcgctacggttcttaagacaagatatacagctactggattttgggttgctggactgagtcttttcgaagaggctgagcgacttgtctctgatgcttctgagaagaaacatttgaaatcttgcgttgctcaagctaaggagcagttaagcgaagtagataatcagccaacagagagctcacaaggttatctttttgagggacatcttacggttgatcgtgagccgccacagcctcagtggctagtacagcagaatctcatgtctgctttcgcttctatcgttggtggtgaatcctctaatggtcctactgaaaacactattggggaaactgctaacttgatgcaagaacttatcaatggtcttgacatgatcattccagatatactagatgatggtggaccaccaagagctccaccggcaagtaaagaagttgtagagaaactcccagtcattattttcaccgaggaattgcttaaaaagtttggagcagaggcagaatgttgcatctgcaaggagaatctagttattggcgacaagatgcaggaattgccatgcaagcacacatttcaccctccttgcctaaagccttggctggacgagcataactcttgccctatatgccgccatgaattaccaacagacgatcagaaatacgaaaactggaaagagagagagaaagaggccgaagaagagaggaagggcgcagagaatgctgtccgcggaggtgaatatatgtacgtttaaatttcaatcagttatggcacactcccattgtctttccttgaaacatctccgaattgttgttcatcattcacaattataaatcccattttacatata

SEQ ID NO: 4662 - DNA, 515 bp, Artificial Sequence
  P15030 (35S::G2226)
tatcgaatccaacaagtgaaagatgggtctatcaagtcttcctggtccatcagaaggaatgttatgtgtgatattagttaatacagcattatcgatctccattgtcaaaggcattgtaagatcattccttggcatagtaggaatcagtctctcgccgtcttcatcctcgccttcttcggtgacggtatcttcagagaattcatcaacttcagagtcatttgatttccgggtctgccaaccagagagttaccttgaggagttcaggaaccggactccgacactgaggtttgagagcttgtgcaggtgcaagaaacaggcagacaatgagtgttctgtgtgtttgtcgaaattccaaggggattcagagatcaacaagctcaagtgcggccatttgtttcacaaaacatgcttggagaaatggatagactattggaacatcacttgcccattgtgtaggactcctcttgttgttgtgccagaagaccatcagctttcttctaatgtttggtgactgc

SEQ ID NO: 4663 - DNA, 1333 bp, Artificial Sequence
  P15033 (35S::G2312)
gttcagaaatcttcggtggacggataacttgcagagttctgattgaggctggttttgtgagaattatagttgcagcaagaaagcgtttcagatattttttaatggccgctgaggatcgaagtgaggaactaagcagcaatgtagaaaatggaagttgcaattccaatgaaggaattaatcctgaaaccagcagtcattggattgaaaacgttgtcaaggttaggaaaccgtacacagtaactaagcagagagagaagtggagtgaggaagagcatgataggtttcttgaagctatcaagctttatggtcgtggttggcgtcaaatccaagaacacataggtacaaaaaccgctgtacagatacgaagccatgctcaaaagttcttctccaagatggctcaggaagctgacagtagaagtgaaggatcggttaaagcgattgtgatcccgcctcctcgtccaaagagaaaaccggcacatccttatcctcggaaatcgcctgttccatatactcagtctcctccaccaaatttgtcagctatggagaaaggaaccaagtctccaacctcagtgttatcatcgtttggttcagaggatcaagtcaatagatgctcttcgcctaattcgtgtaccagtgacatccaatccattggtgcaacttccattgataaaaagaataactacacaacatccaagcaacctttcaaagatgattctgacattggttcaacacccatttcaagcattactcttttcgggaagattgtccttgtcgcggaagaatctcacaaaccatcctcttacaatgatgatgatcttaaacaaatgacgtgtcaggagaatcactactcagggatgctagttgacactaatttatctcttggtgtatgggaaacgttttgtactggttctaatgcatttggctcggttacagaagcatctgagaacttggagaaaagtgcagagccgataagttcttcatggaaacggttaagctccttagaaaaacaaggatcttgtaatcctgtaaatgcaagtgggttcaggccatacaagagatgcctatcagaaagagaagtaacatcatcattgacgctggtagcttcagatgaaaagaaaagccaaagagcacgtatatgctagttttagccattgtacagtttggagtcaattttgatgatccgtgaacattgttttagccatttgctgggtgacttggatcatagcattccacgaaccaaatcctaaatccgagttggtaagtggttttacttgtccgccacatgtaattcttgtaatgaagtttctcctgctgtctcacgttaagaagacac

SEQ ID NO: 4664 - DNA, 1431 bp, Artificial Sequence
  P15034 (35S::G2575)
cttgatcacccaaagtccacatataacctaacacctaagtttgaagaaccaaatctcttcctcttcttctctttctcctcttcttcaatggatgatcatgttgagcacaattataacacatctttagaagaagtacacttcaagagcttaagtgattgcttacaaagctcattagtaatggattataactcactagagaaggtcttcaaattctcaccttatagttccccttttcaatcggtttcaccgtcagtaaacaacccttacttaaatctcacttcgaattctccggtggtctcatcttcctccaatgaaggcgagcctaaagagaacaccaacgataagagtgaccaaatggaggataacgaaggcgacctacatggtgttggtgaaagctccaagcaactgtgagtttttttcaaccttttacttttctttcggagttcctcacatatttttgttctttatggactagatgtcctgaaacaaaatttagactatataattaacgtgaagcttataaaaatcaacaatcacttgccaacatagaacgtggaaacccttgagattgatatgctttagatggatgggtatggtcaggacaaaacaaggtaaaaagaaaggagagaagaaagagagagaagttagggttgcatttatgaccaaaagcgagattgatcatcttgaagatggttatagatggcgaaaatatggacaaaaagcagtgaagaacagcccttatccaaggttcatttattcactacactctattcaaatccacacatttataagttacagatatatatatcataatggttttgtaagaaaataaagtgtatattatcataatatcataatttgtttatgcgttttcaggagttactataggtgcacaacacagaagtgtaacgtgaagaaacgtgtagagagatcgtttcaagatccgtcgatcgtaattacaacctacgaaggaaaacacaaccatccgatcccatcgacgttgagaggaaccgtggcagctgaacatctactagtccaccgtggtggtggaggcagtttactccatagcttccctcgtcaccatcaagattttctcatgatgaaacattctccggccaattatcaatcggtgggatctctgtcgtacgaacatggccatgggacctctagttacaattttaataataatcaaccagttgttgactatggtcttcttcaggacattgttccttcaatgttctccaagaacgagtcttgagagaggggtatgtacgtactatagatcgtatcgttatggttgcattatataagcataaatcatttgtactatatgtatgtaagtagattcttaggtaatgtatttattcatatctatacatgcatgttaatttatatatatttcactgacacactggcactgctactaatcat

SEQ ID NO: 4665 - DNA, 713 bp, Artificial Sequence; identical to SEQ ID NO: 4609
  P15038 (35S::G1274)

SEQ ID NO: 4666 - DNA, 1205 bp, Artificial Sequence
  P15040 (35S::G2579)
acttactcatcataagatatctttaaccaaaaccctaaaagaaacctcctttcaaaaaaaccatttcttcatcatcatgtcaacctccaaaaccctagaccataataaaccatttgaaacatcccaaacgcaaatgggttttgctctgatccaccaaaacacatccgccaacacaaccaccaccaccacaaccggcgagagacgaggccggagatcaaagcaagcggagccagggaggttcctaggagtccggagacgtccatggggtcgttacgcagccgagataagagatccaaccaccaaagaacgtcactggctaggcactttcgacacagctcacgaagctgctcttgcctacgatagagctgctctttcaatgagaggtactcaagctcgaaccaacttcgtctacactccaactgatgtccacaccatcctcacaaaccctaatctccactctctcattgtctctccttacaataacaaccaatctttcttaccaaactcttctccacagtttgtcatcgatcatcatcctcattatcaaaactatcatcaaccacaacaacctaaacacactctcccccaaactgtcttacccgcggcttctttcaaaacgccagttcgtcatcaaagcgtggatattcaagcgtttggtaatagtcctcaaaactcatcttctaacggctcgttatcttcttcactagacgaagaaaacaacttcttcttctctttaacaagcgaagaacataataagtccaataacaactcgggttacttggattgcattgtcccaaaccactgccttaaaccacctccggaggccaccaccacccaaaatcaagccggagctagtttcacaactccggtagcaagcaaagcctctgaaccatatggagggtttagtaatagctacttcgaagatggtgagatgatgatgatgaatcatcatgagtttggttcgtgtgatctctctgccatgatcacgaactatggtgctgctgccgcttcaatgtcaatggaagattacgggatgatggagccgcaagatttatcttcttcttctatcgctgcttttggagatgtcgttgcagacactacaggcttctactcagtcttttagaacattctatattatatatgttttttatatatgcaataatattattagtatttacgttattcgatggtcgtttgattgttgt

SEQ ID NO: 4667 - DNA, 1765 bp, Artificial Sequence
  P15043 (35S::G2682)
ttgtgtggcgactataatgtgtcaaggaccgatatgacaggaaacgcagattccggcaaaatcgcgacagagaaagaccctaggaagctcgttttcaccaaattggaggtatctcccgtcttccgagaatctcctgttaaagaacttcctctttttcctccgatttctcggtattgttccagtttctctgccaattttcactagagatgcttctcgtttgagtaatttcaatccaaaatctactctctgatctccactggtcttgattttgaagcagagagcattcagaagcaaaggataagacagatgaagaaggcattacttcgaggaaacacaaaggatgtcgatgcaagcagtccaaatgtttaaagttgtaagttcatttcaggatccaagaattacttagtgttaagctgatagagatttgagtataatgttgaatagtgagatttctattatctgctgtagattgatgcattattggatatttgtttgacgcttggttattaggtactgtgactgttttgcatcaggagtggtatgtacagactgtgattgtgttgattgtcataacaactctgagaaatgtgatgctagagaagcagctatggtgaatgtactaggtcgcaacccaaatgccttcagtgaaaaggctttaggtagcctaactgataatcaggtatgttcttgacacctatcacttttgtaggttaagcttcaaagaggtatatttcacatcctttttcatttgtaagtatctgggatgttctgtgttttgtattgtagtgtaaggctgcacctgatactaaacctggactgctttcgagaggctgcaaatgtaaaagaaccaggtgtttgaagaagtactgtgagtgctttcaggctaatcttctgtgctcagacaactgtaaatgcatcaactgcaagaatgttagtgaagcgttccagcctcctgcattttctgctcacaattccccacaagtataccggaggagaagagaccgagagctaactgaggcaagtgaaatatactacttgcttcataacatatatgcacttttgggtttatctccataaaactcatttttctgtccggaatagcagtggaattcttgtccagctccgttattttcgatacctgacaattccattcaaaatgctctgggttcccctatgtcttgctctcctaaacttccttacaggttcgattttgcatttcctaaaatgatagttcatcttccttcacctcataatcataaatattttaactgaattttcattgtgctactagaaagaaaaggtccctcatgggatacacctctacacttcttccggacttgggagatttatgctcacttctcgttgcagcgtcagaatctgctacaacaactgcaggtatatctgtagtctcttacaaaatctacactttactggatctactattcctttggcttcatcaacatacttcctttaaaatctcacttagaggaccagaacaggatatttacaaagcctgatgataaggaagccattgagctgtcaagtgagtctgagagtcgtaatgtggaagaagaaatacaatcacgtggaagattgatcgaactgatagatgttcaatacaatggagaagaggattcccaatgtaagaccaagacaagtgtcaatgaaacagatatatacatggagcaggaaagggcagtgcttgaaactttcagagactgtctccaaaagttcatcaaatcgagactggaatcataacaggtaa

SEQ ID NO: 4668 - DNA, 1436 bp, Artificial Sequence; identical to SEQ ID NO: 4610
  P15046 (35S::G3086)

SEQ ID NO: 4669 - DNA, 1828 bp, Artificial Sequence
  P15051 (35S::G1510)
tgccgtctatgatctctctcaatctctcatcttagctttctttctctctctctttgtgtcttcatttgtttatctcatcaatggattcaaattttcattactcgatagatcttaacgaagatcaaaaccatcacgaacaaccctttttctatcctcttggatcctcttcctcgcttcatcatcatcatcatcatcatcatcatcaagtcccttctaattcttcatcttcttcttcgtccatttcatcgctctcctcttacctccctttcttgatcaactctcaagaagatcaacatgttgcctacaacaacacttatcacgctgatcatctccatctttctcaacccctcaaggtaaatttacaattacatatcaaccttaagtgtgtgtgtataaatgttattcttgtacgatcgttctttttagtttagcagttaaaatcatgcctgatcatgtaaaattcatacaataatattagtttctgaatttgtatgtcgagaattctatatagacgaaatttaatttatcaaataaaaaggagggatcttaagaagccatatcattatattattatgtacaattccatctgttgttgattataaaccttgatcggtgatatatatataccaggccaagatgtttgtggctaacggtggatcatcagcatgcgatcacatggtgccaaagaaggagacaagactgaaactaacgataaggaaaaaagatcacgaagaccaaccccatcctcttcatcaaaacccgacaaaacccgattcagactccgacaagtggttgatgtccccaaagatgcggttgatcaagaaaacaatcaccaacaataaacagctcattgatcagactaataataataatcataaagaaagtgatcactaccctttgaatcataagactaatttcgacgaggatcaccatgaagatcttaatttcaagaacgtcttgaccaggaagaccacggccgcgaccaccgagaatcgctacaatacaatcaacgagaacggttatagtaataacaatggcgtgattagggtttgttcggattgtaacaccaccaagactcctctttggcgaagtggacctcgaggtcccaaggtagattaatcacacttacttcaatcgaaattgtcttgatatatgtcatactatctatatctacctagtttagttcacatttttaaaattaatagttatatttcaagaatgtagatatttaatttatttaaacctgatacatcctttaaacattaatactttaatcaatgatactcataagtccaacattctatgattttttttttgtcatctacagttcgcatactaattttcatttatcattgcagtctctttgtaacgcatgtggtatacggcaaagaaaggcaaggcgagccgctatggccgcggccgctgcagccggcgaccaagaggtggcggtagcgccccgagtgcaacaattaccgctgaaaaagaagttgcaaaataaaaaaaagagatcaaacggaggggaaaaatacaatcactctcctccaatggtggccaaggccaaaaagtgcaagatcaaagaggaagaggagaaggaaatggaagcggaaacggttgccggagattcagagatcagcaaatctacaacttcttctaattcttcgatttcgtcaaacaaattttgcttcgatgatttgacaataatgttgagcaaaagctcagcttatcaacaagtgttcccacaagatgagaaggaggctgctgttttgctcatggctctgtcgtatggaatggttcacggttgatcagatcatcacaatatcctcattac

SEQ ID NO: 4670 - DNA, 1455 bp, Artificial Sequence
  P15056 (35S::G2679)
agaagaagaagagagagctattcaagcttaaagcataaaacaatctctgctccttatatagttcttcactatggaagatttgagtaatcagaatctcctcccgcgtcaatcagatatctccatccctgcggagaagatggattcgtttcaaaagtcgctagaacctccgccgtgttctccggtgaaatcttctcaacaatcagaaacggaagtcacaccgcctcagaaaccaccgcttcaccaatttggtcacaaccaagttcagaagaatcgagtgagcaatcaagatccatcgacctcacgaagacataatgaagttgaatcgaaagagaatactccaaataaacaacaaaaacattgcaattgcaaaaactcaaagtgtttgaaactgtattgtgaatgctttgcttctggatcttattgtaatggttgtaactgtgtgaattgtcacaacaaattggagaatgagtcttcgagacaagtagctatctcggggatcttagagcgtaaccctgatgcgtttaagcccaagattgctggtagtcctcatggaatgaaagatttgcaggagaatgtgcagcaagtgttgcttattggaaagcacagcaaaggatgccactgcaggaaatcaggatgtctcaagaagtactgtgagtgttaccaggcgaatattctatgttcggagaattgtagatgtcaagactgcaagaactttgaaggaagcgaagaaagaaaagctcttcttcatggatctcaggtctcggatacctacatacaacagatgaccaatgcggctgttaaccgtgccatcgacatgtctgcttatctgtaccctcctgaatcaagaaagagaaagagcaaggacatttcagattctgtagtttcatcatacggtgtccaataccagagggcaaaccacgttagaagaaatggtgaaaattctctattttcactccctaacaacaaggccgtgtccggatctaccacaagtgcttacaggtcttcttggtcaaatacattccaaccacatcatgtcagagagctatgttcacttttggtctcaaactcggtgatgtagcaaataaattgtcagacaaagggaggaagaacgacaaaggcccttcttcacttgatggagcccaaagagttgctaatgagatcaatgactcaccagattgtgtccttgatgctaatagaatggacgagaagcctatatctcccgcaacacgtgcattgatgtgtgacgaagaacatgagatcgggtcagagaaagagacatcggcccgagtgaaaacaagccaagagaaagaagacacagacacaagctcggggatttacttagagcaagaaagacagatattgtcaatcttcagggactatctcattcagctctcaaaccgtgcgaggataaatggtaaaaatatcaaaagcaacacaaatccaagttgaaagaaa

SEQ ID NO: 4671 - DNA, 1309 bp, Artificial Sequence
  P15063 (35S::G2227)
aacctctctgtcattactctggtcagcgattcttctttcttcttcttctcagatcctttcaccgagtaagaagattttaaagatgccgtcaacgccgacgacgccgactacaacaacgccgatcacggcttcgtattggtgttacagctgtacgcgtttcgtcagcgtttgggctgatcaaggcacaacaaccgtcggtagcgtcgcttgccctcactgcgacggcggttttatcgaacagattaacgattcttcctccgccgctaccgaattaacgattccggcttctactgaagtaagatcgatcaataacaaccgtagatccgtgattagacgccggagatccggtcgtcgtccgtcctttaatccggtcatcgtacttcaaggaggcgccggcgagagagaagagggagaagaaggagatgcggctagagatcgacgcgcttttgagttttattacgatgacggatccggatcgggtcttagaccgcttccggattctgtatctgagatcttgatgggatctggattcgagcggttacttgaacagctaagccaaatcgaagcgtcggctactggaattggtagatctggaaaccctccggcgtctaaatcggcgattgagtctttacctagagtcgaaatctcggattgccacataggctcggaggctaattgcgctgtttgcacggagattttcgagacggagacggaggcgcgtgagatgccgtgtaaacaccttttccacgacgattgcatcgtaccgtggctatcgattcgaaactcttgtcccgtgtgcagattcgagctaccttcagagcctaatcgacggagcaacaacaacgaggaggataacgccgtggggatgacgatttggagacttcccggtggtggattcgccgtagggaggtttaacgcagcaatgagagacggagagagagttttgccagtggtgttaacagaaatggatggtggtgggattggtaatagccaggatggtcctagacggatctcatgggttaggtcacacggtacactcgaatcggatagtaacggtactggctcaggttccggctccggtggaagattgaggaggatggttcgtggaatggtgtcgttaatgaggagagtgagaccaaaccgtagctcttcttcttcatcagctgcgatatcaacttcttctgataatctggatttgaacattgaagtagaatctagggttttggataggtcaaattcagtgatgagaagatacttcagaagaaacagaagtaacagggattcttcgtcttcagttcttcattgattc

SEQ ID NO: 4672 - DNA, 679 bp, Artificial Sequence
  P15069 (35S::G2251)
tcacccattctccaccttatcatcacaatccaaaactctctctctctctctctctgtctcttgtcttatcatttatctctctaacggcgaggcaatgggttttccggtgggatattctgagctacttctcccaaaaatctttttctacttgttatctttcttaggtttgatacgtaaactcatctccacaatgttcaagatcattggtctaccagatttcttagaacctgaaccggtttcaacctcatggcccgacccaccacccacgttgaccaaacctgactcagcagcaatactagccggagagatgttaccggttgttcgattctcggatataaaccgaccggaatccgagtgttgcgcagtgtgtctctacgatttcgagaacgacgacgagatccgacggctgacgaattgtcgacatatatttcatcggggatgtttggaccgttggatgatgggttataatcagatgacgtgtccactttgtcgtacacagtttatacctgatcatcttcaactggagtttaatcaaaggctctggtctcaatcttctgctgtttcttctcaacttcttgatgaatcatcatcttaggacgtattaaatctttgtcccaaccaaaaaaaaagacatattaaatcctttttttttggtactttcattgggaattgggtttgg

SEQ ID NO: 4673 - DNA, 680 bp, Artificial Sequence
  P15071 (35S::G2261)
caacaacaaaacctcttactcactccaatggctcgccttctctttcgtcttctcgtagaatccaacactccgtctccggcgattgataactccaccgccgcgttgaattctgatctcgtcgtcatcctcgctgctctcctctgcgccttgatttgcgttctcggcttaatcgccgtttctcgatgtgtctggctccgtcgtctcgcagccggaaacagaacagtctccggatctcaaactcaatctcctcaacctccggtggcagcggcgaacaaaggcctgaagaagaaagtccttcaatctctcccgaagcttacgttctcgccagagtcacctgagtcggagaaattcgcagagtgcgcgatctgtctagctgaattctctgccggcgacgagctccgagttttaccgcagtgtggtcacgggttccacgtggcttgcattgacacgtggctaggatctcactcgtcttgcccttcttgccgtcagatcttggttgttgccaggtgtcacaagtgtggaggtttacccggtagctctagctccggacttgaatccgaacccgaaatcgagatccgaatcaagcaaggcgaagatgaccccaactccttcttgccataatcattttagtttcccatttatttattagaaaactctataatttaatgcagatcatttta

SEQ ID NO: 4674 - DNA, 689 bp, Artificial Sequence
  P15073 (35S::G2269)
acgccaatcccacatggccctaacctctttcttcaccatcaaatgtcaaccgccaccctcgtcgtcttccctcctccacctcctgtccctatccctacctatataactagcctcggccttggctactccatagccatagctctaggtttcctcgttcttatctccacaatcattctctcttcttacatctgttgccgcgcctcacgcctccgcttctctgcctccgccgcaaacgcaaacgcaaacgcatcgtttagcgaccgtggcgttatcgtcccaagaatcatattcgtagctgaagacgacgatcttgagtctggaaacgtcgtcgttggaggtcttgatcattcagtcatcaactcttaccctaaattccatttcactaaagatatcaccgccgtagtaaacggtgatgggtttcacgacggagaaggaagagagacgacgtgttcgatctgtttatgtgagtacatggaagaagagatgttaaggatgatgcctgagtgtaaacactacttccatgtttattgtcttgacgcttggcttaagctcaatggttcttgtcccgtttgtcggaattctccacttccgacgccgcaatctacgccgcagtcaactcctttgtcggaagttgtgccgttgtctcaatacgccgccgatcggaggagatccagaagataaaacatttc

SEQ ID NO: 4675 - DNA, 1376 bp, Artificial Sequence
  P15077 (35S::G2394)
gcggttgtgtgttacgagagctagagttgaatttgctttggtcaacacaatggggacttgtggttgctgacttttgtgattttcagttttctacttggatttagatggatgtttcttccattgtgcgaaatacaaccctaactgatcaagatcctttgttaatggaccacggtaaccgcgagcacatcgttgacattacaagcaatgacgaggaggactcttcatcaagatcttctctcgatgagcttactcctcaaggtaactcacatcaaggtgaagagacagtattatcatcatcaaatgctacacaacaacacccaactcatccatctcctcctcagcaaagaccaacttcttctaggagaggagataacgggaatggtcgccgtactaggagtccattgaattctggcctctggatctcagttgagttagttgtcactgtcgctcagattgttgcagccattgtagttatggttctggctaaagatgaacatcctgaagcgccattatttacttgggttattggatatacttgtggctgtctagccactctccctattctctattggcgttttcgcacttataatcgagctacagggcaagactcttcacaacgtgctacctcttctcaaggcaatagtgagtccacaccatatacagcagtctcagttgctcaagcagcagatgaagaaaatagcactggcgtgagtgcagcacctagaaacaatcaagttggggaaagcttaagaacaaggctcaacgggctagtggaccacttcaagatggcgattgattgtttctttgcggtgtggtttgttgtggggaatgtatggatatttggaggtcactcatctccttctgattctcctaaactgtacaggttatgcatagcgttccttactttcagttgcattggatatgcaatgccattcatactatgtgcaaccatatgttgttgtttgccttgcttaatctcggttctcggatttcgagagaacttctcacaaactagaggagccactgccgaggccatcaacgcattgcctgtctacaggttcaaatcaaaaagtagaaatgatttggagttttcagaagaaggtgaaggtggatttcttctcttggggtctcagaagaaacgtcttatatcaggcgaggatgccagctgttgcatctgcttgactagatatggagacgacgaacaagttagagagctgccatgctcacatgtcttccatgtagactgtgtagacaaatggcttaaaatcaatgcgacttgccctctctgcaaaaatgaggttggagaaagcagcagtgcttcctcatagacaaaagctgagttgatcgcaactgtttggaatttgggatccatagtc

SEQ ID NO: 4676 - DNA, 866 bp, Artificial Sequence
  P15088 (35S::G1840)
gatccttcgcattcactaaataagtacatattatcagtttgacaccaaaaaaatggattattcagaaaatgttcaaaacaaaaatttcacccctatttcacaacctcctaacttgacaagagaccaagaacatgctatcatggtttctactttgcgacaagtgatatccaacactggaggtgatacgtcatcatctcactacattgctgcaagtgaggctcttccaccttcggacgctggcccttgtcctctttgcggcgtcaccagttgctacgggtgcgcattcccacagcatgaagagattaagcaggagaagaagcataaaggagtgaggaagaagccatcaggtaagtaaattttgttccaacatctttgagtttgttccatcggtttataactttactaagttattatcaggaaaatggtcggcggaaatatgggatccgagtacaagaacaaggaggtggcttggaacgtttccgacggcagagatggcagcggatgcttacgatgaggcagcggctgcgcttgtcgaaaaaagatcagcgagacgtggctcaaagaagggagaaggaagcattcaccaagaagtcggcggcggagatgactgagaaattaagctatataactatatatcgttttatagggggaaaaatagatgttttgggagaaattaatacattacctagatgggttatatgttttacgagaaaccacttgcgtgtgttttttttttaataagaggttttcaaattaaagttttgatggaaaaaaagttagatagagcccaaaaagttttgagtaaaagacctctattttattggagagtcttctcctctgtagtggcctttaacatttgcattgtg

SEQ ID NO: 4677 - DNA, 590 bp, Artificial Sequence; identical to SEQ ID NO: 1523
  P15094 (35S::G2457)

SEQ ID NO: 4678 - DNA, 1684 bp, Artificial Sequence
  P15096 (35S::G2525)
gctctgaagtcgaagcaaagttaattacagagagagagaaaggatggagagagaactcagacgaccgaacccaatcaacagctctcgccggccggagatattttcttcaggcggtagtagtactcaactaccggaaagcccacgaggcccaatggagttcttgtctagatcctggagtgtctctgccttggaagtctccagagctctccacaccgccaaatcagcttcagccaccaacaggcctccctcatccattaacactccgataccggaagaaacgctaaaccctgagaaagaagaatgtccgccggagaacagtactagtgttagtagccagttctcgttcgctgcctcggccacttcacagcttgttcttgagcgcataatgtctcaatcggaggtgtcaccgttaacgtcggggaggctatcacacagcagcggcccactcaacggcggcggttcttttacggagacagacagtcctcctatctccccttccgatgaattcgacgacgtcatcaagtattttcgcacccacaacaccatacatcctctcttctccggcacaggaggcagccgtggtaccaccggaaatgggagcaatacccccatggctggaaccggtccaaagacagttggtaggtggctcaaggaccgtaaggaaaagaagaaagaagagactaggactcagaatgcacaggttcacgcagctgtttctgttgcagcggttgcatctgctgtggcagctgtagcagcagccacagcagcttcttcccctggtaagaacgagcagatggccagaatcgatatggccatggcttcagcggctgctctggtggctgctcagtgtgtggaggctgcagaaatcatgggagcagatagggatcatttgacatccgtggtgagctctgccgtgaatgttaagtcccatgacgatattgtcacccttactgcagctgctgcaacagctctgcgaggagcagctacactcaaggcaagagcgcttaaggaagtatggaacatagctgcagtattgccagccgagaaaggggcaagttcagcgttgtgtggacaggttgacacaaagcatagtgatagcagctttagtggagaattacctgtggctggggaagacttccttggcgtctgtaaccaggaattactagctaaaggcactgagctcctcaaacgaactcgtggaggtgaactccactggaagattgtctctgtctacatcaacaaagcaggccaagctgtgctgaaaatgaaaagtaaacacgttggagggaccttcacaaagaagaagaaacatatggtgcttgaagtgagaaaggatatacctgcatgggctggcagagatcttttcaacggagacaagcatcactactttggcttaaagacagaaacaaagagggtcattgaatttgagtgcagaaaccaaagggaatacgagatatggactcagggcgtatccaggctacttgccattgctgctgagaagaagcagaaaagttccatgtccaaatggatggcaccttaacaacataagctaggaaagaagtagatgctttgtagaacgaactgcttatgataagaataggtttaaacataatggagtagaagacattcccttttgtaatatccttttattcaattgagtgaacagagatgacttctaaagcta

SEQ ID NO: 4679 - DNA, 1136 bp, Artificial Sequence
  P15106 (35S::G2847)
atattctcggttagtagaaactaggaaaagagatgaatagaggagtgttggagagttcgccggttcaacatctcacggcggctggaaaccctaattggtggaataatgtcagccgcggcttgaggccaccaacgccgttgatgagtcacgagccgccgtctaccaccgcttttattccaagtctcttgccaaacttcttctcttctccgacttcctcttcatcttcttcaccttctttccctcctcctaatagtaaccctaacttctcttcttggcttgaaatgagtgatctgcctcttgatcagccatggagccttagtcaactcctcttgggtggattgatgatgggagaggaagagaaaatggagatgatgaaccatcatcatcatcaaaatcaacaccaaagttaccaagcgaagaggatacaaaattgggaagaacaagttttgaggcaccaagcttccatgaaacaagagagtagtaataataatagttatggaataatgtcctcaccaaactcacctccaaacaaatcttgtgctacaattatcaacaccaatgaagacaacaacaataacattcacagtggtcttaacttgtccgagtgtaatagctcagagatgattgggtcttcttttgctaataagaaaccaaaacttcaagttccttcatcacaatcaactctcaaggtgagaaaggagaaacttggaggcagaatagcatctcttcaccagctagtatctccctttggcaagactgacacagcctctgtcttgtcggaggctattggatacattagattcctccacagtcaaattgaggctttaagtctaccatactttggtactccctcgaggaacaatatgatgcaccaacatgcacaaagaaatatgaatggtatatttcctgaggaccctggtcagcttgtgaatgagtattgcatgaaaagaggagtttcattgtcatcgacggacaatcaaaaatcaaatcctaacgaagaaccgatgaaagatttgagaagtagagggctttgtcttgttcccatctcatgcacactacaagttggcagcgacaatggtgccgactattgggctccggcgttcggaaccactctccagtgaactattcactttctg

SEQ ID NO: 4680 - DNA, 625 bp, Artificial Sequence
  P15113 (35S::G3002)
aaacaaagtctctctcttctaattagagagccaagaagatgcagagtacttgtgtctacagagaatgcatgcgcaaccacgccgcgaagctcggctcttacgccatcgatggctgccgtgaatactctcaaccatccaccggcgatctctgcgtcgcctgtggttgccaccgcagctaccaccgtcgtatagacgtcatatcttctcctcaaatcaatcacacgcgcttcccgttcacgagcttaaggcgcgtgaagcagctggcgaggctgaaatggaaaacggctgaggaaagaaatgaggaggaggaggatgacacggaggagacttcgacggaagagaagatgacggtgcagaggcggaggaagtcaaagttcacggcggagcagagagaggcgatgaaagattacgcggcgaagttgggatggacgttgaaggataagagagcgcttagagaagagataagagtcttctgtgaagggattggtgttactcgttatcattttaaaacttgggttaacaataataaaaagttttatcactaactaattaactaatatccttaattgagataatactataatttagttccaatttcattttcatcccttctgtgttaatttct

SEQ ID NO: 4681 - DNA, 1576 bp, Artificial Sequence
  P15148 (35S::G2784)
tctcaaagtcataatcttcgaatccaaaaacaaaaaaaaacaatggaactatcattagcattaacatcaacagaccataatccatcgccttcagaggcacatccagatactatggactttctgtctcgagaatggtgtaatttcgctgttcaatcacttcatccagaccctatcctctacgatcgttccattgttcccgtcgagacatcgatcgccaagtttcaaggcgactcaagtcctgtttcttgtgctgtaagtaaccagagattgttttttgttatattttcttcaattttgttggttagtgtttaatttatgatgattgtaaaagtagatgatggatacgagcatgaagatggacgatccagattttaagccctcgatgccttcatggaaaaccaatgatgtgaaggtataacaaattaggtgtgcaaaatatagtttttaaaataacaaaaatcacagtaacgtttaacattatgatatcatagttttcaacatatattcctcatttttatgttgtctatgtttatttgatgcacattcgaatgaaaattcggtatatatatgatttaaattgtaatacgacagcatattggaattgtagaaattgaaaataaaactgctacatgatagaatgacatatacaattaagtgaagaaagttaagagattaaatattgatactataatttgttgaatgatgtgaacagtcatggatatggatgcaacaagcaatgcacccggaattgagctacgaaggctttttccgcaagaaacttgtaaaacccttttggccatttcgtttggttttgatttatcaaatcaacaatattggttttctaaaccaaaacaataatggttttgtagaaacttccatggaaaattacgccgtcgataaagaaatggtggaaagagataaaggcgaaacgaaaggaagaagtgaggctacagagagctgaagtccacgccgccgtgtcattggctggtcttgccgctgctctcgccgccgtggcttcagagaacgctggaaaagatggtggaaacggtcgacctagcacgagggagactgctgtggcttctgctgcggctgtggtggcggcacaatgtgcgcaaatggcagagacaatgggagcaaacagagaccagctcagcacgatgattggttcagccatgaccgggacaagtgttagtgagatactcactctcactgcctcagctacaacttgtaagaagattgttttttgtttttgtttctataagaatgctctgtttctgagacattggtgcttggtaaaataagcgttgagaggtgccgcgacgctgaaagcaagaagaggttgcaagattaatagattgaatggctctgcacctgtgttgcctattgaagactcttcttatttgcctcctgaattcgataagaacacatctgttcttgctaagggaacagatctcttcgtcgagacaccagatggtatataaatcctctgtttttcttgttgaactcctttgttttgtagagagactaaagagatctttggattaaaacaggggatttcaaggctaggacggtttct

SEQ ID NO: 4682 - DNA, 950 bp, Artificial Sequence
  P15154 (35S::G131)
tatttatatgtatgtggcaaactgtttttattgttgacgattacaaatatatatatggaaatgcttcatgcggcgaagcagccaaggttgcagttgtaaacgggttcaagagtcagttcgagatcattcctcctcattgccataggatcatcttcttgatacagaccacccatgttgagaaaaggagatggctgatgagagagcatgtaaggatgctggatttggtgctgctgcggtggcagagggggaggcatattgtggccttggttctgctgatcccactgctcctgttgagccctaagaattttttccctctccttgatctgtttagaaagcatgctgttttgctcctgtatggccttctcctttttttggagctcattgatggactcgtacataagttggttttttctagtgcggatgtgcttaagagcagtgtcaagctgctgctccagattctgaagctctttagggctcattgcttgcaagtcttccccaagataatgcctctggtttctctccaaaagctcaatcttagccttaagcctgttatactccatcgaccagtctgtattgacgtcggactcaggtgcaataagctgtctttcggcgtaagagtacctctcatagcgttcaagtatcttctccatacaagaatcagtggagtattcgaagagttttcccttatgggagaagacaacaagagcaacttcagcatcacagagaacagagatctcatgagctttcttcaaaagaccagctcttcttttcgagaatgtcacttgtctattgatcttgttctctatcctcttcaattgaaccctaccccttcccatttttgatccttttttaagaaacttcttactctaaaagaaccaaacaaaacaaagacccccaataagaaactacaagagagatataaagaagagctcagactttggtatgaacca

SEQ ID NO: 4683 - DNA, 869 bp, Artificial Sequence; identical to SEQ ID NO: 517
  P15159 (35S::G651)

SEQ ID NO: 4684 - DNA, 1121 bp, Artificial Sequence
  P15160 (35S::G811)
gagaaagagagagatggaggacgacaatagtaacaacaacaacaacaacaacgtgatcgcacctttcatcgtgaaaacatatcagatggtcaatgatccttccaccgattggctcatcacttggggacctgctcacaacagtttcatagtcgttgatccactcgacttctcgcaacgaatcttacctgcttatttcaaacacaacaatttcagcagttttgttcgtcaactcaacacctatgtaagttaattcataaccgaaactcatacatgaaactggaaacaggggattacgaactaatgatcctttctttatttactttaggggtttaggaaagtggatccggaccggtgggagtttgcgaacgagcattttctaaggggacagaagcatttgttgaataacatagcgcgtaggaaacacgcgcgggggatgtacggtcaagatttggaggacggtgagattgtgagggagatcgaacggttaaaagaagagcagagggagctagaggcagagattcagaggatgaaccggaggatcgaagcgacggagaagagaccggagcagatgatggcgtttctttacaaagtcgttgaagatcctgatcttcttccaagaatgatgctcgagaaagaacggacaaagcaacaacaacaagtttccgacaagaagaagcgtcgtgtcacgatgtcgacggtgaagtcagaggaagaagaagtggaagaagatgaagggagggtctttagggttatgtcatcatcaacaccgtcgccgtcatcaacggagaatctttaccggaatcattcaccggatgggtggattgttcctatgacgcaaggacagtttggtagttacgagacgggtttggtggcgaagtcgatgctctcgaattcaacgtcgtcgacgtcatcatctttgacgtcgacgttttctttgccggagagtgttaacggaggaggaggaggaggatgtgggagtattcagggagaaagaaggtataaagaaacggcgacgtttggaggagtggtagagtcaaatccaccaacaacaccgccttatccattttctctgtttcgaggtggcttttagcgtttagcttcacatgatatatgatctttag

SEQ ID NO: 4685 - DNA, 1002 bp, Artificial Sequence
  P15168 (35S::G2958)
gtgccacattgtctcatcactttccgcacttttgttgttaactaactttcataaatagattaagatattaatgtcaccggaggaatacgttagggtttggccggattccggtgatcttggaggaactgagctgaccctagctttgcctggcactccgacaaatgcatcggaaggtccaaaaaagttcgggaacaaacgtagattcctcgagaccgttgatttaaaactcggggaagcacacgagaacaattatatctcaagcatggtcactaagtacggcatatatatattatattaatttcatttatcgttcatataggtcatatgcatgtttgattgatcttcttaatttattgtggttttagtgaccagttggtgggctggccgccggtagcgacagcgaggaaaacagtgaggcggaaatacgtgaaagtggcgttggatggtgcggcctatctcagaaaggttgatcttgggatgtacgattgctatggacagcttttcaccgctctagaaaacatgtttcaggggataataacaatatgtaagtgatcgagataagtaggaaaaaataaagattttgatgtgtttggatggactgacgaagtgaaggatattatggtaaatttacttacacttggggttttggatggtggtaggtagagtgacagagttggagaggaagggagagtttgttgctacttacgaggataaggacggtgacttgatgttagtcggagatgtgccgtggatgtgagttctcggaattaccctttgtgttgcttttacgtacttttccttttttattcaaaactagaatttctgtactattttgttacttacattcatatcaaaactagaattactgtattattctgctgtgaaggaaactaaattttcttgggattgatgatatttaatttgtgtaggatgtttgtggaatcttgcaaacgtatgaggttaatgaaaaccggagatgctattggattataggtctctatt

SEQ ID NO: 4686 - DNA, 2269 bp, Artificial Sequence
  P15182 (35S::G2771)
tcaagctatgaacttccatactttgaatcttctacttctctttcttcctcttacttgatcttcctatagcatacttccatcatgtaagttcctttttgtatttttatttctcttacttgctaaagttttatcttcacattttttgatgattagggttttggtttgagattaggggtgaagatgatatagtggagctcttatggaacggccaagtcgttcgaaccagccaaccacaaagaccttcctcgggtaaaccttctcctactccacccattctgcgtggtagcggaagcggcagcggagaagaaaatgctccccttccacttccacttctacaacctccacgtcccctgcatcatcagaatctcttcattcgggaagaagaaatgtcttcttggcttcactattcttacactggtgtcacgtccacaccggctactcatccgcaaagttctgtttccctgccaccaccaccacccattgctccgtacatttccgttctttttcctttcattctcttactctttgcaatttgacgagtctgatattttagggtttggattttggtttgaaattaggagtgaagatgatgtggtggaactcttatggaaaagcggccaagtcgttcaaagcatccagacacagagacccattcctcctcccattttccgcggcagcggaagtgggggaggtgaagaaactgttctgcctctgcctcccctgcatccgtctcatcaaaatatcttcatccaggaagacgaaatggcctcttggctttaccatcccctccgtcaagattatttttcctctggcgtcgcctctacttcagctactcgcccgcaaagttccgcctctctagcaccaacaccaccaccacccagtgttccctacggtcagattcccgttgagagaaggacagagaattttatgaacttcttgaggctaagagggaacatattttccggcggtagagttgaagctggtccggtggttatagaatcgacgcagataggctcaagcgcgaccccgtcgtcttcagccgctgaatcctgtgtaataccagcgactcacggcaccgagagtagagcggcggccattaccggagtatcccgtacttttgcagttcctggtcttggtcggaggggaaaggaggtggcaaccgagacggccggaacatcatattcaggggtaaacaaggccgaaacagagcgggttcaaatacaaccggagagggagacgaaaattaccgaagataagaagagagaagaaaccattgcagaaatccaagtgagtcacagctaccataggttcacctgttgacacgtgcagtgtagcagtcaaggcttaattttatcttgtttcttggcgtacagggaactgaagaagctcatggttcaacgtctaggaagaggtcacgagctgcagatatgcataacctctccgaaagggttcttatattttactttctaggttttaataatggactctttgtttcgtctctccattaaaacgtagtttgtataattgtttaacagagacggagggaaaggatcaacgagaggatgaaaactctgcaagaactccttcctcgctgcagaaaggtctctctcagttatttataacctgtggctgttaaacataaaaaaagttagattctgatgacatctgtttctattctgatcagactgataaagtttcaatgcttgaagatgttatcgagtacgtgaaatcgctacagctgcaaatacaggcatgtactcaaaaactgaatgtgtgttaaagcaaaacacaaccggaaattaagtgctgtggaatagttgaacatggttatttgagtgctatggaatggttatactctttgtttatcaaccagcgtctctgcattttaaacaaccaattttttagatttgatttctgcagattcatcttggaagggttttaaagtgtcatggaagataaatgcaaatcttataagtcatgttcttgaggtcttactcttctgtattgcttcacacgtttacaggattatgttgaagaatctacagcttataactgagattttaatatatgaatcaatgttgttatgccagatgatgtcgatgggacatggtatgatgccaccgatgatgcatgaggggaatacgcaacagttcatgccccacatggccatggggatgaagggtatgaaccggcctcctcctttcgtaccgttccccggcaaaacttttcctaggccgggtcatatggcgggtgtaggtccatcatatcc

SEQ ID NO: 4687 - DNA, 998 bp, Artificial Sequence; identical to SEQ ID NO: 1713
  P15184 (35S::G2838)

SEQ ID NO: 4688 - DNA, 897 bp, Artificial Sequence
  P15228 (35S::G2779)
gtgtcaagaagatcatatctcaattcattatattatggcaaatttcgagaatctttcttctgattttcagacaatagccatggatatatattcttccataactcaagctgcagatctaaacaacaacaacagtaaccttcattttcaaacatttcatccttcctctacttctctcgaatcgctcttccttcatcatcatcaacaacaattacttcactttcccggaaactctccagacagtagtaacaatttctcttcaacttcaagtttcctccatagtgatcacaacatcgtcgatgagaccaagaagagaaaagctttgttacctactttgtcttcatcagagactagcggcgtctccgataatacgaatgttattgccactgaaacaggttctttgagaagaggtaagaggttgaagaagaagaaggaagaagaagacgagaaagagagagaagttgttcatgtgagagccagaagaggccaagccactgatagccacagcttagcagaacgggttcggcgagggaaaataaacgagagattaagatgcttgcaagatatggtgcccggatgttataaggctatgggaatggctacgatgcttgacgagataattaattatgtccagtctctacagaatcaagtcgagttcctctcgatgaaactcactgcagcaagttcgttttatgactttaactcagagacagatgcagttgattccatgcagagagcaaaggcacgtgagacagtggagatggggagacaaacaagagatgggagtcctgtcttccatttatcaacatggtccctttgacttttgttttctcttttctcttttccttcttttttattgttttcgaaattattcttctatttatttggatgcgatatgtc

SEQ ID NO: 4689 - DNA, 1471 bp, Artificial Sequence
  P15232 (35S::G3008)
gactaacataaacaatggtggaagtcgaagaattggaaccacttagtccaatggacgatgaagaagaagagataagctatgatgacctcaaaagacgcatgtggaaagaccgaaacctcatggaaaaaaagctcaagcaacagaaacgacacagcaacgacgtcgtttcgtttacaacacaccgagccgaagcttcacggcgcaagaagatggctcgttctcaagattcagtgttgaagtacatgatgaagatcatggaggtgtgtaaagctaaaggttttgtatacggaattgtaccggaaaagggtaaaccaataaccggttcttccgatagcttaagacgttggtggaaagaaaacgttcagttcgaccaaaacgctccagacgctatcacagattacttagcactcgcggctgctgctgctgcagcagagctaatcgataagtcctcatcatcctcgagcttattacacatgttacaggaactgcaagacacgacactagggtcgttactatcagcgttaatgcaacattgcatgccgccacagcggcggtttccgttagagaaaggaattgctccgccatggtggccgacggggacggagctttggtggggagaacaaggagcggcacatgagcacggtgcaccgccatatcgaaagccgcacgatttgagaaaatcttggaaagttagtgttctcgcggctgtgattaaacacatgtcgccgaatttgggaagagtgagacgtctggcgagacaatctaaaagtttgcaagataaaatgatggctaaagagactgatacttggtctcgtgtcttaaaccaagaagaagctcttctcaatatcaaagacctcaagatctcggaagatcaggacgatcaagaatcgtcggggtctaagagaaaaagtgagtctatggaaccgtctaagagtgtttacacttgccaaaactcgagttgtcctaaaagtgatgtgagttttggattcggggacaagaactcgaggacgggtcatgagatccagtgtctttatgggtcgaaccaagaaccgagccagagcggtgaatatacatcttccttgcttgaaacggttccaagtattgttactaattcgactagtgaagatgattattacaatgtgagctcgcgtgcactggacaagcgagatgatgatgatcatagcattaatgggaattggatggaatatttctggttagaaaagatgcagcaggagtttcattgctctaggagattcgaagatgatgagggtactggaacggactttgaccaactcacagaatctgatcgatcggacaacgtgaatttgaaccaacttacaaaatctgatcgatcggacaacgtgaaccggagtgctttttcagtttgggacatgggttgcgaggacaaagacatatacatgttcgattaatagttaagctcgttaattagttgctatgctttacatgtacc

SEQ ID NO: 4690 - DNA, 1130 bp, Artificial Sequence
  P15243 (35S::G1412)
tggttgctgaggaatcgaagtagaagagtataaatgggtgttagagagaaagatccgttagcccagttgagtttgccaccaggttttagattttatccgacagatgaagagcttcttgttcagtatctatgtcggaaagttgcaggctatcatttctctctccaggtcatcggagacatcgatctctacaagttcgatccttgggatttgccaagtaaggctttgtttggagagaaggaatggtatttctttagcccaagagatcggaaatatccgaacgggtcaagacccaatagagtagccgggtcgggttattggaaagcaacgggtactgacaaaattatcacggcggatggtcgtcgtgtcgggattaaaaaagctctggtcttttacgccggaaaagctcccaaaggcactaaaaccaactggattatgcacgagtatcgcttaatagaacattctcgtagccatggaagctccaagttggatgattgggtgttgtgtcgaatttacaagaaaacatctggatctcagagacaagctgttactcctgttcaagcttgtcgtgaagagcatagcacgaatgggtcgtcatcgtcttcttcatcacagcttgacgacgttcttgattcgttcccggagataaaagaccagtcttttaatcttcctcggatgaattcgctcaggacgattcttaacgggaactttgattgggctagcttggcaggtcttaatccaattccagagctagctccgaccaatggattaccgagttacggtggttacgatgcgtttcgagcggcggaaggtgaggcggagagtgggcatgtgaatcggcagcagaactcgagcgggttgactcagagtttcgggtacagctcgagtgggtttggtgtttcgggtcaaacattcgagtttaggcaatgagagagatgtgaagttactgatgggtgaaaaaagtaaaaaaaaaacttggagatagtagagtggcaattgatgtaaataatagggatttatatggggcttttaccgattcggtgaggcttaggattccacaaaggaaaaaggctcgactggggactagtttgatccaacttgacggcccccaaatgtgtaatgtttctcaacgg

SEQ ID NO: 4691 - DNA, 778 bp, Artificial Sequence
  P15260 (35S::G153)
tcgctcaattggttttggtgttagtcttttggggagagagatggggagagggaagatagttatacgaaggatcgataactctacaagtagacaagtgactttctccaagagaaggagtggtttgcttaagaaagctaaagagttatcgatcctttgtgatgcagaagttggtgttatcatattctctagcaccggaaagctctacgactacgcaagcaattcaagtatgaaaacaatcattgagcggtacaacagagtaaaagaggagcagcatcaacttctgaatcatgcctcagagataaagttttggcaaagagaggttgcaagtttgcagcagcagctccaatatctacaagaatgccacaggaaactagtgggagaggaactttctggaatgaatgctaacgacctacaaaaccttgaagaccagctagtaacaagtctaaaaggtgttcgtctcaaaaaggatcaacttatgacaaatgaaatcagagaacttaatcgtaagggacaaatcatccaaaaagagaatcacgagctacaaaatattgtagatataatgcgtaaggaaaatattaaattgcaaaagaaggttcatggaagaacaaatgcgattgaaggcaattcaagtgtagatccaataagcaatggaaccacaacatatgcaccaccgcaacttcaactcatacaactacaaccagctcctagagaaaaatcaatcagactagggctacaactttcctagcaaaacatgtgggacatcgaacaatatgcggcc

SEQ ID NO: 4692 - DNA, 954 bp, Artificial Sequence; identical to SEQ ID NO: 4612
  P15277 (35S::G2999)

SEQ ID NO: 4693 - DNA, 2568 bp, Artificial Sequence
  P15340 (35S::G1341)
ttcagacagagagtgagtacttgaagaaatgggttgttgtcagtcaagaatagatagcaaagagatagtgtctcgttgtaaagcaaggaagagatacttgaaacatcttgttaaagctagacaaactctctctgtttctcacgcgctttatctccgttctctacgcgccgttggctcttcccttgttcacttctcttccaaagagactcctcttcacctccaccacaaccctccgtctccttctcctcctcctccaccgccgccgcgccctcctcctcctcctctaagccctggctctgaaaccaccacatggaccaccaccactacttcctctgttcttcctcctcctccgccgccaccacctcctcctcctccgccttcttctacatgggacttctgggatccgtttataccgccgcctccttcttcctctgaggaagaatgggaggaagagacaaccaccgcgacaagaaccgcaacaggaactggctctgatgctgctgtgacgacggctccgacgacagctactcctcaagcttcgtctgttgtgagtggattctctaaagatacaatgacgacgacgacgactggaagtgagctagcagttgtggtgtcgaggaatggtaaagatctaatggagattattaaagaagtcgatgaatatttccttaaagctgcagattctggtgcacctctctcttctctccttgaaatctcaacctctatcactgacttttctggtcattccaaatcaggtaacaacaatcaagctcttgtcttctcttctttgattgattttgattagtgttttgtgtttgtttcttcagggaaaatgtacagtagtagtaactacgaatgtaatctgaatccgacgtcgttttggacaaggggatttgctccttctaagttgagtgaatacagaaacgcaggaggagtaattggaggaaattgcattgttggtagccattcatctacagtggacagactctatgcttgggagaagaaactttatcaagaggtcaaggtattcactttttgacttcatttcattcataaagttgcaatctttgaacaaaacaattaatctttgatgtatcttcatatgttaagttttgtggaaagagtttgaaaatgttgtttatattcagtttgaagtttgaatattgaaattgcttgcttagatttcatccaaatatggataaatgttttgtttttgggaatttggttgattcatgtgggcattaaaggcttgtggtgggtccaagcgtgagcagatagtgtaagagacccacgtgtgtacttaattctgatgaataatgtgttatgtacactggcacaaatatcttgccaagtagtgagtgagtgtttgttgttttttgaatgtgggttttgttgcagtatgcagagagcataaagatggatcatgagaagaaagtggagcaagtgaggaggcttgagatgaagagagctgagtatgtcaagactgagaaggctaagaaagacgtcgagaagttagaatctcagctctcagtatcttcacaagccatccaaagcgcctctaacgagatcatcaagctcagagagaccgagctttaccctcagcttgtcgagcttgttaaagggtttgttttgtgcattcccattgcttcattaacctaaagtatcttatgttggtcaatgtgaacaaggttcttgtatgaatgtaatgtaggctaatgtgtatgtggaggagtatgtacgagagccaccaggttcaaacccatattgtgcagcagcttaagtaccttaacaccatcccctccactgaaccaacatctgagcttcaccgacaatcaactcttcagcttgagctcgaggtccaacaatggcatcactctttctgcaacttggtcaaggcccaacgtgactacatacaatctctcacgggctggctcaggttaagtctgttccagttcagcaagaatccacttgttaggagtagctacgagtcaaagatctacagcttctgcgaggaatggcatttagctattgacaggatccctgataaagtagcatctgaagggatcaaaagctttctgacagcagtccatggaattgtggctcaacaagccgacgagcataagcaaaagaagagaacagaatccatgttaaaagatttcgagaagaaatcggcttcgctgagagcgcttgagagcaagtatagtccatactcggtacctgagagtaggaaaaagaacccggtgatagagaagagagtaaaggttgagatgctaaaaggaaaagcagaagaagagaaaagtaagcatgagaagtcagtgagtgtgactagagccatgactctaaataacttgcagatgggtttccctcatgtctttcaggcaatggttgggttttcaagtgtgtgtatgcaagcctttgagtctgtgtacaaccaagctaagagcatcggtgaggatcaagaggaggttaagaggttgcttccttaaagagagaaagacaaattgttttaccatttgctctctgtttttgcttgatccaagctaatcttttggttgaatgttaggttga

SEQ ID NO: 4694 - DNA, 2632 bp, Artificial Sequence
  P15341 (35S::G15)
ggtgtgttcgttgtgtaaccaatgattgggttttagcttactacttcgagagattataagaaagaaagagtgaagatacattatagaaagaagagaagcagaaaccaaaaaaagaaaccatgaagtctttttgtgataatgatgataataatcatagcaacacgactaatttgttagggttctcattgtcttcaaatatgatgaaaatgggaggtagaggaggtagagaagctatttactcatcttcaacttcttcagctgcaacttcttcttcttctgttccacctcaacttgttgttggtgacaacactagcaactttggtgtttgctatggatctaacccaaatggaggaatctattctcacatgtctgtgatgccactcagatctgatggttctctttgcttaatggaagctctcaacagatcttctcactcgaatcaccatcaaggtcagtagtagtaatgttggagtttttagttttcttggtgttgatgttgttgtgtcttgtttgatgggaacatgtttggttttagggatttatgttttattttttatactaaggacattttctgttttttttggttgttatttagattcatctccaaaggtggaggatttctttgggacccatcacaacaacacaagtcacaaagaagccatggatcttagcttagatagtttattctacaacaccactcatgagcccaacacgactacaaactttcaagagttctttagcttccctcaaaccagaaaccatgaggaagaaactagaaattacgggaatgaccctagtttgacacatggagggtcttttaatgtaggggtatatggggaatttcaacagtcactgagcttatccatgagccctgggtcacaatctagctgcatcactggctctcaccaccaccaacaaaaccaaaaccaaaaccaccaaagccaaaaccaccagcagatctctgaagctcttgtggagacaagcgttgggtttgagacgacgacaatggcggctgcgaagaagaagaggggacaagaggatgttgtagttgttggtcagaaacagattgttcatagaaaatctatcgatacttttggacaacgaacttctcaataccgaggcgttacaaggttgtttttttattttataatattaaactttgtttgactttcgttagtaatgttacatatacttacttaaaaggttatgtgaaacagacatagatggactggtagatatgaagctcatctatgggacaatagtttcaagaaggaaggtcacagtagaaaaggaagacaaggtctagtgcttttttatttaattatcattaagctaaacatagaaactttttaagtagtttatgatttaacgtattactgacatttgagttttattttcttgttttctctatgtgtgataatgatttgatgatcttcttctcagtttatctgggtaagtacacacttcaatcttcatggattcatgatttccccctcaaatttctcgggaaaataatgatggattttgacttctttatttttgtttgattaaatctttattaggaggttatgatatggaggagaaagctgctcgagcatatgatcttgctgcactcaagtactggggtccctctactcacaccaatttctctgtaaatcatcttttctaaactttatgtctctttgaccttgttgtatgatttatttatataatatgataatggatatttgaaggcggagaattatcagaaagagattgaagacatgaagaacatgactagacaagaatatgttgcacatttgagaaggaagagcagtggtttctctaggggtgcttccatctatagaggagtcacaaggtccttttaaattacatttatataactttatataatacatagtttaataatgtgaatattgactttgtgtgagttttttgtactagacatcaccagcatggaaggtggcaagcacggattggtagagtcgctggaaacaaagatctctaccttggaacttttggtaattcatcatgccgatgattttgattgttaaaacttaacattttcaattgcttgtgtcttacgaaatcttttgacactatcataggaacccaagaagaagctgcagaagcttacgatgtagcagcaattaagttccgtggcacaaatgctgtgactaactttgatatcacgaggtacgatgttgatcgtatcatgtctagtaacacactcttgtctggagagttagcgcgaaggaacaacaacagcattgtcgtcaggaatactgaagaccaaaccgctctaaatgctgttgtggaaggtggttccaacaaagaagtcagtactcccgagagactcttgagttttccggcgattttcgcgttgcctcaagttaatcaaaagatgttcggatcaaatatgggcggaaatatgagtccttggacatcaaaccctaatgctgagcttaagaccgtcgctcttactttgcctcagatgccggttttcgctgcttgggctgattcttgatcaacttcaatgactaactctggttttcttggtttagttgctaagtgttttggtttatctccggttttatccggtttgaactacaattcggtttagtttcgtcgg

SEQ ID NO: 4695 - DNA, 640 bp, Artificial Sequence
  P15343 (35S::G1718)
gtttgtttgcgatggcgacagaacaagaagctgaagttggaacagagacatcctctgtttccggaaggtttttgaggaacagagatttatatctcttcttgccttttctcttaggcttctctgatcaagaatcatcaaacggagatgatgatgatgttgcttcatcgcgtgagagaatcattttagtcaacccttttacacaaggaatgattgtgctcgaaggctcatcaggaatgaatcctctgcttcgtagcttactggagtcacgtgaggaaggtcgtcctcctgcgtccaaggcttccatcgatgcgatgccgatcgttgagattgatggctgtgaaggagagtgtgtgatctgtttggaggagtggaagtccgaggagacggtgaaggagatgccgtgtaagcataggtttcacggtggatgtatagagaaatggttagggtttcatgggtcgtgtcctgtttgtaggtacgagatgcctgttgatggagatgagattgggaagaaaagaaacgatgggaatgagatttgggttaggttcagtttcaacgatggtcggagaattagagatttttctgcgcaggacggtggaaacagtgatggtgttgagtccgagaattaggatttacataagaa

SEQ ID NO: 4696 - DNA, 1228 bp, Artificial Sequence; identical to SEQ ID NO: 1441
  P15351 (35S::G2239)

SEQ ID NO: 4697 - DNA, 1175 bp, Artificial Sequence
  P15354 (35S::G2404)
aagtcgacaagaacacaatgccagtttctgcagagccttcttcatcttcttcaacaacaatcggtcaacacatgagactccaacgacctaggaatcatcgaaatctcccacccatttccaccgccgacgaacctctaatccccaaacctagccgcgtctctaaatccgccatgtcttccttcttcctcttgccagaaactactaagaagaaacccaacggaacggcgtcgtttcgtggtctaggctgcacaacctccgcatctcagcaagtttcagtcccggcagtgattcgctcctccgcggattgggatgctagtaatttcaaaattaagaagacgaagaagaagaacaagaacaagggtagtagtagctacaatggtggttcgattaagatcttgagcgaagctagtactagtagtagcgtcgcttgcgcagcgattcctgatgtttggtgtggtcctggagttgggttttcaacggatgctgtcgtcggaggctccattgacacagttgtttcagatcctccgagaaggaatattccggtgagacgcaaaatcgatggagataaaaccaatagtaacagtaataatcatagagagggttcttcttctcttcttcctagacgatctctcaatcaagagtctaatccttattttgattctgattcgagttttttgacatcgcgggctgagcagactgatagatatcatcgtcatctaagactgccttaccctgatggactcgctgagatgatgatgatgcagaatggttttgtgatgggaggagtattaagctcattcgatcaattccgtgacatgaggctcaatgtcgataacatgacatacgagcaacttttggagcttggtgaaagaattgggcatgtgaacactggacttactgaaaaacagatcaaaagttgtcttcggaaagtcaaaccatgccggcaagatacaacagttgctgatagaaagtgcatcatctgtcaagacgagtatgaggcgaaggacgaggtaggggaattacgatgtgggcacaggttccatatcgactgtgtgaatcaatggcttgtgaggaagaactcttgtccggtctgtaaaacgatggcgtacaataagtcttagttagatattatctcttcctgtgatgtgattcttgatttcggcggccgctttccc

SEQ ID NO: 4698 - DNA, 868 bp, Artificial Sequence
  P15364 (35S::G2997)
tcttaactctcatgaattattggtctctctattatagttttttaagtaacaatctaattgtagtacggatgtctcttgagatgttcaagaattaagaaataaagaaagagggatcggagaatgaattttgaggatcaagaagaagatatggagatgtcaggtgttaatcccccctgcggttacgactctctaagcggtgagggagccacatctagtggtggtggaggagtaggaaggagtaaaggagttggagcgaagataaggtatagagagtgcttgaagaaccatgctgttaacataggtggccacgccgtggacggttgttgcgagtttatgccttccggtgaagatggaacgctcgacgctcttaagtgtgcagcttgcggctgccaccgcaacttccaccgcaaggaaaccgaaagcatcggcggtagagcccacagagttcccacgtactacaaccgcccgccgcagccgcatcagccgcctggatatcttcatctaacatctcccgcggcgccttacaggccacccgcggcatcgggggacgaggaggatacatcaaatcctagcagcagcggcgggaccacgaagaggtttagaacgaagttcacggcggaacagaaagagaagatgttagcctttgcggagaggttggggtggagaattcagaagcatgatgacgtggcggttgagcagttctgtgcggagactggtgttaggagacaagtgcttaaaatctggatgcataacaacaagaactctcttggtaagaaaccctaattttgctcgagacatgatttaaaacactagaggatcataattgtttctttttttggtatgactcttctgtaactacttctgctta

SEQ ID NO: 4699 - DNA, 1381 bp, Artificial Sequence
  P15367 (35S::G372)
atgcagaattcataaacaccgctctggaattttactttttaggataacaaaggagggtcattttatctgttaattgatgggtgaagagatatctagcactgtgaacctggatttgaatctgggtcctgatcctgagttaggtctcgagccagcgacgaattatgctcggtctgattggggtaatggacttgctgctagggaatccgaatctctgagaaggtttagaagtcggtaccggtcacgtttcagacggattgatatgcttccggttcttgctgagacacatagcccggcgatggaattgagtcagttgttgatcacttctggaaatgtagttgctttgcctgctggtgagggaagcatggctagtggagaaagggtcatcgaggactccaaaaagtgcgagaatgggagcaaagtgatggcagaagacaatgtaacagaggagaaaagagatgttgagaagagcgttggcagcgatgggagctttttcgattgttatatatgtttggatttgtccaaggatccagttgttactaattgtggccacctttactgttggtcttgcctttaccagtggctacaggtttcagaggcaaaagaatgcccggtttgtaaaggggaggtatctgtgaaaacagtgactccaatctatggacgtgggatacagaaaagagaatctgaggaggtttcaaacaccaagatcccttcgagaccccaagcacgacgcacagagagtttgaggactacacttaacaggtcaggtcatataccaacggaaatatttagacatttgcaggataggcttgaaagggaatctagtacaggagaaagacgcgccagaccatctcttaaccggtttatgacttcgaggggagttagagcagaggagaaccagtctagtgaagcactggttgaaccttcatcagatgagattaacgatattgatctgatcttaaataatgcccctgaaaatgaagaggaaaacgaaaacctaagctcgtcacgtgctttggcaacccagagacgatgggcacagatgtatgggagggtgtcgtcgtttactttgagctctgctgaaagattagcggatacttatttgataacacatgcattggggaggaaccaagaacaaaacagcagtcctcctgttggtgttgaagacagggattcgttctcaagcatagtaggtgtgataaactcggagagtcaagttgaaacggcggctgagattaattcaatgttgactgtatcgacttcttcgtctgttagaagacatgagaacagttcaagggtctctgatgttgacagtgcagattctcgtccactgaggagaagaaggagattagcttagaagagaatggaggagaagaaagaggaa

SEQ ID NO: 4700 - DNA, 1142 bp, Artificial Sequence
  P15372 (35S::G1327)
gatatagtgaaggtagctatagagaagaaagtagtgtaataagaatggggaaaggaagagcaccatgctgcgacaagaacaaagtgaagagagggccatggagccctcaagaagatctcactctcatcacttttattcaaaaacatggccatcaaaactggagatctcttcccaagcttgctggttagtatttattcacatgcatgtttcggtaatactataaagttttaaataactaagagaaataatgattgatatatatacataggattgttgagatgtgggaaaagttgccgactaagatggataaactatctgagaccggacgtgaagcgaggcaactttagcaaaaaggaggaagatgctatcattcactaccatcaaacccttggaaacaagtttgtactctacctattcatctaatttctttataataagacaatatatagtatgtagagactaattgatatatgtgatcatcaggtggtcaaagatcgcgtccttcttgccgggaagaactgacaacgagatcaaaaacgtgtggaacacgcatctcaagaaacgactcactccatcttcttcttcttcatccctctctagcactcatgaccaaagcacaaaagcagatcatgacaagaactgtgacggggctcaagaagaaatacattcagggttaaatgagagccaaaactcagctacttcgtcacatcaccaaggcgagtgtatgcacacaaaaccagagcttcatgaggttaatggactcaacgagatccagttcctgctcgaccatgatgactttgatgatataacctctgagtttcttcaggataacgatatcttatttccgctagactctcttcttcataaccaccaaactcacatttcaacccaagaaatgactcgagaggtaaccaaatcgcaatcatttgatcatcctcaaccggatatcccatgcggatttgaagacacaaacgaagaatccgacttgaggagacagctggttgaatcaaccacacctaacaatgagtacgacgagtggttcaacttcattgacaaccaaacttactttgatgattttaatttcgtcggagaagtatgtctatgaatgtcaataatatatgcatgaccagtgttgtatccac

SEQ ID NO: 4701 - DNA, 1720 bp, Artificial Sequence
  P15377 (35S::G2536)
ttattcaagaagcaaatttgtaacacaccaaaaaatgggagaagagctttctgtagggtttcggttctatccgaccgaagtagagctccttacgtattacctaagaatccagcttggtggaggaaatgccaccattcatagtctcataccgatcctcgatgtgtttagcgttgagcctactcagcttccaagtacgtatgcaatcattagctatataaataatgtcgatgatatatttgtcgtatatatgtgtagtctttcactgtagagttttccttcttgcgtttcttgagtagagtaacgtgactaacgttatcttgagattgtatgcatgagatttaggtttgtgtttcttgatttcgtggttaattataagttacaaaaaaaaactttacaaacaatcacatttctaaaattaaacaatttcattttcgacaaagtttaactttacatgtaattaaggaaaacgtatacacataaactgaggatttacacaaaaaaaattgagaggtgtgttattggtttgtgtgtttttttgtttgtagatcttgcgggagagaggtgtcgaggagatgcagaacaatggattttctttgtgccaagacaagagcgtgaagctagaggaggcagaccaagtaggaccactggttcaggatactggaaagcaactggttcacctggacccgtgttctcgccggataaccgagtgatcggagtaaagaagacgatggttttctataccggaaaagcacctactgggagaaagacaaagtggaagatgaatgaatataaagcagttgaaacagccagtgtatctaccatcccaaaggtgcataatcacttctttaaaatgaagactttcatcaaataatttttctcaaatataccaaattctatttgtgggattccaatataaaaataactgatgtctcaacacctttttggacaagcatgtgcagtgaactagcagaataatctttaatacaattattacaaacagagattattaaaaacgaatcaccctttgattcatgtcaaaaatctttatcatggttattttatatctcacatatataatcttgtcttacatatatcgttgttttcaaaagttatatatgtggtaaaagagtgtgcgaaaaattacatgtgtttttaagtatttgaaactatccaattaaatatcatgcatacataaatgataaaaaccaaaatattcatgcatgcattcttttgtctattggttatatattagagttatagaatttctaccatccctattagggattccctaagatgcataatgttataatatctaagttactgataatattttagtaaaacaatagttaagctttcattatcaaaacaggttctaacgaagtttgttcctattcaatatagttgaggcccgaattcagtatctgtcgaatctacataaagtcaggaagctcgagagcctttgacagacgtcccacagaagcttatgcgatagagagaaatcttcctagcaatggagttgagacatcatctcgtgccacaatatcaacctcaccagaaacttcacattcaggaggaaaccaagttgatttaccggtgaatgctactactattacacaaagcatctcagatatggttgatgagctatcgcaacctttttgggagtgggaacaaatgaattggtcttaaacgtattaatttacttcttatgttcatttgttac

SEQ ID NO: 4702 - DNA, 4053 bp, Artificial Sequence
  P15431 (35S::G2768)
gctacacgcgtggagtttccttctgtgaagtcgaatcagcgaagtaaaaattgaatctttagggttttcttagtttgtatttacctttttgttttggaaatcaaatctctggcctcgtttttttttttaataatccggaggccttgattagggttttcaaaatctagtagctttgtgtcatgatctttataagataagtaatagatatatgtatttttttgctttttatatcagatacaaattttcaatggcaatttattacaagtttaagagtgcaagggattatgataccattgccatggatggtccttttatatccgtcggtattctcaaagacaaaattttcgaaactaagcatttgggcactggtaaagaccttgatattgtcgtctccaatgcccaaactaacgaaggtttgtcttctatgtcaaatgttgtgctgcgcttttcgtattattagactgtttgcttgcagctgtgatacaatgaactttattttatgttatgattgtttactagctgagctttgtcttattttttttttacttttgtgaactattaggaaatggtttgttggaatatgattcttgaatttctcaggaagctttagtgtactgtgtctcgtgccaatatgattgcaatctgtggcctttatatgttctctgttttgaattttcagagtatctggatgaagcaatgttaatcccaaagaatacatctgtccttattcgtcgggttcctggacgtcctcgcatcacagttattaccacacaagagtactttctcagatctttagtttctatattctttgtctacttatttagctattaaacttaaatagacatgatattaaaagcattgcattttactggtgcatcgttttagctaaacataagttaattgtctgactatcggatttaagaaacttcgggatcctcaatgatgcaaatatcttaactttgcaggcctagaatccagaataaagtggaagacgttcaggctgaaaccaccaattttcctgttgctgatccatctgctgctgaatttgtaagttgattatagtgaacttttctcggcttctgttggcattgactgcacctaattttcttctactacaaaagtactaatgtcatccgtattcacctcttagcctgaagatgagtatgacgagtttgggactgatctttattccattcctgatacccaagatgcccagcatattattccacgtcctcatcttgcaaccgcagacgacaaagtagatgaagaaagcaaaattcaggcgctgattgacactccagcacttgactggcaacaacggtaagcaatcttccagaaatggtgcaggtgaaactgttggattttgtgagaaggtttaacagacctcttatatttattcaatgtaacagacaaggtcaagatacttttggagctggtagaggttatgggaggggtatgcctggaaggatgaatggacgtggttttggtaacttatacttacttttattctttgattttggttgaattctggaatgtcaaaatacagtatacaaaacatttacttctgtcaaaatattttatatttttgttctatttgctcaagttgtaagatacttagtttggttttgctggctggataggaatggaaaggaaaacgccacctccaggttatgtgtgccatcgttgcaatatccctggtatgtcagctctgaaaatctttatttttctctcacttttgtagatggatatataatagataagaagtgttgagagcattttctttgctgtctcaggacattttattcagcattgccccacaaatggagaccctaactatgatgttaagagagttaagccacctactggtatccccaagtccatgttgatggcgaccccagatggttcttattccttgccaagtggcgcagttgcagttctgaaaccaaatgagtaagttgtactgaattagtttgggaatgttgctattgggtacttcttcacatatattgattatagtttaaatgtttgttgtgtcttcaacaaattcagggatgcttttgagaaggaaatggagggattgccatcaacaacacgttctgtaggagaacttccacctgagctaaaatgcccattatgcaaagaagtgatgaaagatgctgcgcttacaagcaaatgttgttacaagagcttctgtgacaagtgtaagttcttttaatgcattctgctgttccacaaaaaccttttctgaccgttgtcagttccagttctacattattatcctttttcactgattcaggtatcagagatcacattatttcaaagtcaatgtgtgtttgtggaagatcagatgtacttgctgacgaccttctaccaaacaagaccctcagggataccataaaccgtattttggaagctggaaacgatagcactgagaatgtgggcagcgttggccatatcccaggtccgtcattattttaaattcatgtgtttttaaactttgtttgattagtcctcactactgaattatcatggacaatatagatttggagtctgcacgctgtccacctcccaaggctctatctcctactacatctgttgcatctaaaggcgagaagaaaccagtacttagtaacaataatgatgcttcaactttaaaggcgccaatggaagttgcagagatcacaagtgcccctcgtgcatctgcagaagtgaatgtagaaaagccagttgatgcatgtgaaagcactcaagggtccgtgattgtgaaagaagcaacagtgtcaaagttgaatacgcaagcccccaaggaagaaatgcagcagcaggttgctgctggagagccaggtaaaataaagatgtactaatattagcttcactggacattgcgaatgattggtgactgatagtccagttcagatttccctactgagattaatcaagctggacctcacatgaaccttttttttttcaattactgaggaacccttgttgtcattcatcaatgtaatacgtacttattgtctctatacaggaaaaaagaagaaaaagaaaccaagagtgcctgggaatggtaaaagctttctttgctacgctgaaggcaatacattgtcagtttcgaagtctatgtgaatcgaatgggaggtctaaaagatggtttgtttatgtgatttattgcagacatgcaatggaatcctgtgccagatctagcaggccctgactatatgatgcaaatgggaccaggtccgcagtacttcaacggcatgcaacctggcttcaatggcgtacaaccaggcttcaacggtgttcaacctggcttcaatggctttcaccctggcttcaatggatttggaggcccgtttccaggcgcaatgcctccatttatgggttacggattaaacccaatggacatgggatttggtgggggtatgaatatgatgcatccagatccattcatggcacaaggatttgggttccctaatataccaccaccccataggtaaaacactcactctatcaaagaagagcaataaagctttctcaacaagtctcatgatggaactttctgtgcatgcgcagggacctagctgaaatgggaaaccgaatgaatctccaacgtgctatgatgggcagagatgaagccgaagcccgaaacgctgagatgttaagaaaacgtgaaaacgagagacgacctgaagggtaaaaagaaaacactcactctatttttactacagattcaaacaaggatatgctaaaacctaaacattggttgttgtttggttgtatatacagtgggaagatgtttagggatggagagaatagcagaatgatgatgaacaacggtacttcagcctctgcatcatccatcaaccctaataaatctgtatgtctccttttgtttgactcatcttcccctctcgctctctctttcttcttttctttgttcacctgtgcttcgctctctcccatttacttttggttatatgttattattatatcagaaaatggctccaaattctcttccctgattccctcattttgcttattttgaaaacc

SEQ ID NO: 4703 - DNA, 561 bp, Artificial Sequence; identical to SEQ ID NO: 1525
  P15446 (35S::G2459)

SEQ ID NO: 4704 - DNA, 906 bp, Artificial Sequence
  P15453 (35S::G145)
aagaaaatgggaagagggagagtagaattgaagaggatagagaacaagatcaataggcaagtgacgtttgcaaagagaaggaatggtcttttgaagaaagcatacgagctttcagttctatgtgatgcagaagttgctctcatcatcttctcaaatagaggaaagctgtacgagttttgcagtagttcgagcatgcttcggacactggagaggtaccaaaagtgtaactatggagcaccagaacccaatgtgccttcaagagaggccttagcagaacttagtagccagcaggagtatctcaagcttaaggagcgttatgacgccttacagagaacccaaaggaatctgttgggagaagatcttggacctctaagtacaaaggagcttgagtcacttgagagacagcttgattcttccttgaagcagatcagagctctcaggacacagtttatgcttgaccagctcaacgatcttcagagtaaggaacgcatgctgactgagacaaataaaactctaagactaaggttagctgatgggtatcagatgccactccagctgaaccctaaccaagaagaggttgatcactacggtcgtcatcatcatcaacaacaacaacactcccaagctttcttccagcctttggaatgtgaacccattcttcagatcgggtatcaggggcaacaagatggaatgggagcaggaccaagtgtgaataattacatgttgggttggttaccttatgacaccaactctatttgaatctttctcacttaatcaatccctctcttttttttttgacatttttaagatgatgtttctattttattacctctctcatgttttctgtcttgtgtgcatgtgtgtgtgtaatgtttatgcccttctattattcaatgatttctcgac

SEQ ID NO: 4705 - DNA, 4045 bp, Artificial Sequence
  P15454 (35S::G2570)
gaggtttgtgcaacctaaatagttcatccatacttgagagaagaaaaaaaactctttgcaaagattattagaatggcttctgctcaatctttctacaaccaaagctctgtcttgaaaatcaatgtcatggttgtggacgatgatcatgttttccttgatatcatgtcacgcatgcttcaacactccaaatacagaggtaattaaatattattatcatattatatataatatgttattgattttttgtttgtgatttcatttagatttttatttctatgatttcttagcatgaaatacaatttttggagaaacaactagcagttttaaaaacaaaacttgaattttgagaaattcaaagatgttatatatatatgtcaaaatttaacaattattcttctaaatcatccggattccgtttacatgtacacatctacaattttcaattgaggtattcttgttttgatgcctttgagacgaatagtttgattgataaaaaaaattctaaccaatatgatatataaagtttattttctttttgtcaaaccatactttatactatgtaacttttttaagagattattgaaaatagtttatttataaaatagtaacctattgttgaattaaaaaaaaaaaaaaaattgtaaatcgtgtttgcaaacgacatgtgatttatcttagtttaaaactagctgatattcttcaaatcgactgttcttataagtaatcaaccaattagcatcaatcacaataaattgtaaacacttcaatgaaaatggtgattttaaagaatatgttttacttatgttatgaactatctcaaatttgtgaaatatttcataactaatgtggaaaactatataacccctccatacaaaacgtaagtaaaatttatgaaatcctatcatttttaaaggttaaaccaatcaaaaagtaataattcttggtacttgcaatatttttgtcattatattttagtttattaattttattttgattaaatggttttagatccatcagttatggagatcgcagttatagctgtagacgatccgaagaaagcattatctactctaaaaattcaacgagacaatatagatctcataatcacagattattatatgcctggtatgaacggtttacaactcaaaaaacaaatcactcaggaatttggaaatttaccggtcttaggtaacattttttgttctttacaacttaaattaaattatgatatttattcttttgttatagtgaaagatatatttatccgtttgtttccccttacattgtttttgatataaagttatgtcatcggacaccaacaaagaagaggagagtttaagttgtggagcgatgggtttcattccaaaacccatacatcctactgacttaacaaagatttaccagtttgctttaagcaacaagaggaacggtaagtcaacactatcgaccgagcaaaaccacaaggacgcagatgttagtgtccctcagcaaatcacgttggttcctgagcaagctgacgtcttaaagaccaagaggaagaactgctcatttaaatcggattcaagaaccgtgaacagtacaaatggaagttgtgttagtacggatggttcaagaaaaaatcgaaaaagaaaacccaacggtggtcctagtgatgatggcgagtctatgtcgcaacccgcgaaaaagaaaaagattcagtggacggattctcttcacgacctattcttacaggctatccgacatattggtcttgatagtaagtgttttgattttcttaaaaaaaacgatatatatatagtacatgatacactgtttgttttcttacaattcaggtcacctgcacactaactaatgttttatgtttgtttactaatcttccaaagaggcggtgccaaaaaagatcctagcgttcatgagcgtaccatacttgacaagagagaacgtagccagccatttacaggtttgatatctcttgtcaaaaatgtttttggattttactgtttaaaatgggaaaaagttggaaaaacctctattaactcgaatcaaacaaataaactttatatcttattaagcacaaaaatcttccaagtttgagttgatttgtcgatttcaacctatccttagtcaacattaagagctcgttataacaccctttaacttaaacttggggacttttttcctccactttaaatacatcataccatgcatagattatgtgtcattctacttgttatttaacttaaattcatttgctatgttatgcagaaatatcggatattcttgagaagagttgcggagcagggtttgtatagcatgttgtcggatagaggcatagactcgatgtttcgacaaactcacattaaggagccgtacttcaactattacacaccatctacttcttggtatgacacaaggcttaacaatagatcattctattccaaacccgtacatggctttggacagtctaaactcttgtccacaacacgtgagcccgtctgcttcaaccagatgccttacaactacatgaaccggtcatccacctatgagccgcaccgtattggatctggatcaaacttgacgctgcccatccagagcaacctcagtttcccaaaccaaccatctcaaaacgaagaaagaagaagctttttcgaaccacccgtgatggcaaacaaaatcgcccaaacatctcaagttcttgggtttggacaacttggaccgtcagctatcagtggtcataatttcaacaataacatgacgagtagatatggaagtttgattccgagccaaccgggacctagccacttctcctatgggatgcaatcgttcttaaacaatgagaacgtaacatataaccctcagccacctgccaatgcaactacacagccaaatcttgatgaacttcctcaactggagaatctcaacttatacaatgatttcggcaacactagtgagcttccttacaacataagtaactttcaattcgatgacaacaaggtatattttcccaaccctaatcttacaatgatatatatatgtatattgaagtaggtgctgtgagatatgtgtttaaataatcggtttgtgcagcatcaacaaggagaagcggatcccaccaaatttgagctcccagctgcaaaattttcgactgaactgaatcatgaagacgatggtgactggaccttcgtgaacataaaccaggtatttacaatttattaagagatcttagcaataacaaaaatcgaatttgagccaacgttctatcaaagattagattttatcaaattaatgttttataaaactatccaccatggaaattttctaactagacttgttagtattagacatttagtagatttgcaaagtttttcatgctgctagctagtcttgtaattagatagaaatcggcatctgttaatgtcttattgacttacatgacttggttgtgaagggtcaatctaatggagaaacatcgaacactattgcttctccggagactaatactccaattttgaacattaaccataatcagaatcaggtacctctaattcatatcagtcagaatatttatatgaaactatgatacttaatatataaaagaaatatttgtttaaatctattctgaaacctggactcggtttttttagggacaagatgttccagagtttaacgattggtcgtttttggatccacaggtaaacgatataatgtttacaagaacttacataaattatttgtatatagtttaactttgaagtttatgagtctttgaaacaagttttggtgaattgtttcttatataggaattggttgatgacgacttcatgaactctctgttcaacaatgacatgaattgaaaaggattctcctctccatgatgttctcaaaaaggaggtgggaagaaataaattcggcgatacctaatagttctttaagcaaatatctatatagctttagtagttctttaagcagaatacttagttagcctttctaagtattggatgttatgtctttttttcagcaagcgtaatgagtgttggtcctgttg

SEQ ID NO: 4706 - DNA, 2143 bp, Artificial Sequence
  P15458 (35S::G1017)
gaatttgggggttacacaacttcgtctagatggagcaagagaaaagcttggatccacaactatggcatgcttgtgcaggatcaatggttcaaatcccttcactgaattcaacggttttttacttcgctcaaggccacacagagcacgctcacgcgcctcctgattttcacgcgccgcgcgttccacctcttatcctctgtcgtgtcgtctccgtgaagttcctcgccgacgctgaaacagacgaagtttttgctaaaattacgcttttgccacttccgggaaacgacttggatctagaaaacgacgccgttttgggtctaactcctccttcttctgacggtaacggtaacggtaaagagaaaccggcgtctttcgctaaaacgttaacgcagtctgacgctaataacggcggtggtttctccgttccacgttattgcgccgagacgattttcccgcggcttgattactcggcggagccaccggttcaaaccgtgattgctaaagacatccacggcgagacttggaaattccggcatatttacagaggaacacctcgccgtcatctcctaaccaccggttggagcactttcgttaaccagaagaaactaatcgccggagactcaatcgtcttcctccgttctgaatccggtgacctctgcgtcggaatccgccgcgctaaacgcggcggtctcggatctaacgcaggatccgacaatccttaccctggattctccggtttcctccgtgacgacgagtcaacaacaacaacatcgaagctaatgatgatgaaacgcaacggaaacaacgacggaaacgccgcggctacagggagggttagagtagaagcagtagcggaagcggtggcgcgtgcagcgtgtggacaagcgtttgaggttgtttattatccacgcgctagtacaccggagttttgcgtaaaagcagctgatgttagatcagcaatgaggataagatggtgtagtggtatgcgttttaaaatggcgtttgaaacagaggattcttctagaatcagttggtttatgggtactgtctccgccgttcaagtcgctgatccaattcgttggcctaattcaccatggcgtctccttcaggtagcttgggacgaaccggatttgttacaaaacgttaagcgggttagtccgtggttagtcgaattggtatcgaacatgcctacaatacatttatctccattctctccgaggaagaagattaggattccgcagccatttgagtttccattccacggtactaaattcccgattttctccccgggattcgccaacaatggcggtggcgagtccatgtgttatctgtcaaacgacaacaataatgctcctgcaggaatacagggagccaggcaagctcaacaactcttcggatcaccatctccgtctttgttgtctgatctcaatcttagtagttacaccggtaacaacaagttacattctccggcgatgtttctatcgagtttcaacccgaggcatcatcattatcaggctagggatagtgagaatagtaataacatttcgtgttctttaactatggggaatcctgctatggttcaggataagaagaagtctgttggttcggttaagactcatcagttcgtgttgttcggtcaaccgattttaaccgaacagcaagttatgaaccgaaaacggtttttggaagaagaggcggaagcggaggaggagaaaggtttagtggctcgtgggttaacatggaattatagtttgcaaggacttgagacgggtcattgtaaagttttcatggaatctgaggatgttggacgcacactcgatctctcggttattggctcgtaccaagaattgtaccggaaattggctgagatgtttcatatagaagagaggtcggatttgttgactcatgttgtgtaccgggatgcaaatggtgttatcaaacgtattggagacgaacctttcagtgatttcatgaaagcaactaaacggctaacaatcaagatggatattggtggcgacaacgtgagaaagacgtggataaccggaatcaggactggtgaaaatggtatagacgcttctacgaagactggtccgctcagcatcttcgcttgaacttgaagcatattgaggaataagcagtggcc

SEQ ID NO: 4707 - DNA, 2525 bp, Artificial Sequence
  P15470 (35S::G707)
tctcatccatggcggatttcttctatcttcattaaatatttccctctttattaaaatctcatgaatttcaacggttttctcgacgacggtgctggagcctcaaagctactctctgatgctccgtacaacaaccacttctctttctccgccgtagacaccatgctcggaagcgccgccattgctccttctcagtctcttcctttctcttcttcaggcctctctctcggactccaaacaaatggagaaatgagtagaaacggagagattatggagtcaaacgtaagtcgtaagagtagtagaggagaagatgtagaaagcagatctgaaagtgataacgctgaagctgtctccggtgacgatttagatacctccgatagacctttaaagaagaagaaacgttaccatcgtcacactcctaaacaaattcaagacctcgaatcggtttttaaagagtgtgcacatccagacgagaagcaacgtcttgatcttagccgtcgacttaacttagatcctcgtcaagtcaagttctggttccagaatcgtcgtactcagatgaagactcaaatcgaacgacatgagaatgctttgttgaggcaagagaacgataagcttcgagctgagaatatgtctgtacgcgaagctatgagaaaccctatgtgtggtaattgcggcggacctgccgttatcggtgagatctcaatggaagagcaacatctgagaattgaaaactctcgtctcaaagatgagttagaccgagtctgtgccttaaccggtaagtttcttggccggtctaatggttcacatcatataccggactcagcacttgttctcggcgttggtgttggttctggtggatgtaatgttggtggtggtttcactctctcttctccgctgttgcctcaagcttctcctagatttgagatttctaatggaaccggttctggtttggtggctacggttaaccgtcaacaaccggttagtgttagtgattttgatcagagatcgaggtatttggatttagctcttgcggctatggatgagcttgtgaagatggctcagacacgtgagccgctctgggttcgaagctcggattctggttttgaagtgctgaaccaggaagagtacgacacaagtttctctcggtgtgttggaccaaaacaagatgggtttgtctcagaagcttctaaagaagctggaactgttatcatcaatagcttagcgctcgttgaaaccttaatggactcggaacggtgggcggaaatgtttcctagtatggtctcaagaacttcaaccacagagattatctctagtggcatgggagggcgaaatggtgcacttcacctgatgcacgcagagcttcaactgctgtctccactcgtgccggttagacaagtgtcgttcttgcggttctgtaaacagcacgcggaaggtgtttgggcagtcgtggatgtctcaattgattccattagagaaggttcttcttcgagctgtagaagattaccatccggttgcctcgtacaagacatggccaatggctactcaaaggtaacatggatcgagcacacggagtatgacgaaaaccacatccaccgtttataccgcccattactcaggtgcggtctagcgtttggtgcgcatcgatggatggctgcattacaacgtcaatgcgaatgcctcacgattctcatgtcctccactgtttccacttccactaatccatcccctataaactgcaatgggagaaaaagcatgctaaagctagcgaagaggatgactgataatttctgtggaggggtttgtgcttcgtcgttacagaaatggagcaaactcaacgttggcaacgtcgacgaagacgttaggataatgactaggaagagtgtaaacaatcctggcgagccgcctgggataattctaaatgcggcgacgtcagtttggatgccggtatctccgaggcggttgtttgacttccttggaaacgaacggcttagatcggaatgggatatcttatccaacggtggaccaatgaaagagatggcccatatagctaaaggccatgaccgttccaactccgtctccctcctccgtgccagcgcgataaatgcgaatcagagtagtatgctgatattacaagagacaagcatagacgctgcaggagcggttgtcgtgtacgcgcctgttgatatcccagcaatgcaagctgtgatgaacggtggagattctgcttacgtggcactccttccttcaggattcgccattctccctaacggtcaggctggtacgcaacgctgcgccgcagaggaacgtaacagtattggtaacggtgggtgcatggaggaaggagggtcgttactaacggtggcgtttcagatactggtgaatagtttgcctacggctaagctaacggtggaatctgtggagacggttaataatttgatatcgtgcaccgttcagaagattaaagctgctcttcattgtgatagcacctgatcatcgagatcagacgatggaggagattgagtcaagaa

SEQ ID NO: 4708 - DNA, 855 bp, Artificial Sequence
  P15472 (35S::G2616)
ggagagaggagaaggcaaagtggtgaaagaggagatggagcaagagagcctaaacggtaggtatggtagtagagtaatgacggatgaacaaatggagactcttcgtaagcaaatcgccatttacgccgttctttgcgaccagctcgtcttcctccacaactctctctcttctgtccctcttctttcatcaggtacgtacactactccataattgtatttggaagaaacttaagggtcacgtaactgaatttgtatggtaatgattatgagaaaatacaataggaatgaatccaatgagaggtgagtattttgatccaatggtggcatcgtcaagcgctcatggaatgtcgactcggcctcgatggactcctacgacaacgcaacttcagattcttgagaacatttacaaggaaggcagtggaacaccaaatccgcggaggattaaagagatcacgatggaactgtctgaacatggacaaatcatggagaaaaatgtataccattggtttcaaaaccgacgagctcggtccaaacgaaagcaacctccgacaacgacaattacctcgagtcaggcggatgatgcggccgtgacaacaactgaggagagagggaggtgtggagatgattctggagggtttgagtcttatgagcatatactgttcccgagtcctgatttaggtaacctcttactatatgatatttatgtgtctatgcatcgtattttggtttaattgagtcagagatgaaaaaatgtggtgaactttttgtggtttcagggattgagcatttgttgaatagggacaagtttatagactgagtgaaacaaagatgatgaactctccaacctctctgttt

SEQ ID NO: 4709 - DNA, 877 bp, Artificial Sequence
  P15479 (35S::G3094)
gcctgaccttgaccttactctctctatctcttccccgagaaaaccacctcccagtgtagataaccagaagaagataagccaagatggaatctggagaatttcctgcatggcttgaggttctgttaaaagacaagtttttcaacgcttgtttggatcatgaagatgataagaagaacgagaagaacatattatgtatcgattgttgtcttaccatctgtcctcactgtctctcttctcatacctctcatcgtcttcttcagataagaagatacgtgtatagagacgttttgagggttgaagatggttctaagctaatggattgctctttaattcagccatacacaacgaacagttcaaaagttgtgttcatcaatgaacggcctcagtctcgacaatttcgtggttccggtaacatttgtatcacctgtgaccggagtctccagtctccttacctcttctgctgtctctcctgcaagattagtgacgtcataatgagacaaagaggactctcagggtttctccgcgtctgcaacgttcttgatttaaccgacgaagtcacgacaacgacaccgagttccactctcgagcccaccgggtcgaaccgaacatcttccgagtcaagtggtaacgaaggagaagacatgttctggtgtcaggcgctcgcttgcaccgccactactgaaatcgttaggaagaaaagaagcagcttgtcgacgacttgcaggagagtcacggaggtggtttcaacgactaacacggaagctccggtgaactttttaaaccgtcggaagaatccgccgcaacgcgccccgctttattaactcgtgacgtttggcgaaatttggttggtccaagtggtaagtagaatgaatacacg

SEQ ID NO: 4710 - DNA, 2088 bp, Artificial Sequence
  P15481 (35S::G2565)
tgattgtgagttctcatattgcttctatgtaacactccttgtaaagctaaatagcccttttgtgctaagtctctgatatctattgttatcttctcaatactgcacttgttcaatgacacttgctagcgattttggttttccatccgctatatcttcatcttttacaattctagaagagagataccacaataactttcctaacactttgtgtgtttcatcaggacaggaatcgatgaataacaaccccgtcccctgtcaggtgtttcctctggtctctggtggtagttctggtgggaatttgttttcatcttcttccggattctgcaatggtgtctatgtttcatcttcctcccaggcacggccatctgtttctaccgtgccaagagacagaattactgttgctcacgtctctggtgaagggcagaggcaggaatgccctgtggaaacacattccttgcaattgatcaatcaacctcaagaacagaaaattatgacttggtcttcagaccagattcggggcttcttcgattttcctgttccagatccacaagcagcgagcagcagaactatggtttcatccaaggaagtgctttcaaaatgcgaatggccagactgggcggatcagttgatctctgatgatagtcttgaaccaaattggtcggagcttctaggtgatcctaatgtactcaatctatattcaaaggttcgtttctttcagctaaatatgaatctctacgcttatttcagctaaatatgattcttctattaagactgactctgataatgtcttacagatagaaacacagtcttctgatatagcaaggcaagagatcgtctttagaaatcagcatcaggtggatccatcaatggagccgtttaatgccaaaagcccaccagctagttcaatgacatctaagcaaagaatgcgttggacaccagaacttcatgaagcatttgtcgaagctatcaatcagctcggtggtagtgaacgtgcgtatgccctttttttttccttctcatgcctgcaaaatttagctgaacaacttattattattctcttggcttataatttcaaaccacaggagccacccctaaggctgttttgaagctcatcaatagccctgggttgaccgtttatcatgtcaaaagccatttgcaggttactattctccatctatgttttcggtttgtatgcttacagctcatcttaaacgtctttatattattggcttgtccagaaatacagaactgcaaggtataaaccagagctttccaaagatacaggtacttgaggcatctaaggattcaaactgtcttctcaatatttcacataagcttattatactttggaaacataatggcatttaaaagactcttgtgtgatgaaacacgtctttatacataatcagcttttcttcttggacagaagaacctctagtaaagaatttgaaaaccattgaagatatcaaatctcttgacttgaagacgtaaggaacattttacttctctgtcagaacagactaagtatcacctaggataatatttcttcatatctaagattttttttttttattcttcttcaggagcattgaaatcactgaagctctccggttacagatgaaagttcaaaaacaactccacgagcaacttgaggtataataattcaaactgcctaaaagaagcttttataaaacaaaacagtgtcctttcctcttcatttgtctgatttcttagtttttggttttagctggtgattttgatcttatattggtcttaatacaatgcagatccaaagatcactgcagttacaaatcgaagaacaaggtcggtatcttcagatgatgattgagaaacaacagaagatgcaagagaacaaaaaagactctacttcctcatcatcaatgccagaagctgacccttcagctccatcaccaaacctttcacaacctttcctccataaagcaaccaattcagaaccatcaataactcagaaactgcagaatggttctagcacaatggatcaaagtgaatctacttctgggactagtaatagaaaacgggttagagaagattagacatctcatgagt

SEQ ID NO: 4711 - DNA, 1468 bp, Artificial Sequence
  P15484 (35S::G253)
aaacaactgtccatataaaatgcttttgtatgcatccatggaaaatagcttaaaaatcaatataaacctaaaatatataattttaaataagttttctcaaaataatttttcataaatcttttcgaacataattatcatagttattctaattttcaaaataaagtttattttatagatactttgaggtattctttgatatacaaaattagatttggatggatccacttaaacaggtttttaaattaacatactctgatccgcatcaaagaatgcatagaacttatttttttggagcagataaatcttggattggatatcagatccctagtattttttttcaagcattatggatgacatcaattgctttgacttgctaaaacctaaaaagatatgtgtgcttttaaaagaaattcattctcctaggaattccatttttagaataaattagccatcaacctaatatcacacaccaacacatatatttgtatggatttgagattttgatacttcacattctgtagacaccgtcaaatgaggttcaagaagaaatcaattcattgaggtggaaacgttggacactttcagaggatttgaaactaaaagagcttgtggctgtgtatggtcctcaaaaatggccgcacattggaaagcaaatgcaaggcagatcaggttagaaatgtgctttcgtttttttttacttttttttccaaagattaatctttttcttcgtttttgtgtgttgaaggtaagtcttgtagatcaaggtggtataaccatttggatccaaggattaggaatgatgtttttagtgacgaggaagaaaaattgctaatcaaagcttacaacgaatggggttgcaaatggtctaagattgctaggcttttccctggaagaacagacagacaaatgcagagactatggcgattggtcatgaaaacaaaattggagaggccataaacttctactcatgaactaactgcaaatgacaaaatagaaggcgagagaaacattcaatgtttttttttcttttttttttgggtctctttgaactaacgacctcatagattctgtgttagggtttgtacgtgataaaagtacaaagatgccacaagaggaaaccactcacctcgaagctaagtatcgcaacgaaacaatgaattacttagctcatcaacgtcgcttctataacatccctaaaggtttcttggcaatgtccacaccgcctgtctccaactctcaaccatcatcatcatcatcatcaccatcattaccatccaaacccgaagatgcaaaggccaatatacccgcaaagtatatagactttctcgggttaggagattctgaaaagaaaaagaagaaactactatagaacttcttgattgtaaccttattacatataatgtggaatctgtaaaatatcaacataacaatgttgtatttttacaagcaataaaactcaatttgtgct

SEQ ID NO: 4712 - DNA, 1856 bp, Artificial Sequence
  P15486 (35S::G2802)
ctccaactctcgggatatgatcgaaagagctttgttattattatctttacaacttcacgcagacgcataagagagagagttgatcaaagatattcgagattgagatgaacaagagtaatcctgctggttcggtgactggttcggatataatagacgccaagatcgaagaacatcaactttgtggatccaagaagtgtcctagctgcggccacaagctcgaaggcaaaccagtcatttgtaaatgttttttaaagaaaaaaaaaagaaaaagaggaaaagaatcaatgaagaacatcaagaatgatgctctctgttttattctatcgcttgcagcaattcaaaatccaaattttaaagcgtctatatacgagtctttatttgtatagttgtatatacttatattctcttgttctttttctttatattaattaagtttttgttttcccctctttttagcaggattgggttggtttaccagcaggagtgaaatttgacccaacggatcaagaattgatagaacatttagaagcgaaagtgttagctaaagacttcaaatctcaccctctcattgacgaattcatcccaaccattgaaggcgaagacggcatttgctacactcatcccgagaaacttcctggagtgactagagatggtttaagccgacacttctttcatagaccatcaaaggcgtacacgacgggaacaagaaagcgaagaaagattcaaacagaatgtgacaataatttgcaaggaagtagtagctccggtgagacgaggtggcataagaccggtaagacaagaccggttatggtaaacggtaagcaaaaaggttgtaagaagattttggttttgtataccaattttggtaagaatcgaaaaccggagaaaaccaattgggtaatgcatcaatatcatttggggacacatgaggaagagaaagaaggagaacttgttgtgtctaagatcttttatcaaactcagcctaggcaatgcaactggtcgtcttctacatcgagcttgaacgctataggtggtggcggcggtgaagcgagtagcggcggaggcggcggagagtatcatatgaggagagatagtgggactactagtggtgggagttgttcttcgtctagagaaattattaatgttaatcctccgaatcgatccgatgaaataggcggcgttggtggtggcgttatggccgtagcagctgcggctgcggcggttgcagctgggcttccgagttatgcaatggatcagctcagctttgttccgtttatgaaaagctttgatgaggtggcgaggagggaaactcctcagactgggcacgctacatgtgaggatgtaatggcagaacaacatcgtcatcgtcatcaaccatcatcatcaacatcacatcatatggctcatgatcatcaccatcatcatcatcaacaacaacaacaacggcatcatgcattcaacataagccagcctacacatccgatatcaaccattatttctccatctacttcgcttcaccatgcctccattaatattcttgacgataatccttatcatgttcatagaatcttgctccccaatgaaaattaccagacacaacagcaactacgtcaagaaggagaagaagaacataatgatgggaagatgggaggaaggtcagcttccggattggaagaactcataatgggctgcacttcttctaccactcatcatgatgtaaaagatgggtcatcatcaatggggaaccaacaagaagcagaatggttgaagtactcaacgttttggccagcccctgactcttctgacaaccaagatcatcatgggtaattgtgccattttccagtctgatgatcttg

SEQ ID NO: 4713 - DNA, 1149 bp, Artificial Sequence
  P15494 (35S::G2632)
agatcgtttcatcgtccaagcggaagaagcgtctccttcaatcaccgtggacacctccgagactgtctccgattgaatgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttgtaacttcccaatatagatatattgttcttatcatttcctttgggaaaattttagctatggttgcttacaatttagttttttcccggttatgaatcatgcagggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttataagagaagggaagaaggagagtgttcagggcagcaatggaacagcctttcctcaaaccatccttctcaagctcgtctagccattaaatgacctcacaaggcggcaattcattcttggctttctctttgttggcttattcggtagcagcc

SEQ ID NO: 4714 - DNA, 1121 bp, Artificial Sequence
  P15495 (35S::G2649)
cggagatgggcatggttggtctaagagatgtattccttgttgctccggcttatcaccaccagaacgccggagtgatatctggatccgatcatatgaacagtaatgcagctgcggcggcggcgctcggtgtcggagtgattcctctactcacggcgggtacaccgcagcaaaacgtggaagactccgacattaacttcctcggaaacaaccggagatggcagaataacaacaacaaccacgaaacgcagtatcttcacttcaagagtactaaccagacaacggtcggaacgagctcgaacaactcggggtctggctcaggcgcatcaggaaccgccacgtgtcaagactgtggaaatcaggcgaagaaagagtgtaagcagaggcggtgtaggacttgctgcaagagccgtggctttgattgttctactcacgtgaagagcacgtgggtctctgctgctcggcggagagagaggcaggtcatgcctaccggcgctaatccaacggctggctcgtctctttcgacctcctccgggacgaagaagccgaggatcgtagggtctcaacaacaacaacaacaacaagccacttctcatacttcaacttctaacacaccacctcaaagtttcgagaccagctccagccgacaagacggaggagggtcaagggaagcatggccagggcaggttagggcagcggcggtgttcaagtgtgttagagtaacggcagtggaggacggggatgatgagtacgcgtaccaagcggtggtgaaaatcggcggccatgtctttaaaggattcttgtacgatcaagggcttgaaccaaaagaaggttttcctagtatgtcggatttgcatttaggtggttcagccaataaccataacggagtttctgcctcggcgcctattctcgacccgcctaatgttgtttatggtggtggtggaggttcaggcggtgggttttacagttaaaccaaattcaagaaagtttactgttttaaagaaaagattttctctaatgtttttatccagtggggttagatacaaacgaatatttcactgttgtatgaattgtccatttggacaaactacttctaatgctgcaacagacgacgtatcgacaga

SEQ ID NO: 4715 - DNA, 525 bp, Artificial Sequence; identical to SEQ ID NO: 1021
  P15499 (35S::G1483)

SEQ ID NO: 4716 - DNA, 748 bp, Artificial Sequence
  P15502 (35S::G715)
ccgaccaatggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggttaagctcagagtattccagatgatgcttgacctgcttga

SEQ ID NO: 4717 - DNA, 648 bp, Artificial Sequence
  P15510 (35S::G1797)
actgaaatggtgagaggaaagatcgaaatcaagaagattgagaacgtgacaagtagacaagtcacgttttcgaagcgaaggagtggtctctttaagaaggctcatgagctttctgttctatgtgatgctcaagtggcagctatgatcttctctcagaaaggaagattatatgaattcgctagctccgatatcaggaacacgataaagcgatacgctgagtacaagagagagtattttgttgcagaaactcatcctatagagcaatacgtgcaggggctaaagaaggaaatggtgacaatggtgaaaaagattgaagtgcttgaagtccataaccggaagatgatgggacaaagtttggattcttgttcggtaaaagaactttcagagatagccacacagatagagaaaagccttcatatggttagattaagaaaggctaagttatatgaagatgagctacagaaactaaaagccaaggagagggaactcaaggacgagagagtcaggctttctctaaaggttggagaaagaccaatggggatgccgtcgggaagcaaagagaaagaggatgttgaaactgatctatttattggatttctgaagaaccgaccataaaatcgtccttggtcattaaacgtcatttctagc

SEQ ID NO: 4718 - DNA, 1368 bp, Artificial Sequence
  P15514 (35S::G3032)
gagggtaaatttgtgattccatctgcaaattattcctcctatatatatatagaacgtgatgaatcaaatttcttaagttgcaagccatgactaatcttgatgagtttcttgaagagctaagttctattgaatcacattctcagaaaatcgtgaagatagatgagcatttaaaaaagttggatgaagagacgaaagaagatgaagatgaagatgcggcgaagataattcaagatcggagtaccgcgagagaagcagaaattgctctacttatggatctccgtcagaactttcttccaccaccatcgatgtcatcctcctctcttcaaccaccgtcatcgtcaactctcgcaccatcgtcatcatcctctcttcaaccacccgcaccgttgatagacttctttcggtcatcagtgtcatactctcatcaaccaccgtcatcttcaactctcgcaacatcatcgtcaccgtctcttcaaccaccgtcgatgtcatcctcctctcttcaaccacccgcatctttgagggaattctttacgtcgtcagtgtcatactctcatcagccatcttcatcttcaactctcgcaacatcttcgttctttccgtcgtcaatgccatactctgttcgacctcccgattcgtctgatcgaccatctttgagggaattctttccgtcgtcaccatcatcctctattcagccacccgaatcatcatcatctaagcgagcacggcttagtaacatctttccgtcacctttatcctcctctccgtcaccgtttgttaacccgtttctccgtccgcaggcccaagaaccaacaataccaaatttcataaacccaataccacagatctctccaggcctacctgctctattcccaaaccctaaccctaatcctaaccctaacccaatcccaaacccaatccgaaacccagacttggtgtggacaaataggcttcaactagtgtttgatgacgcagttgtcagacttgggggattattcagtgcaacacccaaagccataaacgaactaatttctgaagagggtctcactggtgaccagatccgtagccacttacaagtcttgcgggatcgtcaaaaggctattgcagacaaattagccttggagtgaagaaaatattgaagatgagagataggattaaatagaaagagtgatagtatagaacgtttctttttcttttgttgttaatcttgcatattacaaacaattactatatcataatagaatttatgttaatgttggagttattaaaaaaaaaaaagttaaccataataacattcttactgtacgcatgagtgatcatttatcacaatctattagagcaaccccaatgggtgggatgatgacagtc

SEQ ID NO: 4719 - DNA, 916 bp, Artificial Sequence
  Artificial sequence
  P15518 (35S::G3091)
gggttggtcgactttgctaagataagcagaagagagactgactctctctctctctaactcttcattcttctctcttttaccttctctccaagaaatcttcactttctctctagaaaaaagttggaagctgactcgataaagactctctttttcttcttcttcctgcaaatggcgatcgaggatcaagagaacacaatccgtgaaatcaaacctaagaacagaagaatcatgggagctggtggtccggaggaagaggagaaccggtggccgccatggttgaaacctttgcttaaagagcaattctttgttcattgcaagtttcatggagactctcataagagtgaatgcaatatgtattgcttagactgcaccaatggcccactttgctctctttgtcttgctcatcacaaggatcatcgcaccattcagataaggagatcttcttatcatgatgttataagggtgaatgagatacaaaagtatcttgatataggtgggatccaaacctatgtgatcaatagtgctaaagtcgtcttcctgaatgagaggcctcagcctaggcctgggaaaggagtgaccaatacctgcaaggtttgctatcgtagcctcgttgatgatagcttccgcttctgctctcttggctgcaagattgctggaacatcaagaggctttgaaaagggaagggagaacctgctaatggaaacagaggattcaagtagcagcattgcaattgggaagaacattacaaatctccagagtttcagcccatcaacacctccacttactacatctagtaactgcagaatcgtcaagcgaagaaagggaattcctcaccgatctccaatgggataagaaccgagattacacacaggttttagctaatacagaggcttcttctgtctcttatctttcctcg

SEQ ID NO: 4720 - DNA, 1080 bp, Artificial Sequence
  P15520 (35S::G3095)
cgcctcctcccactaaactcaaatcctctcatagtcttttcaatcaaatctgctcttcttcactgttgaagctggctatcaaaactcacaataactatgggaccgatgatgatgagagcagaagaagataactacaatctaaatcctccaccatggctaatcccaatgctaagagcaaactacttcatcccttgttcaatccacgccgcttccaacaaaagcgagtgcaacatgttctgtcttgactgttcttctgaggccttttgctcttactgtttgctcaatcacagaaaccatcgtgtcctccagatacggagatcatcgtaccacaacgttgtgagagtaaacgagattcagaagtacatagacatatcttgtgttcagacatatataatcaacagcgcaaggatcgttttcttgaacgaacgtcctcagccaagaatcggcaaaggagtcaccaatacttgtgaaatctgttgcagaagccttctcgattctttccgtttctgctctctcggttgcaaacttggaggaatgaagcgtgatccaagtctaaccttctctttgagagggaagcatggaagagagtacgaaggtgagtgggaatctgatgaagcgactacaccaactaagatacgcaagacatgtgctttcaaccgtctgatgagtggtctttccatctccaccgttaaatgtgattacttgtcaggagatcaaccgtcttcgagctccggtgatgagagcggttttaaactttctccggggacaccgccgatatataatcaccggaattcaagtagacggaagggcgtcccacaccgtgctcctttctaaaattaatactaacggaagctaattatatagtgtagattatagaaaatgtggttgttatgttgtaactaaatggttagtagtttttaaccttttgagctaggaatatacatattgtaagacatattacttacaggtattgtttggtttttctttttatagtacatatagaaattaggtatatactgtactcaaagggattgaaatatgttttcatatagtttttttgctgtaaatatacgtttgaag

SEQ ID NO: 4721 - DNA, 1201 bp, Artificial Sequence
  P15531 (35S::G2979)
ttgctaagacaaatatccgaatctcagaaatttctcgtcctctttctctgttttttgtttctggggaaaatgtcttctgcgattgttgtttctcaagatgcggaatcgcttggtctgcaaatttatagccgcaaggagaaatctcttggggttctcgtctccaatttcctgagactgtataaccgagacgatgtggatctcattgggctcgatgatgccgctgggcaattaggagttgaaaggcggcgtatctatgatgtggtcaatatattggagagtattgggattgtggcaagaagagggaagaatcaatactcgtggaaaggttttggagagattcctcgttctctagatgaactcaaggaagaagggatgagagagaggttaggttactcaagttcaaacaattcagacaaggtttcaaatggttgtgaaagagaagaacctttaactttaacacctgatgatcaggagaactcatcatcctctaaaatggaccaaaagaaggaaaaatctctctggcttctcgcacagaattttgtgaagatgtttctatgttcctgatgatgatctcatcacacttgatagtgctgcaaaagccttgctgagcgactctccagattcagtccatatgcgaactaaagttagaagactttacgacattgcaaatgtatttgcctcgatgaatttaatcgagaagactcatataccagtgactaggaaaccagcatataggtggttagggtccaaaagcatagctgaaagaggattaagcttatttaattccggagaaccgaagcgggtatttggaacagagatcacaaacttgagggcaaagagaaacaaaacatattgttcatcaatccgcaagcaaattggatataagaaacatgacgaggaaaacacagagcaggaatcgaaaccagctgcaagtaaatatgtgtttggcccgttctccccaataggagcatctaagacgaacaacgacaaagtcggaaagggaaggttactagagatcgaggcccttgcttctacctaccaaccacagtattgcaatcaagaaataactggtcttcttgggcatttcacggaggcatggaagaaatggtatgcagaggttgatcggaataaataacattactgaggtcacatgttttctctgggtacatgagagcacataactcatccaacatatagcttt

SEQ ID NO: 4722 - DNA, 644 bp, Artificial Sequence
  P15538 (35S::G2559)
gataattcatggtgtgtgtgtatgaagatgctgttttggttagactcgagcaagataagaggatatctctaatcaaagcttgggaagaggctgagaaatccaaagtggagaacaagtgagtcctaaagaagtttatataatccattgttttgatgaatttccaaatttttagttccatgatatttttttttgtgttccctatatatttgtatgtaatctcatttattaactttatgaaacagagctcagaagaagatttcttcagttggagcttgggaaaacagcaagaaagcttctgtggaagctgagctaaaaaagatcgaggtaaaagtgtaattctttattctttcaattttgttgttttatttttaacttttacatgaaatgctttccacttttcacattattctaatttatccgctggaaatatgaatgataacaggagcaactaaataagaagaaagcacactacacagagcaaatgaagaacaagatagctcaaatccacaaggaagctgaggagaagagagcgatgaccgaagctaaacgcggagaagatgttctcaaagccgaagaaatggctgcaaagtaccgtgccaccggaactgctccaaccaagctatttggattcttctgatcggaga

SEQ ID NO: 4723 - DNA, 1283 bp, Artificial Sequence
  P15567 (35S::G1990)
ccgattgatcaattccaatattacgtcctttttttcttgaatctctctatatactcaatggaagcagctgcggaggctgtatcagccgctagggagcaatcattgatccttaaagggaaacggactaagcggcaacgtcctcagtccccaatccctttctctatcattcctcctatgtcttcgcatgaaccggatgctgaagaagagtctactagtcttgtttccaaggagaagagtctcaatgatgaaatcaacaacaataacatcaagaataataacaatactttgatcaatggtgttacatcttcatcttctgcctcttcatcttccaacaacaatgccacattaaaggccacggctgacgaagaagatcaagatatggctaattgtttgatcctcctcgcccaaggtcactctcttccccacctccaaccgcaaccgcacccccaacaacaaacaagacagcttatgatgagttaccaagattccggtaacaacaacaacaatgcgtatagatctagcagcaggaggtttctagagacatcttcatctaacgggaccacaacgaacggtggtggaggcagagccggttactatgtttaccagtgcaaaacatgtgaccggacttttccgtctttccaagctcttggtgggcatagagccagccacaagaagcctaaagccgctatgggtcttcactctaaccatgaccacaagaagtctaactacgatgacgccgtttctctccatctcaacaacgttctcaccacaactcctaacaacaatagtaaccatagatcgcttgtggtatacggcaaaggtagtaataataaggtccatgaatgtgggatatgtggagccgaattcacatccgggcaagcattaggtggtcacatgagacgccatagaggtgcagtggtagccgcagcagccgcctctaccgccaccgtatcggttgcggccattccggctactgcaaacacggctttgtcattgtcgccaatgtcgtttgatcagatgtcggagggtccaattcaggctcccgttaagagagcgaggagcgcggttgtgtcgttagatttagatctgaatctacctgccccggaagatgagaatcgggtcaacggattaagctttgcttcaaagcaagaacacgaacaagaacatgaacaaacacaacagaagaaacagagagaagaacaaaagtctcttgtcttgtcttctgctcctacattggtggattgccattactaaaatcaaaattcattaatacctaatcaaac

SEQ ID NO: 4724 - DNA, 1014 bp, Artificial Sequence
  P15568 (35S::G2639)
ggtcatatatggctggtggtatcggaaaatggcaggatttttctcgttaggacacggcggaggaggaaacactccagacaaccacagaacaaacactaataatccttcttcatcgggaacagaatcttggctttggtgcagaaaccctaactctaacgctgacggtggagaagctggtccttcttacaaaggaacccttgagctatggcaacacccaaacaatcaagaaatcattttccagcagcagcagcaacagcaacaaaggctggatctttacacttccgctgcgggtttaggtgttggaccgagcaaccggagcttaattgaaacttccggcggtgcgttgatgatgatgagaagcggtagcggtagcggcggaccaagctgccaggattgtgggaatcaatctaagaaagactgctctcacatgagatgtaggacttgctgcaagagccgtggccttgactgtcccactcacgtgaagagcacgtgggttcctgccgctaaacgccgagaacgccagcagcagctttctaccggtcagcaaccgcagcaactgggagggagcgtccctaaacgacagagagagcgtatcccggcgagatcgacttccatggcctacactcgtataccttctaacaacacttcagggttggaggttgggaattttccgccggaagttagctcgtcggcagtttttcggtgcgtgcgtgtgagttccgtagatgatgaagaagaagagtatgcatataaaacagctgtgagtataggcggtcacgtcttcaaaggtgttctctacgatcaaggcccggccgagagaagctcctcgggcggtggatctcagccgttgaatctcataaccgcaggcccatcggcctcatcatcaagcccaaacgtgagctgcaacaatggagtcgttggctccacttcagatcattatatcgatcctgcctcacttaattatcctactcccattaacactttcatgactggtacgcacttcttctccaactc

SEQ ID NO: 4725 - DNA, 2361 bp, Artificial Sequence
  P15569 (35S::G2334)
gcaaccaacacatttctctgtctgtctctctttctctctctctcactcactctctctttgttccatggacttgcaactgaaacaatggagaagtcagcagcagaatgagtcagaagaacaaggctctgctgcaactaagatatcaaactttttctttgatcagattcagtcccaaactgctacttctgctgctgcggctcctcttcctctctttgtccctgaacccacttcttcctcttctttctcttgcttctctcctgactcttctaattcttcttcttcttccaggttcctcagtaagttgttttaaaaggacaagacttattcactctaatgttgaagttgtttttgctgatatttaatctgacgtttctatgttacatatatatgtagagatgggaaacttcttcagctgggcacagtggcaagaacttgagctacaagcactgatctatagatacatgttggctggtgcttctgttcctcaagagcttctcttacctattaagaaaagtctcctccatcaatctcctatgcatttccttcaccatcctcttcaacatagttttcctcatcaccaaccttcttgtcagtctctctctcctctctattgtttatgcttctcttatccttgaaatagtctttctttgtaaaaaagattccctttgttttggtgttggagttatatttccaagatctaaaataagtataaggctgctctgcaaccttgcaaggagttaaaaccctatgtgtatgataagcctatttctagaagatctattagcaacatagatagaatcagacaagtacatttcgtaaccaatgtcttgagtgagatttatgtttgttgttactaatgaacaacacacacttaataaaaaacagggtattggggaagaggagcaatggatcctgagccagggaggtgtaagagaactgacggcaagaaatggagatgttcaagggatgttgtagcgggccacaagtattgtgaccgccacattcaccgtggaagaaaccgttcaagaaagcctgtggaaaccgccacaaccaccatcacaacgacagccacaacaaccgcatcttcttttgtcttaggtgaggagcttggtcatggaccaaacaacaaccacttcttctcctctggttcatctcaacctctccaccttagtcatcaacaaaggtacaataaaaaaacacaaacactctgtttaattaaagtcattagtagatttggttaattacaaatattgttgttagggaaatagtgatttcactgtgaagtaatgctgtgaagaaaggggtaatgttggcaatagggtgacaagagagacttatcatacatactttgtgataaaaacattattctttcttttgttgagagataatgataacagttggatttgatagaatctaattttatttactagttgggtgagacttttcaatcatagaaatagaaaagagagagaaagttaaagagatatgtatacttatgttgtatttgaaataatgacatggtaggacctcagtgaaagctgaccaaacctgcatagaagccaaacaaaataaagctctcagattctgcaaccacttcctcttattaacacacacatttgactgattaaattatttctctaaccattttgttgaattgatcagtctacttattattgttcaaatgttggatctttttgttgacaatgtttatgtttatgtttattcctctctgtcacagttgttcttcagagatgaaacaagaaagcaacaacaacaagaggccatatgaagctaacagtggattcagcaatggaagatcagacgatggtcacatcttgaggcatttctttgacgattggccacgatcatcagactctacctccagtccaatgagctcatccacttgtcatctttcaatctccatgcccggtaacaacacgtcctcagatgtttctctaaaactttccacaggcaatgaagaagaagaagagaacatgagaaataacaacaatgagagggagcaaatgaattggtggagcaatggagggaatcaccacaacaatatgggaggaccattagctgaggctttgaggtcagcttcttcgacgtcaagtgttcttcatcagatgggaatctctactcaagtttttcattaaagaaaagtgtttgtaatctttttggtttgtgctctttgaatctttattttctgcagaaaataatctttgaatttgtcttcttttggaattgtgagttctgcttttggaattgttttgttccttactctgctattatatttatgtttaaagcttgacaattttgtataagcaatgaaactaatatgatcctctgcctgcaagtaag

SEQ ID NO: 4726 - DNA, 2139 bp, Artificial Sequence
  P15573 (35S::G268)
cgctgatccttcacacgcaagctaatgaagcctctcactaatggcgatctgttcaaatccccaactctgatcaagatctccgccttagttttcgtcaccgtcgctttcttctacttaggcaagcattggtccgacgatggctaccaacagctcgtcttcttctcctcttccacttccggtagctcgatcccggaggtctccgtttcaccgaatagtaacagagtctttaatttatcagcgataattcctactaaccatacccagattgaaatccccgccacaatacgacaacaacctccgtcggtggtggcggacacggagaaggttaaggtggaagctaatcctcctcctcctccacctccttctccttcacctcctcctccgcctggtccggttaagagctttgggatagttgatgcgaacggtgtgatgtctgacgattttgaggtgggtgaggttgagagtgatacagtggaagattgggggaatcagactgagatcgttgaggcgaaaagcgacggtgattctaaggctagggttagaattaagaaatttgggatgtgtcctgagagtatgagagagtatataccttgtttggataatactgatgtgataaagaagcttaaatcgacagagcgaggtgagagattcgagcgtcattgtcctgagaaaggtaaaggcttgaattgcttagttccacctcctaaaggttaccgtcagccgattccatggcctaaaagccgtgacgaggtatggtttagcaatgttcctcatactcggcttgttgaagacaaaggaggtcagaactggatttcacgagacaagaacaagttcaagtttcctggaggtggtacacagtttattcatggggctgatcagtacttggaccagatgtctaagatggtttctgatattacgtttggcaagcatattagggttgctatggatgttggttgtggtgtggcgagttttggtgcttatctattgtctcgtgatgtcatgacaatgtctgttgcaccaaaagatgtccatgagaaccaaattcaatttgctcttgagcgtggtgtgcctgctatggcggcagcatttgcgacaaggcgtttgttatatccaagccaagcttttgatcttattcattgttcaagatgtagaatcaactggactcgtgatgatggaattttgctccttgagatcaatagaatgctgcgcgctggaggatattttgcttgggctgcacagcctgtttataagcatgaacccgctttggaagaacaatggacagaaatgctgaatcttactattagcctctgctggaaattggtaaagaaggaaggatacgttgcaatctggcagaagcctttcaacaacgactgctatttgagtcgtgaggctgggactaaacctcctctttgtgatgaatcagatgatcccgataatgtttggtacacaaatctgaaaccttgcatcagtcgcatacctgagaaagggtacggaggaaacgtccccttatggcctgcccgtctgcatactccacctgataggctgcagacgataaaatttgattcctacattgctaggaaagagctattcaaggcagaatcaaaatattggaatgaaataattgggggctatgttcgcgccttaaaatggaaaaagatgaaactaagaaatgttttggacatgagagcaggctttggcggatttgcagctgcactaaatgatcataaactcgattgctgggttctaagcgtggttcctgtcagtgggcctaacacattgcctgtcatttatgaccgtggactgttaggagtgatgcacgattggtgtgaaccatttgatacatacccacggacatatgacttcttacatgcctctggactcttctcgatcgagagaaaaagatgtgagatgtcaaccatattgttagagatggaccggatattaagacccggtggaagagcatacattagggattcaattgatgttatggatgaaattcaagaaatcacaaaggccatgggttggcatacttctctgcgtgacacatccgagggtcctcacgcaagttacaggattctaacatgcgagaagcgtctccttcgagcttaataccacacaagttactgcactagtcaacac

SEQ ID NO: 4727 - DNA, 3318 bp, Artificial Sequence
  P15595 (35S::G2907)
tcatcgtacggattcctatctctcactactcagatgcttccttcttcactttaatcacccttttcgattttcgttttccagctttttgattcctctgtttcaccaagtagacgaagtagaagaagaagaagaagaagaaagttttcacctttactctaaaagtttcactttttatgtctgctttgaagctctgagatcggagaaagcaatatctatggcggaagcaagacgattcagcccagttcatgaattagatgttggacaaatactctcagaagcacgacatcgatggcttcgtcctcctgaaatctgtgaaattttacagaattaccaaagatttcaaatttctactgagccacctactacaccatcaagtgggtctgtttttatgtttgatcgaaaggtgctcagatacttcaggaaagacggtcacaattggaggaagaaaaaagatggaaagactgtgaaggaagctcatgagaggttgaaggcgggaagcgttgatgttctacattgttactatgcgcatggacaggacaatgaaaactttcaaagacgcagttactggttgcttcaggaagaactttcccacatagtttttgttcactacctcgaagttaagggtagtagagtttctacttcttttaaccggatgcaaaggactgaagacgcggctcggtctcctcaagaaactggggacgccttgaccagtgaacatgatggttatgcttcttgcagcttcaatcaaaatgatcatagcaatcattcacaaactactgactcagcaagtgtcaatggttttcactctccagaacttgaagatgctgaatcagcatacaatcagcatggaagttccacagcttactctcatcaagaacttcagcagcctgcaacaggaggaaaccttactggttttgatccttactatcaaatctctttgacgcccagggatagttatcaaaaagagcttcgcacaatccccgtaactgattcttcaattatggtagacaaaagcaaaactatcaacagtcctggagtaacaaatgggttaaaaaacagaaaatccattgattcccaaacctgggaagagattctgggaaattgtggttctggagttgaagccttacctttgcagcctaacagtgagcatgaagtgctggaccaaatactcgaaagctcttttacaatgcaagattttgctagtctacaagagtccatggtcaaaagccagaatcaggagttaaattcaggacttacatctgatcgtaccgtgtggttccaaggacaagatatggagctaaatgctataagcaatctagcttcgaatgaaaaagctccatatctatctacgatgaaacaacatctgttacacggtgcattgggcgaagaaggtctgaaaaagatggacagtttcaatcgctggatgagcaaagaacttggagatgttggtgttatagctgatgcaaacgagtcctttactcaatcaagttcaagaacctactgggaagaagttgagagtgaggatgggtccaatggtcacaactctaggagggacatggatggatatgttatgagtccttccctctcaaaggaacagctctttagcatcaatgacttctctccaagctgggcttatgtgggttgtgaagtggtggtttttgtcactggaaaattcttaaagactcgggaggagactgaaattggcgagtggtcttgcatgtttgggcaaacagaagttccagcagatgttatatctaatggtattctccaatgtgttgctcctatgcatggggctggaagagttcccttttatgtaacatgttccaacagattggcatgcagtgaagtgcgtgaattcgagtataaggttgccgagtctcaagtttttgatagagaagcagatgatgagtctactattgacattcttgaggcaagatttgttaaactgttgtgctcgaaatctgaaaatacaagccctgtttctgggaatgacagtgatttgtcacaattgagcgagaagattagtttactacttttcgagaacgatgaccagttggatcagatgctcatgaatgaaatctcccaagaaaatatgaaaaacaaccttttgcaggaatttctgaaagaaagcttacactcatggcttttacaaaagatagcagaaggtggaaaaggtccaagtgttttggatgaaggtggccaaggtgtattacattttgcagcttctcttggttacaactgggccttagaaccaacaataatcgctggtgtaagcgttgattttcgcgatgtaaatggttggaccgcacttcattgggcagctttctttggcagggagaggataattggttcactcatagctcttggtgctgctcctggaactttaactgacccaaatccagatttcccatcaggaagcacaccttctgatctagcctatgctaatggtcacaaaggaattgctggttatctctcagaatatgccttaagagctcatgtttctttgctcagtctaaatgataaaaatgccgaaactgttgagatggctcctagcccatccagctcatcattgacagactcgttgacagctgtacgtaacgctactcaggcagcagctcggattcatcaggttttcagggctcagtctttccagaagaagcaactaaaagaatttggagataaaaagcttggaatgtcggaggagcgtgctctttcgatgcttgctcctaaaacacacaaatcaggaagggcacatagtgatgattccgtgcaagccgctgctattcggattcagaacaagttccgaggttacaagggaagaaaagactatttgattaccagacaaagaatcatcaaaatacaggctcatgtgagaggttatcagtttaggaaaaactacagaaagataatttggtcagtgggggtattagagaaggtgatattacgttggagacggaaaggagctggtttgcgcgggtttaagtcagaagcacttgttgagaagatgcaagacggaacagagaaagaagaagatgatgattttttcaaacaaggaagaaagcaaacagaggacaggctacaaaaagctcttgcaagagtgaaatccatggttcaatatcctgaagctagagatcaataccgtagattgctaaatgttgtcaacgacatccaagaaagcaaggttgaaaaagctcttgaaaattcagaagcaacttgttttgatgatgatgatgatctgatagatattgaagcattgttggaagatgatgacacattgatgttgcctatgtcctcatctttgtggaccagttaaatcac

SEQ ID NO: 4728 - DNA, 1069 bp, Artificial Sequence
  P15600 (35S::G2866)
cactgtctcatcattccaccattttctttaattaaaaaaaaaacatatcagaaagaccattccaatattattacttcttccttttaagctctaacaattaaataaaaatttccattctctatatataatacacacacgttcaaatcattaatcacctgttttagataaaatcatagagagagagaaatagtaaaagaaataaaaaaaaatgggaagagggagaagctcatcgtcttcatcgatagagagcagctgcaaaagcaacccatttggtgtgtcttcgagtaatactcggaacctaagcacggacctgagactcgggctcagcttcggatcatcttccggacaatattacaacggtggagataaccatgaatatgatggagtcggtgcggcagaggaaatgatgatcatggaagaagaagagcaaaacgagtgtaatagtgtcggaagcttctacgtgaaagtgaacatggaaggagttcctattgggagaaagatcgatcttttatctcttaatggatatcatgatttgatcacaactctcgactacatgttcaatgcttcaatcctttgtaagtatctacacacacttaattacatctttgcatgtagacttagttaatatttatatttgttatacctctctttgcatgtatatagttaagaccaaaactaatggcaataaaaaaattgtgaaaataggggctgaagaagaagatatgtgtagtgagaagagtcacgtgctaacgtacgcagacaaagaaggtgactggatgatggttggagatgttccttgggagtaagttcttttttaattttagtgtattaaaaatctctagttaagtattttttttgacataattatgtaaaaattccctttaattaatggggacttaattgattatgtaggatgttcttgtctagcgtgagaagactaaagatctcaagagcttatcactactgattttctaaaagcaaacttggaagaatctaggattgaccaatacagtcagtggtggtgggggaaaaagttagttttgtctgaatgtaaatcacttgttcgaga

SEQ ID NO: 4729 - DNA, 3257 bp, Artificial Sequence
  P15601 (35S::G2869)
tggtagcgagagaagttgaggaaagagagaaaattgtataataactgttgagataacatattttggtataccgatctttaggtacgagcttatggaaagtggcaacgttgtgaatacacaacctgaattatcaggcataagtaagaaattttgatttttttattttattgaaaacttgttttagttataatgttttgatttttgttcggcagttgatggatccaagagttatatgtacgagcagttatggaaactctgtgcgggacctttgtgtgatattccaaaacttggagaaaaggtttattactttcctcaaggccatatagagcttgtgagttctctctctctatattctttctctcttctttctctctctctctctctctctctctctctctctctctctctctctctctctctctctcctttctctctcttctctctcttctctctctcgcctctttctctctctctctctctctctctccttctctctcatgtatgaaaccttttgacggctttttcaggttgaggcatctacaagagaagagttgaatgagttacaaccaatttgtgattttccttctaagcttcaatgtcgtgttattgctattcaacttaaggtatatctctattatgttttagcgaatacgcatgatttttatagttgatctaattataaacagaaataattggttaattgtttgatgtttgattttaggtggaaaacaatagtgatgagacttatgctgagatcactttgatgccagatacaactgtaagtgaaaatttagtatttctcttttattttcagttaattctatttttctcctattatatctcattgattttctgattttgttaaatttttagcaagttgtaatccctactcagaatcaaaatcaatttaggccattagttaattcctttacgaaggttttaacggcctcagatacaagcgttcatggtggattctctgttccgaaaaaacatgccattgaatgtctccctccgctggtatttaattttatagttttttaaacgaatttgaattttaagctttcattagacattacatattaaattttggtttaggatatgtcacagcctctaccgacacaagaaattcttgctatagatcttcatggtaatcaatggagattcagacacatctatagaggtaataattccttttattatataattaaaacacagctattgaggtaataaatcctagagaagtaactaataatcttcttattccatgtaggtacagcgcaaagacatttgttaacaattggttggaatgcattcacaacatcaaaaaaattggttgaaggagatgttattgtattcgttaggtataatattggttcttctaatatatctttgtgttcttgagttttggactttaaactatatacttgtggttttaggggagagactggagagttacgagttggtatcagacgagcaggacatcaacaagggaatataccttcatcaatagtatcaatagaaagtatgagacatgggataattgcttctgcaaagcatgcttttgataaccaatgtatgttcattgtggtttacaagccaaggtaatttcaaagaaccatttgaactcacattttagattatattgatttatcaataaattagtttcttcaacatgtaggtttatattttgtgtctttataagtatcaggtcaagtcaatttattgtcagttacgacaaattcttagacgttgtgaacaataagttcaatgtcggttcaagatttacaatgcggtttgagggtgatgatttctctgaaagaaggtaacattagatgaaaaaaaaaattgcttaaatattttggtaatgtctaatattatctgtgataacacattttgttctatcgattaagatcttttgggacaattattggagttagtgatttctctcctcattggaagtgttcagagtggcgcagcttagaagtaaaatttcattcacactttataacattattttagaaatacgtttttgagtgcaataaatagcatatcactaattaactctaatgttgcaggtgcagtgggatgaatttgcatcatttccgagaccaaaccaagtttcaccatgggacatcgaacatttaacgccttggtcaaatgtttccaggtcatcttttctcaagaacaagcgttcacgagaagttaatgaaatcggtataaaaaaagacacttataatcttctatttaatgaatttaagattctttaataccttctcaatatacctattttatatacaggttcttcctcatcacatctcttgcctcctacattgacacaaggacaagaaattggacaacaaagcatggccaccccgatgaatatttctcttcgttatcgtgatattactgaagatgctatgactccttctagattgctaatgagctaccctgtccaaccaatggccaaactaaattacaataatgtggttacaccaatagaagaaaatataacaaccaatgcagtcgctagttttaggttgtttggagtctctctggccactccttcggtgatcaaagatcccgttgaacaaattggcttggagatttctagacttactcaggaaaaaaagtttggtcaaagccaaattttgagatcaccaacagagatccaaagcaagcagttcagttctaccagaacttgtaccaaagtaagtataagttcaatatattcttattctttatatatgaaattttttctcattatactcaactcacgcaatcttaatatggaataggttcaaatgcaaggtgtaacaataggaagagctgtggatttaagtgttcttaatggatatgatcagttaatactagaattggagaagctcttcgatctcaaaggccaattgcaagctcgcaaccaatgggaaatagctttcacaaataatgaagaggataagatgcttgttggagaagatccatggccgtaagttttctttctatttctatcgattgaaagattagttaaaatcttgagagacattgatatttcatttttttttttttcatgtagtgaattctgcaacatggtgaagaagatattcatatattcaaaagaggaggtcaaaaacttgaagtccaggaagagtctctcaagttgaattaagaatcaaaacatatgtaataaaaaggggtcgaaaatgttaccggtgtttgttctatttttatttttctcttatttggtgttgcatacatttgtg

SEQ ID NO: 4730 - DNA, 3008 bp, Artificial Sequence
  P15631 (35S::G1150)
ctctgtagctccttttcctctcagcagccatggaagaaaaaactcatcatcatcatcacagtaccaacaaacacatccctagttccaaatcaagaacacctcttctccacaagccttatcatcaccatgttcaaaccaatcctcctccttttcttttgcacccttcttctcaccaaaacctcaatcttgttgcctcaaatcttccttctagctactactactattactactgctacttctactctcaatttcacaactctcttcctcctcctcctcctcctcatcttcttcctctttctcctcctcttcctcctttacttcctcttcctcctcctcactcaatgacccgtttccacaaatctctccctgtttctcaagttgtggagagaaagcagcaacaccaacagaagaagaagatacaagtttctaacaacaaagtgagtggatccatagcaatagaagaagcagcattagtggttgctaaaagaccggactttggtggtcaagatggttctgtcatttatctcctcgccaaccattttcttgtcaagtttgattcgtcacagaggatttaccattacaatgttgagatatctccacagccttcaaaggaaattgctagaatgatcaaacagaagcttgttgagacagatcgtaatagcttctctggtgttgttccggcttttgacggcaggcaaaacatttacagccctgtggagtttcagggagataggcttgagttctttgttaatctccctatcccatcttgcaaggctgtgatgaattacggtgacttgcgtgagaagcaacctcagaagaagattgagaaactgtttagggttaatatgaagcttgtgtccaagtttgatggtaaagaacagagaaaggaaggagaggattgggctcctctgcctccagaatacattcatgctcttgatgttatcttgagagagaatccaatggagaagtgtacatcgatcggaagatcgttttactcgagttctatgggtggatctaaggagattggaggaggagctgttggactcagagggtttttccagagtcttagacatactcagcaaggtttagcacttaacatggatctctcaatcacagctttccatgaaagtattggagtaatagcttacttgcagaagcggctcgagtttcttacggaccttcctaggaacaaaggtagagaattgagtttagaggaaaagagagaagtggagaaagcacttaagaacataagagtctttgtttgccatagagaaacagttcaaaggtatcgagtttatgggttaacagaggaaattacggagaatatatggtttcctgatagagaagggaaatatctaaggcttatgagttacttcaaagatcattatggttatgagattcagttcaagaacttgccgtgtctgcaaatcagtagggcaagaccttgttaccttcctatggagctatgcatgatttgtggaggtcaaaagtttcttggaaagctatcagatgatcaagctgcaaagatcatgaaaatgggctgccaaaaacctaatgaaaggaaagctattattgatatggttatgacaggatcggtcggtccatcgagcggaaaccaaacaagagaattcaaccttgaggtttcaagagaaatgacattgctgaaaggaagaatacttcagccaccaaagcttaaacttgaccggccaaggaaccttaaagaaagtaaagtttttaaaggaactagaattgagagatgggctttgatgagtattggaggcagctctgatcagaaatctaccattcccaagttcataaacgagcttactcaaaagtgtgagcatttgggagtcttcttaagcaagaacacattaagcagtaccttctttgaaccatcacacatactcaacaacatttcgcttctcgaatcaaaactgaaggagattcaaagagcggcatcgaacaatctccagctgattatttgtgtaatggagaaaaaacataaagggtacggagatctaaagaggatatcagagacaagaattggtgttgtgacacaatgctgcttataccctaacatcactaagctcagttctcagttcgtttcgaacttagctctcaagataaacgccaagatcggtggatccatgaccgagctctacaactcgataccttctcacatccctagactgcttagacccgatgagccggttatcttcatgggagctgatgtaacgcatcctcatccattcgatgattgtagcccttcagtagcggctgtggtagggagcataaactggccagaagctaaccgatacgtctcaagaatgaggtctcagactcataggcaagagatcatacaagatcttgacttgatggtcaaggaacttcttgatgatttttacaaagcggtaaaaaagcttccgaatcgaatcatattcttcagggacggtgttagcgagacacagttcaagaaagttctccaagaagagcttcaatcgataaaaactgcttgttcgaagttccaagattacaatccaagcatcacattcgccgtggttcagaaaagacaccacacaaggctgttccggtgcgatccagaccatgagaacatacctcctggtacagtggttgatacagtgataactcatccgaaagagtttgatttttatctctgtagccatttaggagtgaagggcacgagcaggccaacgcattaccatattctatgggacgagaacgagttcacttcagacgaattgcagagacttgtgtataatttgtgttacactttcgtgaggtgcacgaaacctatatcgattgtgccaccggcttattatgctcaccttgctgcgtacagaggaaggctatacatcgagagatcatctgaatctaatggaggatccatgaatccttcttctgtgtctcgtgttggtcctccaaagacgattcctcttcctaaattaagtgataatgtcaagaatctcatgttttactgctgattcttt

SEQ ID NO: 4731 - DNA, 1389 bp, Artificial Sequence
  P15643 (35S::G2051)
ttcaacctcttgtctttaattttgttcaaagagggaatttgaaatcttgaaacccttatttagaaataaatttcgtgttcttgtttttctctgatatcataatctgttttttttttctcacttgttccttgagctttaagaaagacaactataggacttagggtttctgttttgtggaagtttcacactgttttcgacaagaaattttttaaatcaagatcaagaatacgactgagtaaatcatttgaagaaattatagataaagaaaatggtaggatcatttttaccacctggtttcagattttatccaacagatgaagaacttgtaggttattacctgcacagaagaaacgaagggcttgagatcgagctcgaaataatcccattaatggacttatacaagtttgatccttgggaacttccagagaaatccttcttgccaaatcgagatatggaatggtttttcttctgtcatcgcgacagaaaataccagaacggatctcgaataaacagagcaactaaatctggttattggaaagccactggcaaagatcgaaaaatcgtttgccactcttcttcttcttcatcatcttcctctatcaccggctgccgaaaaaccctagttttttatatgggtcgagctccttttggtggtagaaccgagtgggtaatgcatgagtatcgcctcttcgacaacgatacttcacaaggatcactaaacttcaagggagacttcgcgctgtgtcgtgtgataaagaggaatgagcatacgcttaagaaatgtgaaattatctcaccagaggtttcagatgagtcattaagcaataatgttaacaatttttgtcaagcaagtgacctagaaaagggttcttgtgatgcaagtaacacacgtttgtcttctcctgatttcatccttgaatcatcttttcagggaaattcacattcaaaaacagaagaagattccggtttccaagtatttacattacccgaattcgaatatccgctagaggtttttgcagatttgaatttcgatttggaaatggaggatccattcatgttcgattatcatccagagcctcatatgaacaatgaagtcatgagccatcacattcgtgggtaaagaaaaatattatagttcactagactgaatctcaaaaccaaacactcgagatggatcaagatctaactacaatcacatttattgaatatagatttgtttgtgtgtatagttgcatattataaaatgtaaagctacaagattctcttcagcatcaactagtagactagtagttatagatacgctttttaaagactttttaggtctcaaaagtatgtataatcaatgttgtatatctactaattacataaataaaagtgacctataaaaaa

SEQ ID NO: 4732 - DNA, 2750 bp, Artificial Sequence
  P15647 (35S::G386)
ttctgtgtgattcagttctcgatccatcttttcgtgaaaagtatcaatcttttaattctctagttgtttgtcaaatctggttagtttcttctcttgtatttatttgatgaacttcggtagtctcttcgataacacacccggtggtggctctaccggagcaagacttctctccggtttaagttatggcaaccacaccgccgcaactaacgtcttacccggtggtgctatggctcaagcggcagcggctgctagtctcttctctcctcctctaacgaaatctgtttacgcttcttctggcctctctctagccctcgtacgacgtcgtcttcctctactactaatacttatctttttatacttaaacctaatttgtgttttggataggagcaaccggagagaggaaccaaccgtggagaagcatcgatgaggaacaataataacgtcggaggaggaggcgatactttcgatgggagtgtgaacagaagaagccgagaagaagaacatgagagtagatctggtagtgataacgttgaaggtatctccggtgaagatcaagacgctgctgataagcctcctcggaagaaacgttatcaccgacacactcctcaacaaatccaagaactcgaatctatgttcaaagagtgtccgcatccagacgagaaacaaagattagaactaagtaagagactttgcttagagacaagacaagtcaagttctggttccagaatcgtcgcactcagatgaagactcaattagagaggcatgagaacgcgttattgagacaagagaacgataagttaagagctgagaacatgtctattcgtgaagcaatgaggaatccaatctgcaccaattgtggtggacctgccatgcttggtgatgtctctcttgaagaacatcatctccgtatcgaaaacgctcgtttaaaagacgagcttgatcgtgtctgtaacctcaccggtaagttccttggccaccaccataatcaccactacaactcctccttagaactcgctgtcggcaccaacaacaacggtggacatttcgctttccctcctgatttcggcggtggtggtggttgcttacctccgcagcagcagcagtcgacggtgattaatgggattgatcagaagtcagttttgctggagctggctttaactgctatggatgagttagtgaagcttgctcagagtgaagaaccgttatgggtcaaaagcttggacggtgagagagacgagcttaaccaagatgagtacatgagaacattttcatctactaaaccaaccggtttagctactgaagcttctagaacctctggtatggtcatcatcaatagcttagctctcgtcgagactttaatggactccaatcggtggacggagatgttcccgtgtaacgtcgcaagagctacaaccaccgacgttatatccggtgggatggctggaacaataaatggtgcacttcaactgatgaatgcagagctacaagttttgtctccactggttccggttcgtaatgttaatttcctccggttctgcaaacagcacgcggagggtgtgtgggcggtggtggatgtatcaattgatcctgtcagggaaaactctggtggtgccccggtaatccggcgactaccatcaggatgtgtggtgcaggatgtgtctaatggatactctaaggtcacgtgggtggagcatgcagaatacgacgagaaccaaatccaccagctgtacaggccgttgctacggtcaggccttggttttggctctcaaagatggctcgctacacttcagagacagtgcgagtgtctcgccatcctcatttcttcctccgttacatctcacgacaacacatcaataacgcctggtggtcgaaaaagcatgctgaagttagctcaacgcatgacgttcaacttctgttcgggaatctcggcgccgtcggtccacaattggagcaagctcactgttggaaatgttgacccggacgttcgagttatgacccgtaagagtgtggacgatccaggagagcctccggggattgttttgagtgctgccacttctgtttggctacctgctgcaccacagcgtctgtatgatttcttgcggaacgaacggatgagatgcgaatgggatattctatccaacggtggtcccatgcaggagatggcccatatcaccaaaggtcaagatcagggtgtctctctgctccgctccaatgcaatgaacgcgaatcagagtagtatgctaattcttcaggagacatgcattgacgcatctggagcgcttgtagtatacgcgcctgtcgacattcccgccatgcatgtggtgatgaacggtggtgattcatcctacgtggctctccttccgtccggtttcgctgttcttcctgacggaggcattgacggtggtgggtcaggtgatggtgaccagcgaccggttggtggtggatccctcttgacagtggcgtttcaaatccttgtaaacaatctcccaacggcaaaactcacggttgagtcggtggagactgtcaacaacctaatatcatgcaccgttcagaagattcggccgctttacaatgcgaaagctgatcttgatcaagactggcgcgtgcgtgtgtttcgcggccgctctagacaggcctcgtaccggatcctctagctagagctttcgttcgtatcatcggtttcgacaacgttcgtcaagttcaatgcatcagtttcattgcgcacacaccagaatcctactgagtttga

SEQ ID NO: 4733 - DNA, 976 bp, Artificial Sequence
  P15660 (35S::G1468)
caagaagacaccaaacccgttacttccactaaaaacaagggctttcttctttttaattcacaccaaaacactttgaacacacacatgcatggagccatgaactcaccatgcattgatttcgtaatgttcagtcgtggacaacacgatgaggacaacatgtcacgtcgtcctccgtggaagagggagagatcgatgtccactcagcatcatcatcttaacttgtctccaaacgaagacgaagagcttgccaactgtcttgtcttgttgtccaattcaggggatgcgcatggtggtgatcagcataaacaacatggacatggtaagggcaaaaccgtcaaaaagcaaaaaaccgcccaggttttccaatgcaaagcttgcaagaaggtgttcacgtcgcatcaggcattgggtggacacagggcaagccacaagaaagtgaagggttgttttgcctctcaagataaagaagaggaagaggaagaggaatacaaagaagacgacgacgacaacgacgaggacgaagatgaggaggaggatgaggaagacaaatcaacggctcatatcgcaagaaagagatccaacgctcacgaatgcaccatctgccatcgcgtcttctcttcgggacaggccttaggaggccacaagcgatgccattggctaacaccttccaattatcttcgtatgacgtcgctccacgatcatcatcattccgtcggcagaccgcagccgttagatcaaccatctctcgatctcaacttagcttgccaagaatattccgtcgatccaacggccatgagcgtagggatgatcgagagagatggtggtggcaataatcacaacgctacttcatcttcgtggttaaaactcgcaagtggtgattggtcttgacgactgactaatttaattaagttgctaattatattcttttaactttcattcgtttatattctttacatatatacaattaagtgcatga

SEQ ID NO: 4734 - DNA, 2776 bp, Artificial Sequence
  P15661 (35S::G3070)
ctttataattcacatctctcccagtgaatccaaagacggatcttgaacaaacatgcgtggggtttggctttatctcaagaagtctcttagctgctgcaaggcacagaagtcaactgtagcttgtgatccagacaagatccaaattcagaagaaggagaatccatctggatgctcaagaagatcaatgtcgaatctgagagatgtctttgtaactaatggagatgaaggagctatgcagaatgtaagctgctgcagctcacggtctcttgagagctccaggtttgtaaacacagtgaaatttgaggagaatgcaggttattcagacagattcaaaggtttgcttagcggagcatcttcttctgatttacttcccggtcgttgttcagagagatttgatgttgttggctctgacatctgcggtttcggagttcttgcttgtcaaaaatgtcatgagagagtcagagatcttgacgcgtttgaagcacattacctctctaaccactctggtaagacttgaattagatgaactttttcattgacttttagccaatgttgtgaggagaatttgatttgttttttcttttttgcagtcgttagactcttagcaggagatttctcaagaacaactgtggaactaatctgcaacacaggctattctcacaagctaggcaaaatgaaagggaacaacatttcagcgatctttaaaatccagaacttgcagagagttgttgcagactttgaagattacagagagctcgtgaaaataagagcaaacaagctttcaaagaagcactctcgttgtatggctgatggcaacgagtttcttgggttccacggtacaactctttcttgcactctcggtttcagtaacagctcttcaaacctctgtttctcggatcactgtgaagtttgtcatattctaagacatggtttcagtcctaaaacaagaccagatgggataaaaggagttctcacagcatcaactagctctacagctcttgaatctatcgaaaccgatcaaggaagaaatagaggttcattgatagctgttgtgctatgtagagtgattgcagggagggttcataaacctatgcagacgtttgaaaattctttagggttttctgagtttgattcactagctttgaaagttggacaaaattcaagaattgaagagctttacctgttgagtacaaaagctttgttaccttgctttgtgataatcttcaagccatgaaacaagcccgtatatgcaaaatttattctttaggtttttgtatagttttctcatcttcttttttcttgcaaaatttggtgggcctgtaataggttaaaaatgttgggctttccccaaaattgaaagatggaaaacttgctggacaagtctatgcccagcctctatatttaaagggtgaagaagactgtaactgttagtgctaccattttcttcaattagggtttctttgactagctcttcgctaagaacactcatgtctcctctgcttctgagccggccttcagtgttctccctccggaaacctctgtttgtaagatactattctcttctctccccaatcacactttgttctttttttttttttttgatgatgttttgctgatgtgagatcactacaattatactcagagacgccctagtgttgggtgcttgtcatctcgacgctgaaccttgcggattgggtatgggaaaactcatgattgcaattagtagtgataattcgatgtgggttttggagaagaaggcccctgtggagttggtggaaggaggaaagggaattgtaggagcatcccatgggtgggtagctactttgaaagacggagtagtgtgtctccaagatgatctaaacccaagcacatcgaattcagacccgaaacgcatctcattgcctagtctagtaactctacctcattgccaaacccaagttgtcaccaacatggccatgtcttgctcatctcctgaggaaaatgactgtgttgtggctataagtcttaggaccacaactcagcttatgttgacccgctcaaagtaaccctgagtggatcaacatcgagattcagaactcaagcttcttctcttcccctgtcatgttttccaagagagttgagatgttctgcataccttcttctggaggtcacgttactggatcgtgggatctccacaaacacaagttgcagagggtgcgatttcgaaaccttgctaagttgacaaagaaggaatggaagcttttggattcgtgtagcaggagcgaacatttggtggagtcagcagaaaatgaaactttcttggttaagtggtacaggaagaaaagcaaagatttgaagagaatgatgacaacaaaggctgtaatggtgttcaagcttgacaaagaaggaaatgctaaaaaaaaaaaaaaaaaaaaaaaaaaaaaaaaaagaaggaaatgctgtttacactcgagacattggagatctctgcattttcctctcaaaatctgaatctttctgtgtctctgcaactagtagctacaaatccgttccttccctagtccgtaaccacgtctatgtccaggcttacgacgagtatggattcatggatatcgccaagccttttgacgattcctgggtcattcctgcctcacctgatgcgaacccgaatcctttctatattccacctcaaactatagaatatactttatctacgatgcacccggatctatgaattttttactttgtcgtctcccgttactagttttcgtacccgtttcaatgctacttagtcagg

SEQ ID NO: 4735 - DNA, 4643 bp, Artificial Sequence
  P15666 (35S::G2884)
ggccggacaccttcacaaaaacacgcagagtgtttatatgcagccattaaatatggctgagatattggatcaccgtggagtcttgaccgacggtgatgatggtccatttagaaatctaacaaacttctatgatatgttttcaagcaactttcctgaaggtttgcgagtgttagtcttcgatgaagatccatcgtatcttctgatattggagagacatctccaaaagtttcaataccaaggtagctatttaaccattttcgaagttgatctagtgtttatttaagtctatattcaaagctggtctaacattttcaaatgtatgaaaaagttttgttccccttttcatatagtcgttgacaaaaaaaaaacctaaaacatttctcccaaattttgacctatatttgaggccatgacatgctttggactagatctctccatattaatggcgatgtgtatttttgcagtgactatatgcaacgaagtgaacaaagctatgcatacactccgcaaccataggaataggttcgacctcgctatgatacaagtaaataatgcagaaggtgatatattccggtttctctcggaaatcggatcggaaatggatcttccaatcatcagtaagatatctaatcacccaagaacagagcacataaagctctaatcctctttactcatcaatcatcacgcaggatgtctttctctctactctctcttactattttataagcgtatcataattttaataaaaatgtcatttcattgaactaagtgtaaattcgatatgcaacaagaaaacacacctttttttataccgcagtaatatctgaagacgattcagtgaagtcggtgaagaaatggatgattaacggtgctgccgactatcttataaaaccgataagacccgaagatctacggatagtattcaaacatttggtaaagaagatgagagaaaggaggagtgtggtgaccggagaggcagagaaagcagcaggtgagaaatcatcctctgtcggagattccaccataagaaaccctaacaagagtaaaagaagtagttgccttgaagcagaagtcaacgaggaggatcgtcatgatcataatgatcgtgcttgtgcttctagtgccaagaaaagacgagtcgtttgggacgaggagcttcaccaaaactttctcaacgccgtggattttcttggactcgaaagtgagtcacaaacactaatattattgtttataattaccattcccaatttattatatatactatacctctctatatttatataataaatgtgtgaataattatattttcatgcaggagctgttcccaaaaaaatattagatgttatgaaggttgattacatcagtcgagaaaacgtagccagtcatcttcaggtaacgtttcttatatacaacataattgttcattttcaacaacatttttgcttttattcttgaatagcatctccattttttttatacttcaaaatggagtaagatttcaaatctatttagttattgattttcagaatgaccctttataatttacttatgaaaattacaaattcaacccatatatttgtaattttaccttagttatgttatactctgatccctcatcattataagtgatgtttaaggtttctacacataaattatgaaaacataaatctttcatttaatatacctcttttacatagaaacaaaactaaataaaatgaattcaaccaatttgaaaacatactctaaaatataattggtcgaaaaaaacaacatttagatattgaattattgcatagaaacatgagagcatcacttaaaatgaaacaaaataaattttcttaaacatcacttaaagttatacatagggagtaggtaatatatgtcattttaatattaaaatattagttaaccacataattaacattattgtttatatgttttaactatgagatagtagcaaataactttatttgagtataaagtaaaaaaaaactataatttaatggattgagttacaaatttttttctataaaactaaaaaaaaaatagtttttaactaaaaggatagattaaaaaacaaaaaacacaccacgaacccttccaaactttttacctcaccttgcatcggtttcaggttgctcttcagatccaatcgaagaaggaaggatgagacattgtgctcttcccttctcccactctttccctgcatctccttggacactcccttcagatctgcttccctttgtaggaaaggctacgaacccctggaacctcaacacaaccacggtcagagtctgccccattttggcatcctgaagtgaacctagggttttccccagtggacctagactcttctgttggcccattacctataataaggtccaagcccacctgctggtttaatcattctaaggcttttaatcttaggtctgaactcattattcttatgcttagcccattactttctttgtgtcgatctcctctgttctatggtcatggactccatgtgaaagagacatcaacattgacggtttgggttttcatttaccttatgcgaaccttggttttagctacctttaaggctttatggtatccttataaagaattgaagattgttgtgctaagttccttgaatcgttcttattgttgtggcatttgtggtattggattattctttttcgttgctcatttgccactaagcagctcacttttcgtcttcaaacactgtaccctctttatcatctccatcttccagaccatatgcttcatagtctttgccgctattgaccggagagatcctcattcgagttggtttctaaagccaccctcacctgactatcgcaccatagtctcccgaatccttggtatcgtgttactgtgggtaatgaagcttgctccggcgagattcatatcattgatccgtttgtcaatgtcactatatccttcgactgtgactaatccgtcgtccttcgaactcttcgaggatgatctctcgatttaccgtgacctctcatggtgcattgcgcttccttgccttttccaaaaatgatattttcacaatttctctttacaatttcctttttttttttgtggtcaaccgattttgcatgtttttaattagatgatattaaaaatgtaacagattagaccatggtgttaccagtatgtttttatcagctgaatatcttagtcatcattacccatatttttgatcactctactaatagagatgttaggagaaataatagagaggtgttcacccaataaaatgcttatagatcatcttttgttagttattttattttaaagttatgtgtattagtgtgattttcagatttcttctgataacagtcacagaggttttccgtttttttaattgatattcatatatagttcatgacctcttacttattgttttaaatcatgatacagaccatactaagacatacttagtagttaaaattttgtatttgctttctagtctttcttttttgggaactttaattcatgggtagattccattcaactattttcttatttagaaataaagtagttctttcttttcttttgttggtaaaatattagcatgatttagctctttctttctttttttggtaaaattttaacatgatttagttcttattgaactgttggggataaataagtaagacaataagacatcatatacataaatcagagtatatggatgttaatatactagttatattatcagaaagctcaactaattaaactacaccaaattaaatatggttgacacaaatttagagtaaaatacatttaaaaatgtcaaaagataatccttatttggttatgttttaatatatatatatatcgtactaattttcttttgtcctgaattgggtgtgtagaaattccggctcatgctgaagaaggagaatgatgaaaagattaagaaagaggagatgaacaaatctttaataaccccacaaaatggaagaatgtatgttggagaagatccatcaaatttctacagaggaagaaatgatcatttcccaacacatcatgtcaacaatattcctcaaccttcttatgtgccgcaacacaccttgaaccctaacaatctcaacacacagctcataccatctctcggacatcattttgatcatcgaggctctattgtggttcccgatacaaacctagagatgaatcaacaattttttcaccaccaacagacctcggacttcacgccagaagagaatcttggtgataacaactttactgaggaagatttaatgatggcatcaacatattatttgagcgagccggatgatgcttcttttgaaaagaagaatgggcatgaagttgtgccatcgcccatatttcattcgccgttttcctctaataagtaccaacgtagttcctttcttgatcaggtgatgaggcttatgtttcttacaagtcttatgtttcttgaataaacattatgtgttattcatatctttgtattttgtgtgtgtgtgcttcttcagcaagaaagtggaggacttagctacaatactgttttttctaatgatgaatccaacattgggatttgcaagaagggatcaagatgggtcaagatcggagccaagcatgaagacggaagatgatgtacgtactac

SEQ ID NO: 4736 - DNA, 3119 bp, Artificial Sequence
  P15686 (35S::G846)
gaacaacaattggcttcacactctctcttttctcaattttgcttcttacttctttccccggctgattagaaacttgaccgcttgattctcttaaaggaggtcttgcgatggattccgctattgatatcagttctgatagtgatgtcgagatacaagaaactagaaccaggcctcaacatcccccacggatagctgaaggatctcatagaagagatctctctacgctgagaccgcactttcttagtgggagttcttccggtgcaaatggccacactaaaacaggacttacaaatctcgactcacgtaatggttttgaatccaagccactgcctcgggcagaacaccatacacatattccgggaaatgggagtatcgtaacttccagaattcccaatatctctgttggtgattatgagaaattttcatctcaacaagcttttaaaaggacacatccaccaacctttagtcgacctccttttcctcctagacctgatattggtacaagtaacgggaatgcgagtcactttcgtggtggagcacatgatgatctaggcatggggcgtgtgactaacggcactcggatcctacctccatctgtggcgcacggaacatctgcgtctccttcacattttaatggattaagtgatccaatgcataggaatggcataggcgaagaaaggaattcggaaaatgacgagaggctgatctatcaggctgcactacaggaactgaatcaacccaagtccgaggtcgatttacctgctggtcttctttcggttccccttatgaagcatcagaaaattgcattggcatggatgtttcagaaggaaactaatagtttgcactgtatgggagggatattagctgatgatcagggccttggtaagacagtctcgactattgcgcttatcctaaagcaaatgcacgaggcaaaattaaagtccaagaattcaggcaatcaagaggctgaagcattggatctggatgctgatgatgagtcagaaaatgcatttgagaaaccagagtctaaggcttcaaatggtagtggtgtgaatggtgattcaggcataaagaaagccaagggagaagaagcgagtacttcaacacgcaaattcaacagaaagagaccagctgctggtactttaattgtttgtccagcaagtgttgtgcggcagtgggcaagagaacttgatgagaaggttactgatgaagccaaactttctgttttaatataccacggcggtaacaggaccaaagatcctattgaactagcaaaatatgatgtggttatgacaacttacgccattgtttcaaatgaagttccaaagcaacccctggttgatgacgatgagaatgatgaaaaaaattctgaaaaatatggtctcgcttctggcttctccatcaataagaaacggaaaaatgtagtgggtactactaagaagagtaagaagaaaaaaggtaacaataatgctggcgattcatctgaccctgactctggtactctagcaaaagttgggtggttcagagttgtactagatgaagctcaaacaattaagaatcatagaacccaggtggcaagagcatgttgcggtcttcgagccaaaaggaggtggtgtttgtctggaacaccaatacaaaatacaatagatgatttatacagctatttcaggtttctaaaatatgatccatatgctgtgtacaagtcattctgccaccaaattaagggtccaatttccagaaattcccttcaagggtacaagaagcttcaggctgttctaagggctataatgctacgccgtacgaaaggaacattgcttgatggccagcctataattaatctaccaccaaagacaattaatttgagccaggtggacttttcggtagaggagcggtctttctacgtgaagcttgaatccgattcccgttctcagttcaaggcatatgctgctgcaggaactttgaatcaaaactatgcaaacattcttctcatgcttttgcgactacgccaagcttgtgaccacccccaacttgttaaaagatataactcagattctgttggaaaagtatcagaagaagctgttaaaaaactccctaaagaggatctagttagcctgctcagtcgcttagaatcgtctcccatctgttgtgtctgccatgatccaccagaagaccctgttgttactttgtgtggccatatattctgctatcagtgtgtatcagattatatcacaggggatgaggacacgtgccctgcgcctagatgcagagaacagcttgcgcatgatgttgttttctctaaatccacgcttagaagttgcgttgctgatgatttgggttgtagttcctcagaggataatagtcatgataaatcagtttttcagaatggcgagtttagttcatcaaagatcaaagctgtcttagatattctgcagtcgctttctaaccaaggcacttcaaactcaacacagaatggtcaaatggcttcttcctcgcagcagccgaatgatgatgatgatgatgatgatgatgatgtcaccattgtcgagaaaacgagtctgaagtcaactccttctaatggaggaccaataaaaacgattatattttctcagtggactggtatgcttgacttggtggagctatctctaattgaaaatagtatagaattcagaagattagatggtacaatgagtctaattgccagagacagagctgtgaaagaattcagcaacgatccagatgtaaaagtgatgataatgtctttaaaagctggaaatcttgggctgaatatgattgctgcatgtcatgtcattcttcttgatctatggtggaatccaactactgaagatcaggctattgatcgagcacatcgtattggacaaactcgacctgttactgtaactcgtattacgataaaaaatactgtggaggatagaattttggctctccaggaagagaaaagaaaaatggttgcgtctgcctttggtgaagatcatggtggaagctctgcaactcgattaacagttgatgatctcaaatatctattcatggtgtagctgttcttaaatcttgggttggcgaagtttcgcttctttcagaattttgatcatgagctgcattct

SEQ ID NO: 4737 - DNA, 904 bp, Artificial Sequence; identical to SEQ ID NO: 1079
  P16175 (35S::G1591)

SEQ ID NO: 4738 - DNA, 1089 bp, Artificial Sequence; identical to SEQ ID NO: 1681
  P16177 (35S::G2774)

SEQ ID NO: 4739 - DNA, 1271 bp, Artificial Sequence
  P16178 (35S::G1556)
ctataaataattggtgcacactctcaatattatcaaactaaaaattttacgagagataaaaaaaatgcaagatccgatggttagatcttacattaggtcagacaatccgcgaatgcactggaccgacgatcttgatatccgttttattcaagttattgaaaaactcggtggcgaagagagtaagcggttttctttccatatcgcaaaactataacaagacgattcttctgaaataaattcaaagaaaaaaaaattgtcattgaaatcaacaatcttttttttccttttaagacctttccatgattaatgttctctttatatccttttttagattaattcactatagtcgatattattgttctccttaaatttgcaggtgcaactcctaagagaattttgagtcttatgggtgtgagagacctcacaatatcacatgtcaaaagtcatctccaggtctttataattatatagtgtataaaacttatctacaaaacatatactatctaagatggcaagtactgaattattttttatttttttactttcaatagatgtataggaacaaaaagaaagaagaatctagtaaaggtaaaataactatcttacattttaaattaaattttaataaatatgtttgtcgtgtaactttgcataaggaatatttagattttcaacataatgcatagtgaagtttatatccgtttattcataattatgcacctccaatcctttgacagaaataaaaatgatgcgggagatgacacagaggcaatctcagcaatatcttcaaatctatgaacgtgctacccaatttatccaaaatcaacaaaggttcttatgttcatgtatcaacttagtttttcatataattaatcgttttttggtttcgtgagtaaaacaatcttctttttcaatttcttctaggctacaactggataatactgagaagataaccccagttttgggatcaagtaacaagtctctagatcaatcttcaaaggtaatttttttttccttttgtaatttttatattactaaatatcatgcatgattatcaacatgttgatttgatgcctatgaaactagattaatgtatattttatggcaggttggactaaatgaaaacagaggcaatgatgttgttgttgttggtggtgcaactggtgaagaagaattgtcccttgaactcactcttggtcgcaagtactaagaggagtttggtttctatctttttttttatgcttgctctctattttatgtaatgcttatcc

SEQ ID NO: 4740 - DNA, 1881 bp, Artificial Sequence
  P16180 (35S::G2550)
catcaatcggatgaaactcacttaaacaacaaaacactttcgatttattatccaatggctgtgtattaccctaatagtgtcggcatgcaatctctttaccaagaatccatttacctcaacgaacaacaacaacaacaacaacaagcttcttcttcctctgctgcatctttctccgagattgtttccggtgatgttcgaaacaacgagatggtatttatcccaccaacaagcgacgtagccgtcaacggaaacgtaacggtgtcaagtaacgatctaagctttcacggtggaggactttctttaagtcttggtaatcagatccagtcagctgtctctgtttctccgtttcagtatcattaccagaatctttcgaaccaattgagttacaataatcttaatccttctactatgtctgatgagaatgggaagagcttgagtgttcatcagcatcactctgatcaaattttaccttcctctgtttacaacaacaatggtaataatggtgttggattctacaacaattaccgttacgagacatcagggtttgtgagtagtgtactgagatctcgttaccttaaaccaacacaacaattgcttgatgaagttgttagtgtaaggaaagatttgaaattggggaataagaagatgaagaatgataaaggtcaagactttcacaatgggtctagtgataacattacagaagatgataaatctcaatcgcaggagttgtctccttcagaacgtcaggagctacagagcaagaagagcaagcttttaacaatggtggatgaggtaagactaaatcaaatttgaatactttaaagtgagagagagactttggagttttgagttttgaaaacatttttgcaggtagataaaaggtataaccaataccatcatcaaatggaagctttagcatcgtctttcgagatggtaacaggtcttggagcagctaagccttacacatccgtagctctgaatagaatctctcgccatttccgctgtttacgcgacgcgataaaagaacagattcaggtgatcagagggaagcttggggagagagagacttctgatgaacaaggagagaggataccgcgtcttaggtacttagatcaacggttgagacaacagagagctttgcatcaacaacttggaatggttagaccagcttggagaccacaaagaggcttacctgaaaactctgtctctatacttcgagcttggctctttgagcatttccttcatccgtaagtttgttgtttgtaagacactttctttctgctcctcattgcttcattgataaccatttcaatcgtttttgtagatatcctaaagaatcagagaaaatcatgctttcaaagcagacaggactatcgaaaaaccaggttcttattggctcaatctttggtcttgcttttatatgagtggtattctgattcttggcaatttaggttgcaaattggtttattaacgcgagagttcgactatggaaaccaatgattgaagagatgtataaagaagagtttggagaatcagcagagttactctctaactctaatcaagacaccaaaaaaatgcaggaaacatctcagctcaaacacgaagactcttcgtcttcgcaacaacagaatcagggaaacaacaacaacaacatcccatatacatctgatgcagaacaaaacctagtctttgcagatcctaaaccagaccgtgctactactggagattacgacagcttgatgaactatcatgggtttggtattgatgattacaatcgttacgttggccttggaaaccaacaagatggcagatattctaatccccatcaattacacgactttgttgtctaaaagattcctgagcttttcacaagcttaagat

SEQ ID NO: 4741 - DNA, 1664 bp, Artificial Sequence
  P16190 (35S::G1928)
tatgatgaacaaagacatgttacttcaccagcatcagcaaccacaacaagacgagaatatgtcgaatctaacatcagcttccggggatcaagcaagtgtctcttcaggaaatataactgaagcaagtggttctaattacttccctcatcatcagcaacagcaagaacaacaacaacaacagttagttgttccagattcgcagactcaaaagaagaggagaaaccaaccagggaatccagacccagaatcagaagtgatagctctatcaccaaaaacactaatggcaacaaacagattcgtgtgtgaaatctgcaacaaaggttttcaaagagaccagaatctacagcttcatagaagaggtcacaatctgccatggaagctgaaacaaagatccaacaaagaagtgataaggaagaaagtgtatgtatgtccagaagcaagctgtgtccaccatgatccatctagagctctcggtgacttaaccggaatcaagaagcatttctgtagaaaacatggtgagaagaagtggaaatgtgataagtgttcaaagaaatatgctgttcaatcagattgcaaggctcattctaagacttgtggcaccaaagaatacagatgtgactgtggcactctcttttctaggagggatagtttcataactcatagagcattttgtgaagcattggctgaagagactgcaagagaagtagtaataccacaaaaccagaataataatcaaccaaaccctcttttgattcatcaatctgcttctcatcctcatcaccatcatcaaacacaaccaaccataaacgtctcttcttcttcatcttcctcccacaaccacaacatcatcaatagccttcacttcgacaccaacaatggtaatactaataatagtaacaacagcaacaaccatctccatacatttcccatgaagaaagagcaacaaagcaatgaccatatcatgaattaccaccatagtatcatccctccttggcttgctcctcagcctcacgcactcacatcttcaaaccctaaccctagtaatggtggaggaggaggaggaagtttgttctctcttgcttctccggctatgtcagccaccgcattgctccagaaagcagcccaaatgggctctacaaagacacctcctttaccaccaaccacggcctacgagaggtcaactcataataacaacctcacaacgacaatggcggcgatgatgacgtcaccatctggattcatcagctccaacaacaacaatcatgttttgtttcaagactacaacgcatccgggtttgataatcacggcagagaagaagcattcgacgatacatttggcgggttcttgagaacaaacgaagttacagccgccgcaggatcagagaagagtactaaaagcggtggaggagaaggtttgacgagagatttcttggggctaagaccgttaatgtctcataacgagattctaagttttgctggtcttggaagttgcataaatagctctgcttctgatcagcttcatccaaagccttggcagggttagttaggttttttgctcataatatataatatgtgtatatatatttatatatctagttttgcatctttctcttgttttgttcttcgttttataaatttatatgttgaatgctcatcaaaggaaa

SEQ ID NO: 4742 - DNA, 1157 bp, Artificial Sequence
  P21111 (35S::G682::INTPDK::AG682)
tcgacggaaccgctggagaaattgagaggttttgggtcatgaaaaattgaaaagtgatcaatatatctctatagtttcactgattgtttcgattatattccgttgtattttaaatttaccaactctgttataagaagaaaactttcttaaatcccaacgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataagcttgcggccgctctagagaattcgttgggatttaagaaagttttcttcttataacagagttggtaaatttaaaatacaacggaatataatcgaaacaatcagtgaaactatagagatatattgatcacttttcaatttttcatgacccaaaacctctcaatttctccagcggttccgtcgacg

SEQ ID NO: 4743 - DNA, 1855 bp, Artificial Sequence
  P21117 (35S::G1073::INTPDK::AG1073)
gccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttcgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataagcttgcggccgctctagagaattcgaagattgtagaaagcaacacctcctccaccatttccaccttggaggtttgactcacacgcctgggccccactccccgtaacctccgacgactgagacgcctccggctgctgctgctgcaccccggtggttctcggcggtggggtttcttcctcttcaatcggtaacctatcataaactgcgtttgcaaaagaagcagccatcaacactaccggtcccgaagcaattaacgaaccagccacattccctcctacaacttgtccttgacctccggctagatacaccgtcaaacctcctgctcccggtggtgcaggcggtggaagcgcagtaccggtcaaagacaaaatgtcaaaccgaccatgcagggtaatcacacctccaccagccggagccgcaggttgccgtatcgtgacgttagtgaccgcacccgtgccgcttataatgcaaacgccgcagccgcgacgagtggcgtaggtggagactgcctcggatatgtccgaaccggcgtcgac

SEQ ID NO: 4744 - DNA, 598 bp, Artificial Sequence
  P21144 (35S::G682::GAL4)
taatacggtgccgtttgacatggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaatgaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4745 - DNA, 1208 bp, Artificial Sequence
  P21145 (35S::G1073::GAL4)
tacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgtttgaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4746 - DNA, 792 bp, Artificial Sequence
  P21146 (35S::G481::GAL4)
cccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctgggaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4747 - DNA, 1351 bp, Artificial Sequence
  P21159 (35S::G2345/G482::INTPDK::AG482/G2345)
tcgacaggaatgcgtctctgagttcatcagcttcgtcaccagcgaggctagtgataagtgccaaagagagaagaggaagaccatcaatggagatgatttgctttgggctatggccactttaggatttgaggattacgcggccgcggagcaagacaggttcttaccgatcgctaacgtcagccggatcatgaagaaggccttgcccgccaacgccaagatctctaaggatgctaaagaaacgatgcaggagtgtgtgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcacacactcctgcatcgtttctttagcatccttagagatcttggcgttggcgggcaaggccttcttcatgatccggctgacgttagcgatcggtaagaacctgtcttgctccgcggccgcgtaatcctcaaatcctaaagtggccatagcccaaagcaaatcatctccattgatggtcttcctcttctctctttggcacttatcactagcctcgctggtgacgaagctgatgaactcagagacgcattcctgtcgacg

SEQ ID NO: 4748 - DNA, 1045 bp, Artificial Sequence
  P21160 (35S::G2156::INTPDK::AG2156)
ccgtccacgtggtcgtcctgcgggatccaagaacaagccgaagccaccggtgatagtgactagagatagccccaacgtgcttagatcacacgttcttgaagtcggaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcattttatatagtattattttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgcgaattccgacttcaagaacgtgtgatctaagcacgttggggctatctctagtcactatcaccggtggcttcggcttgttcttggatcccgcaggacgaccacgtggacgggtcgac

SEQ ID NO: 4749 - DNA, 1311 bp, Artificial Sequence
  P21162 (35S::G867::INTPDK::AG867)
gaagccgaatcaagaaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcaagaaatcgacctcgtcttcgtccatcttcacgtctttgaaatttgtgacggcgtcacggcgacggaacctgtgaaccgcgacgtcgtaggcacgagcggcttcgtcttcttcgttgaatgtcccgagccacacgcgctggtgtttctcgtaaatctgagctccccatcttccgtttggttgtggcaccacacctttgtattttgacgacggaagctttcttgattcggcttcgtcgac

SEQ ID NO: 4750 - DNA, 1389 bp, Artificial Sequence
  P21193 (35S::G867::GAL4)
taaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgcaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaa

SEQ ID NO: 4751 - DNA, 1267 bp, Artificial Sequence
  P21199 (35S::GAL4::G1073)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacgaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgtcgcgtttgcgtgtttgacctcaaactactaggctactagctatagcggttgcgaaatgcgaatattaggtt

SEQ ID NO: 4752 - DNA, 1526 bp, Artificial Sequence
  P21201 (35S::GAL4::G867)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacgaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactg

SEQ ID NO: 4753 - DNA, 987 bp, Artificial Sequence; identical to SEQ ID NO: 1875
  P21243 (35S::G3407)

SEQ ID NO: 4754 - DNA, 1143 bp, Artificial Sequence; identical to SEQ ID NO: 1871
  P21244 (35S::G3400)

SEQ ID NO: 4755 - DNA, 1064 bp, Artificial Sequence; identical to SEQ ID NO: 1877
  P21246 (35S::G3408)

SEQ ID NO: 4756 - DNA, 516 bp, Artificial Sequence
  P21248 (35S::G3394)
agggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgagtgagtcgtcgccctcgtcctcccccctcttgtgctctgctctgctctgctctgtcttcttttgagttttgagctttgagctcgttgtttgacttgtcgttggcggcgatgagatgtgactgggtttttgttgtggtggggcaacattacagggcgagcgataaatgccagagggagaagcgcaagaccatcaacggcgacgacttgctgtgggcgatggccacgctgggcttcgaggactacatcgagcccctcaaggtctacctgcagaagtacagagaggtgcgtactgatgtggatgtttggaattggggtgattctctgttgatttaaaaaggtttagttattgctttgcgagttaggtagggacatc

SEQ ID NO: 4757 - DNA, 633 bp, Artificial Sequence
  P21251 (35S::G3429)
tgcattcaaagtggtaattaagaatcggatgatcattttgattgttcctcttcatttgttttggatgtcaggtggcaggaacatggatcaggtcaagaaggcggcagtgagatcggatggggtgggaggtagtgcgaccaacgccgagctgccgatggccaacctcgtacgcctgataaagaaggtgctcccagggaaagcgaagatcgggggagcagccaagggtctcacccatgattgcgcggtggagttcgtcgggttcgtcggcgacgaggcctccgagaaggccaaggcagagcaccgccgcaccgtagcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcactgacgcagagctgcagtttctccggtcggtgatcccctccagaagtgatgatgaatatagcggctcatcaccagccataggcggctatggctatggatatggctatggaaaaaatatgtgaacaacttgatgcatgtgtgtgtg

SEQ ID NO: 4758 - DNA, 761 bp, Artificial Sequence; identical to SEQ ID NO: 1867
  P21252 (35S::G3398)

SEQ ID NO: 4759 - DNA, 610 bp, Artificial Sequence; identical to SEQ ID NO: 1861
  P21253 (35S::G3395)

SEQ ID NO: 4760 - DNA, 356 bp, Artificial Sequence; identical to SEQ ID NO: 1857
  P21254 (35S::G3393)

SEQ ID NO: 4761 - DNA, 1076 bp, Artificial Sequence
  P21255 (35S::G3392)
gctctaaactaccataaaatcttaactcggcattttttttttcacgctaatggaaagtagcggtggaagccagctgggaaagaattccaaaacaagtgatggtcgtgaaacaaaaggttagttgtatctttgttttcttgttcttccttttagccacttcatccttgcttctcttaattacggctattcatttcgtagcattatgtccaaaaggggaaaatgaagatgccagaaaaggtgtatatcattttactagtgtcattttgttaatgtttactgatatttaacctgcctattgtcacacgggtatttttaccatccttgagaaggtacctagaggtaccgtattttctagtgtaaaatttggtacctctaggtactaggtatctcaaggtatcaaaaattttaatgtaaaatttaggtatttgaatgtactttctaaaaaactgtaaaataccttactgtcaccctttgcatcttgatgctttttttggttatgtcaatggagagaacaaaaggaaacgagaagtcagaaagaaacaaggaatttgcaatttgaaaaattctagtggacatacaaattgtaatataaaccataaaattgtaacttgaaacatatttcaagatggtttggctactgggctattttgcttactctggtcaccatattttttgtaaattcgcagaagttaatagcactgcgcaaaattttgttcatttcacagaagaagaggaagatattgttttcagaatgcacaggcttgtcgggaacaggtatcctaatacacatacctgtaatgtgcatcaagtgaaaatgaagacacagtgtctttttaatcgatctagcttatactatgattatttcatagtatgaaagtttatgaaatccataagtcagcctgttccaggcaaatacattatttgcagttccctaactttgctccttctatgatgtttaggtgggaacttatagctggaagaataccgggaaggacagcagaagaagtagagaagttctgggcaattaaacatcaagccacatgatagcagaaagaggatgtttgccccaaaagtag

SEQ ID NO: 4762 - DNA, 321 bp, Artificial Sequence
  P21256 (35S::G3393)
caagatctcaactcggcatttcattggagtttttcacgcctaatggatagcagcagtggtagccagggaaagaattccaaaaccagtgatggttgtgaaacaaaagaagttaataacactgcacagaattttgttcatttcacggaagaagaggaagatctcgttttcagaatgcacaggcttgttgggaacaggtgggaacttatagctggaagaatccctggaagaacagcaaaagaggtagaaatgttctgggcagtaaagcaccagaatacataaggggggaaaaagggtgtatgccctaaaagtagcgtacaattt

SEQ ID NO: 4763 - DNA, 1338 bp, Artificial Sequence; identical to SEQ ID NO: 1855
  P21257 (35S::G3391)

SEQ ID NO: 4764 - DNA, 1068 bp, Artificial Sequence; identical to SEQ ID NO: 1853
  P21260 (35S::G3389)

SEQ ID NO: 4765 - DNA, 1003 bp, Artificial Sequence; identical to SEQ ID NO: 1873
  P21264 (35S::G3401)

SEQ ID NO: 4766 - DNA, 720 bp, Artificial Sequence; identical to SEQ ID NO: 1865
  P21265 (35S::G3397)

SEQ ID NO: 4767 - DNA, 932 bp, Artificial Sequence
  P21266 (35S::G3388)
acgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcga

SEQ ID NO: 4768 - DNA, 959 bp, Artificial Sequence; identical to SEQ ID NO: 3
  P21267 (35S::G3430)

SEQ ID NO: 4769 - DNA, 1157 bp, Artificial Sequence
  P21269 (35S::G3399)
ggtgaggagcgagttgtagaggaggagggacaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgcagcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcag

SEQ ID NO: 4770 - DNA, 144 bp, Artificial Sequence
  P21271 (35S::G1073(DBD1))
tcgaccagctcagccatggcctctggctcttcctccggacgtcgtccacgtggtcgtcctgcaggttccaaaaacaaacccaaacctccgacgattataactagagatagtcctaacgtccttagatgacacgttcttgaaggc

SEQ ID NO: 4771 - DNA, 463 bp, Artificial Sequence
  P21272 (35S::G1073(DBD2))
tcgaccagctcagccatggcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgtagatggctgcttcgc

SEQ ID NO: 4772 - DNA, 236 bp, Artificial Sequence
  P21274 (35S::G481(DBD2))
tcgacgatgctatggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatgaggaaagagtggagatggc

SEQ ID NO: 4773 - DNA, 419 bp, Artificial Sequence
  P21275 (35S::G867(DBD1))
tcgaccttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgtagttaacgtcggc

SEQ ID NO: 4774 - DNA, 548 bp, Artificial Sequence
  P21276 (35S::G867(DBD2))
tcgacctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttgaccggagagttcgc

SEQ ID NO: 4775 - DNA, 1502 bp, Artificial Sequence
  P21281 (35S::G481::GR::6XHA)
cccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctgggcggccgctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaatatcaaaaagcttctgtttcatcaaaaatctagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgc

SEQ ID NO: 4776 - DNA, 1728 bp, Artificial Sequence
  P21287 (35S::GR::G481::12XHA)
atgaaccttgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaatatcaaaaagcttctgtttcatcaaaaaggtaccgtcgacgcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtgcggccgctctagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccggatcctctag

SEQ ID NO: 4777 - DNA, 1651 bp, Artificial Sequence
  P21294 (35S::G481::INTPDK::AG481)
tcgacggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattcgattcactcgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcgagtgaatcgaataacaacaggatgtggacaaatttttccttcattcaagtgttctcaacatctaacagagaaatctttaaatacaaccaactaaaccggaaacaataaaccaaacgttcaaactaacataaccgaaattgagagtaaacccgaaatagttgtcgatcagctcaactataaacaactcactgatctctaatttcccttgatcatttggcgattgttcttaatcactacttgcaacttcttttaccagctcggcatttcttcaccagaaacaccgccaccagcatctctatttgatccatctccactctttcctgatcccttattatcaccctccaactccctgtacctcgctaggtatatctttagaggttccaggtaatcctcaaatccgtcgacg

SEQ ID NO: 4778 - DNA, 1445 bp, Artificial Sequence
  P21299 (35S::G682/G226::INTPDK::AG226/G682)
tcgaccttcttgttccgaagaggtgagtagtcttgagtgggaagttgtgaacatgagtcaagaagaagaagatttggtctctcgaatgcataagcttgtcggtgacaggtgggagttgatcgccggaaggcgcggccgcggaagtgagtagcatcgaatgggagtttatcagtatgaccgaacaagaagaagatctcatctctcgaatgtacagacttgtcggaaataggtgggatttaatagcaggaagagtcgtaggaagaaaggcaaatgagatagagagatactggattatgagaaacgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcgtttctcataatccagtatctctctatctcatttgcctttcttcctacgactcttcctgctattaaatcccacctatttccgacaagtctgtacattcgagagatgagatcttcttcttgttcggtcatactgataaactcccattcgatgctactcacttccgcggccgcgccttccggcgatcaactcccacctgtcaccgacaagcttatgcattcgagagaccaaatcttcttcttcttgactcatgttcacaacttcccactcaagactactcacctcttcggaacaagaaggtcgacg

SEQ ID NO: 4779 - DNA, 1351 bp, Artificial Sequence; identical to SEQ ID NO: 4747
  P21300 (35S::G2345/G482::INTPDK::AG482/G2345)

SEQ ID NO: 4780 - DNA, 1053 bp, Artificial Sequence
  P21301 (35S::G2156::INTPDK::AG2156)
tcgacccgtccacgtggtcgtcctgcgggatccaagaacaagccgaagccaccggtgatagtgactagagatagccccaacgtgcttagatcacacgttcttgaagtcggaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgcgaattccgacttcaagaacgtgtgatctaagcacgttggggctatctctagtcactatcaccggtggcttcggcttgttcttggatcccgcaggacgaccacgtggacgggtcgact

SEQ ID NO: 4781 - DNA, 1317 bp, Artificial Sequence
  P21303 (35S::G867::INTPDK::AG867)
tcgacgaagccgaatcaagaaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattcaagaaatcgacctcgtcttcgtccatcttcacgtctttgaaatttgtgacggcgtcacggcgacggaacctgtgaaccgcgacgtcgtaggcacgagcggcttcgtcttcttcgttgaatgtcccgagccacacgcgctggtgtttctcgtaaatctgagctccccatcttccgtttggttgtggcaccacacctttgtattttgacgacggaagctttcttgattcggcttcgtcgacg

SEQ ID NO: 4782 - DNA, 1107 bp, Artificial Sequence
  P21304 (35S::G867::INTPDK::AG867)
tcgacgaaagcttccgtcgtcaaaatacaaaggtgtggtgccacaaccaaacggaagatggggagctcagatttacgagaaacaccagcgcgtgtggctcgggacattcaacgaggaagaagaagcccgctcggaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatcttacatttggattgattacagttgggaaattgggttcgaaatcgataatcttgcggccgctctagagaattccgagcgggcttcttcttcctcgttgaatgtcccgagccacacgcgctggtgtttctcgtaaatctgagctccccatcttccgtttggttgtggcaccacacctttgtattttgacgacggaagctttcgtcgacg

SEQ ID NO: 4783 - DNA, 1351 bp, Artificial Sequence
  P21305 (35S::G2345/G485::INTPDK::AG485/G2345)
tcgacaggaatgcgtctctgagttcatcagcttcgtcaccagcgaggctagtgataagtgccaaagagagaaaaggaagaccatcaatggagatgatttgctttgggctatggtcactttaggatttgaggattacgcggccgcggagcaagacaggttcttaccgatcgctaacgttagcaggatcatgaagaaagcacttcctgcgaacgcaaaaatctctaaggatgctaaagaaacgatgcaggagtgtgtgaattcggtagcccaattggtaaggaaataattattttcttttttccttttagtataaaatagttaagtgatgttaattagtatgattataataatatagttgttataattgtgaaaaaataatttataaatatattgtttacataaacaacatagtaatgtaaaaaaatatgacaagtgatgtgtaagacgaagaagataaaagttgagagtaagtatattatttttaatgaatttgatcgaacatgtaagatgatatactagcattaatatttgttttaatcataatagtaattctagctggtttgatgaattaaatatcaatgataaaatactatagtaaaaataagaataaataaattaaaataatatttttttatgattaatagtttattatataattaaatatctataccattactaaatattttagtttaaaagttaataaatattttgttagaaattccaatctgcttgtaatttatcaataaacaaaatattaaataacaagctaaagtaacaaataatatcaaactaatagaaacagtaatctaatgtaacaaaacataatctaatgctaatataacaaagcgcaagatctatcaattttatatagtattatttttcaatcaacattcttattaatttctaaataatacttgtagttttattaacttctaaatggattgactattaattaaatgaattagtcgaacatgaataaacaaggtaacatgatagatcatgtcattgtgttatcattgatattacatttggattgattacagttgggaaattgggttcgaaatcgataagcttgcggccgctctagagaattcacacactcctgcatcgtttctttagcatccttagagatttttgcgttcgcaggaagtgctttcttcatgatcctgctaacgttagcgatcggtaagaacctgtcttgctccgcggccgcgtaatcctcaaatcctaaagtgaccatagcccaaagcaaatcatctccattgatggtcttccttttctctctttggcacttatcactagcctcgctggtgacgaagctgatgaactcagagacgcattcctgtcgacg

SEQ ID NO: 4784 - DNA, 735 bp, Artificial Sequence; identical to SEQ ID NO: 1887
  P21314 (35S::G3435)

SEQ ID NO: 4785 - DNA, 803 bp, Artificial Sequence; identical to SEQ ID NO: 1889
  P21315 (35S::G3436)

SEQ ID NO: 4786 - DNA, 1290 bp, Artificial Sequence; identical to SEQ ID NO: 1883
  P21318 (35S::G3432)

SEQ ID NO: 4787 - DNA, 268 bp, Artificial Sequence; identical to SEQ ID NO: 1893
  P21320 (35S::G3444)

SEQ ID NO: 4788 - DNA, 257 bp, Artificial Sequence; identical to SEQ ID NO: 1881
  P21324 (35S::G3431)

SEQ ID NO: 4789 - DNA, 862 bp, Artificial Sequence
  P21328 (35S::G3456)
aacttcaacttttgttatggccaaccggtggtggaccgggtcggtgggtctagagaactctggccactcgatgaaaaaaccggatctggggttttccatgaacgagagtacggtgacggggaaccatataggagaagaagatgaggacagagaaaacagcgacgagccaagagagggagctattgacgtcgccaccacgcgccgccctaggggacgtccaccgggctccagaaacaagccgaaaccgccgatattcgtcacccgagacagccctaacgcgctgcggagccacgtcatggagattgccgtcggagccgacatcgccgactgcgtggcgcagttcgctcggaggcgccagcgcggggtttccattctcagcggcagcgggaccgtcgtcaacgtcaatctccggcaacccacggcacccggcgccgtcatggcgctccacggccgcttcgacatcctctccctcaccggctcctttctccctgggccgtcccctcccggcgccaccgggctcacaatctacctcgccggaggccaggggcagatcgtcggcggcggagtggtgggcccgctcgtggcggcgggccccgtattggtaatggcggctactttttccaatgctacgtatgaaagattgcctttagaggatgatgatcaggaacaacacggcggcggaggcggaggaggttcgccgcaggaaaaaaccgggggtcccggcgaggcgtcgtcgtcgatttcggtttataacaataatgttcctccgagtttaggtcttccgaatgggcaacatctgaaccatgaagcttattcttctccttggggtcattctcctcatgccagacctcctttctaatta

SEQ ID NO: 4790 - DNA, 902 bp, Artificial Sequence
  P21331 (35S::G3459)
tggatgtgtctatggctggtttggatttaggaagcgcctcacgctttgttcaaaaccttcacagaccagacttgcacttgcaacaaaatttccagcagcaccaggaccagcagcaccagcgtgatttggaggagcagaaaactcctccgaatcacagaatgggggcgccgttcgacgatgatagcgatgatagaagcccgggcctggagctcacttcaggtcctggcgacatcgtcggacggcgcccgcgtggcaggcctcctgggtcgaagaacaagcctaagccgcccgtcataatcacccgggagagcgccaacacgctgagggcgcacatcctcgaggtcggaagcggctccgacgtcttcgactgtgtcaccgcgtatgcccggcggcgccagcgtgggatctgcgtcctcagtggcagcggcaccgtcaccaatgtcagtctccggcagcctgcagctgccggtgccgtcgtcacgctgcacggcaggttcgagattctctccctctctggctcgttcctcccgccgccggctccgccgggagccaccagcctcacaatctacctggccggcgggcaggggcaggttgtcggaggaaacgtcatcggagaattaaccgcagcagggccagtaatcgtcatcgcagcgtcgttcaccaacgtggcttacgagaggttacccttagaagaagatgaacaacagcagcaacaacagcagcttcagattcagccacctgcaacgacgtcgtctcaaggaaacaacaacaacaataaccctttccccgacccttcttcaggacttcccttcttcaatttaccactcaatatgcagaatgttcagttaccagttgagggttgggctgtaaaccctgcttcacgtccacaacctttttgagag

SEQ ID NO: 4791 - DNA, 859 bp, Artificial Sequence
  P21332 (35S::G3460)
tatggctggtttggatttaggaagcgcgtcacgctttgttcagaatcttcacttaccggacttgcacttgcaacaaaattaccagcaaccccggcacaagcgcgattcggaggagcaagagactcctccgaacccgggaacagcgctggcgccgttcgacaacgatgatgacaaaagccagggcctggagctggcttcaggccctggggacatcgttggacggcgcccacgcggcagaccttccgggtccaagaacaagccgaagccaccggtgataatcacccgggagagcgccaacacgctgagggcgcacattctcgaggtaggaagcggctccgacgtcttcgactgtgtcaccgcttatgcgcggcggcgccagcgcgggatctgcgtcctcagcggcagtggtaccgtcaccaatgtcagtctccggcagcctgcggctgccggagccgtcgtcaggctgcacggaaggttcgagattctctctctctccggctcgttcctcccgccgccggctccgccgggagccaccagtctcacaatctacctcgccggcgggcagggccaggtcgtcggaggaaacgtcgtgggagaattaaccgcggcagggccagtaatcgtcatcgcagcatcgttcaccaacgtggcttacgagaggctccccttagaagaagatgaacaacaacaacaacagcttcagattcagtcacccgcaacgacgtcatctcaaggaaacaacaacaataaccctttccctgacccttcttcaggacttcccttcttcaacttaccactcaatatgcagaatgttcagttaccacctttttgagggttcatgaatctgataatatgagac

SEQ ID NO: 4792 - DNA, 555 bp, Artificial Sequence; identical to SEQ ID NO: 1921
  P21341 (35S::G3470)

SEQ ID NO: 4793 - DNA, 556 bp, Artificial Sequence; identical to SEQ ID NO: 1923
  P21342 (35S::G3471)

SEQ ID NO: 4794 - DNA, 553 bp, Artificial Sequence; identical to SEQ ID NO: 1929
  P21344 (35S::G3474)

SEQ ID NO: 4795 - DNA, 528 bp, Artificial Sequence; identical to SEQ ID NO: 1933
  P21345 (35S::G3476)

SEQ ID NO: 4796 - DNA, 600 bp, Artificial Sequence; identical to SEQ ID NO: 1931
  P21347 (35S::G3475)

SEQ ID NO: 4797 - DNA, 547 bp, Artificial Sequence; identical to SEQ ID NO: 1925
  P21348 (35S::G3472)

SEQ ID NO: 4798 - DNA, 602 bp, Artificial Sequence; identical to SEQ ID NO: 1935
  P21350 (35S::G3478)

SEQ ID NO: 4799 - DNA, 285 bp, Artificial Sequence; identical to SEQ ID NO: 1905
  P21351 (35S::G3450)

SEQ ID NO: 4800 - DNA, 302 bp, Artificial Sequence; identical to SEQ ID NO: 1895
  P21352 (35S::G3445)

SEQ ID NO: 4801 - DNA, 257 bp, Artificial Sequence; identical to SEQ ID NO: 1897
  P21353 (35S::G3446)

SEQ ID NO: 4802 - DNA, 250 bp, Artificial Sequence; identical to SEQ ID NO: 1899
  P21354 (35S::G3447)

SEQ ID NO: 4803 - DNA, 264 bp, Artificial Sequence; identical to SEQ ID NO: 1901
  P21355 (35S::G3448)

SEQ ID NO: 4804 - DNA, 268 bp, Artificial Sequence; identical to SEQ ID NO: 1903
  P21356 (35S::G3449)

SEQ ID NO: 4805 - DNA, 803 bp, Artificial Sequence
  Artificial sequence
  P21381 (35S::G3436)
tttgacttgaccggacagtgctgttcggtggctcggccgcgatgccggactccgacaacgagtccggcgggccgagcaacgcggagttctcgtcgccgcgggagcaggaccggttcctgccgatcgcgaacgtgagccggatcatgaagaaggcgctcccggccaacgccaagatctccaaggacgccaaggagacggtgcaggagtgcgtgtcggagttcatctccttcatcaccggcgaggcctccgacaagtgccagcgcgagaagcgcaagaccatcaacggcgacgacctactctgggccatgaccacgctcggcttcgaggactacgtcgagccgctcaagctctacctccacaagttccgcgagctcgagggcgagaaggcggccacgacgagcgcctcctccggcccgcagccgccgctgcacagggagacgacgccgtcgtcgtcaacgcacaatggcgcgggcgggcccgtcgggggatacggcatgtacggcggcgcgggcgggggaagcggtatgatcatgatgatgggacagcccatgtacggcggctccccgccggccgcgtcgtccgggtcgtacccgcaccaccagatggccatgggcggaaaaggtggcgcctatggctacggcggaggctcgtcgtcgtcgccgtcagggctcggcaggtaggacaggttgtgaccgtcgccgtccatgcttgcatggccatggccatggcatggctcccgccgccggcttcttgcttggtgtcggtaattagcgctggtggcctgcgctggttaagttaacctt

SEQ ID NO: 4806 - DNA, 451 bp, Artificial Sequence
  P21401 (35S::G3515)
agcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagctagctagct

SEQ ID NO: 4807 - DNA, 393 bp, Artificial Sequence
  P21402 (35S::G3516)
atggaggacgacaagaaggagggcaagtaccgcggcgtgcggaagcggccgtggggcaagttcgccgcggagatccgggacccggagcgcggcggctcccgcgtctggctcggcaccttcgacaccgccgaggaggccgccagggcctacgaccgcgccgcattcgccatgaagggcgccacggccgtgctcaacttccccgccagcggaggatcgtcagctggcgcggctcccggcggccggaccagcggcggctcctcctcgtccaccacgtcggctccggccagcagggggagggcccgtgttcccgactcggagaaggtggagctggagtgcctcgacgacagggtcttggaggagctgctcgcggaggacaagtacaacaagaactaa

SEQ ID NO: 4808 - DNA, 444 bp, Artificial Sequence
  P21403 (35S::G3517)
acagccatcatcgccacccgcgcgcttatggatggcgagtggtccaaggacggcggaggcggcgagccgaccaagtaccgcggcgtgcggcgtcggccctggggcaagtacgcggcggagatccgcgactcgagccggcacggcgtccgcatctggctcggcacgttcgacaccgccgaggaggccgccagggcgtacgaccgctccgccaactccatgcgcggcgccaacgccgtgctcaacttcccggaggacgcgcccgcctacgccgccgccgcctcccgtggctccgccggcggatcctcgtccagaccggcgggctccggccgggacgtgatcgagtttgagtacctcgacgacgaggtgctgcaggagatgctcaggagccaggagccgtcggcggcggcggcgcagaagaagaagtagcgcgagcgccacaggtgg

SEQ ID NO: 4809 - DNA, 604 bp, Artificial Sequence
  P21404 (35S::G3518)
gttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttga

SEQ ID NO: 4810 - DNA, 486 bp, Artificial Sequence
  P21405 (35S::G3519)
tcgacattaagttctaagagaataacaatggagggtgggaagatcatctgcttcaaatgggaattgtgaggttcggtatagagggattagaagaaggccatggggcaagtttgcagcagagattcgtgaccctacgagaaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctggtgatgataataaccaccttgtgagacctggagaaataatgcaaggtggtgatcttgatgacacttttgagttggagtacttggataataagttgctcgaggaactccttcagatgcaagataacagacacttctaagc

SEQ ID NO: 4811 - DNA, 576 bp, Artificial Sequence
  P21406 (35S::G3520)
gtagggatgacgcacaatcccactatccttcgcaagacccttcctctatataaggaagttcatttcatttggagaggacacgctgacaagctgactctagcagatctggtaccgtcgacaaggcacacaatggaagaggagtcaaaggagaaaaagaaggacactaaggaggaaccacgttatagaggagtgcggcggcggccgtgggggaagttcgcggccgagattcgggacccggcccggcacggtgcccgagtgtggctggggacatttctcacggcggaggaggctgctagggcttatgaccgagctgcctatgagatgaggggcgctttagccgttctcaattttccaaatgagtatccttcatgctcttctatgaactcatcttcaacattagcaccttcatcttcttcttcaaattcaatgcttaaaagtgatcatggtaaacaagttattgagttcgagtgcttggatgacaaattgttagaggaccttcttgattgtgatgactatgcctacgagaaagacttgcctaagaactgaacggtttgatcaagcggcgccttttccaaa

SEQ ID NO: 4812 - DNA, 479 bp, Artificial Sequence
  P21460 (35S::G3380)
ggtccgatccgtaacagtagtagctagttaatttgattattgtccgtccgcggccggtcagtggtcgcaatcgatcgatcgatatcatggacggcgacggcggcggcggatgggacgatcagggcaacggcggcggcgagacgaccaagtaccgtggcgtgcgtcgccggccttctggcaagttcgcggcggagatccgtgactccagcaggcagagcgtccgcgtctggctgggaaccttcgacaccgccgaggaggctgcgcgggcttacgaccgcgccgcctacgccatgcgcggccacctcgccgtcctcaacttccctgctgaggcgcgcaactacgtgcggggatcaggctcgtcgtcctcgtcccgacagcatcagcagcggcaggtgatcgagctggagtgcctagacgaccaagtgctgcaagagatgctcaagggtggcgacgatcagtacaggtcagcagctgggagc

SEQ ID NO: 4813 - DNA, 514 bp, Artificial Sequence; identical to SEQ ID NO: 1847
  P21461 (35S::G3381)

SEQ ID NO: 4814 - DNA, 1160 bp, Artificial Sequence; identical to SEQ ID NO: 1869
  P21465 (35S::G3399)

SEQ ID NO: 4815 - DNA, 534 bp, Artificial Sequence
  P21466 (35S::G3434)
tcgacaagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctagc

SEQ ID NO: 4816 - DNA, 869 bp, Artificial Sequence; identical to SEQ ID NO: 1915
  P21467 (35S::G3456)

SEQ ID NO: 4817 - DNA, 534 bp, Artificial Sequence
  P21469 (35S::G3474)
atggctgagtccgacaacgagtcaggaggtcacacggggaacgcgagcgggagcaacgagttgtccggttgcagggagcaagacaggttcctcccaatagcaaacgtgagcaggatcatgaagaaggcgttgccggcgaacgcgaagatatcgaaggaggcgaaggagacggtgcaggagtgcgtgtcggagttcatcagcttcataacaggagaggcttccgataagtgccagaaggagaagaggaagacgatcaacggcgacgatcttctctgggccatgactaccctgggcttcgaggactacgtggatcctctcaagatttacctgcacaagtatagggagatggagggggagaaaaccgctatgatgggaaggccacatgagagggatgagggttatggccatggccatggtcatgcaactcctatgatgacgatgatgatggggcatcagccccagcaccagcaccagcaccagcaccagggacacgtgtatggatctggatcagcatcttctgcaagaactagatag

SEQ ID NO: 4818 - DNA, 568 bp, Artificial Sequence
  P21471 (35S::G3477)
tcgacttgtagggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatagtttagatgcttctacgcatcgc

SEQ ID NO: 4819 - DNA, 803 bp, Artificial Sequence; identical to SEQ ID NO: 2033
  P21493 (35S::G3556)

SEQ ID NO: 4820 - DNA, 1304 bp, Artificial Sequence
  P21495 (35S::G3455)
ctcttagaatccgtacggtctaatcaacacaacaaaatggatgcaattagttgcctggatgagagcaccaccaccgagtcactctccataagtcaggcgaagccttcttcgacgattatgtcgtccgagaaggcttctccttccccgccgccgccgaacaggctgtgccgcgtcggtagcggtgctagcgcagtcgtggattccgacggcggcggcgggggtggcagcaccgaggtggagtcgcggaagctcccctcgtccaagtataagggcgtcgtgccccagcccaacggccgctggggctcgcagatttacgagaagcaccagcgcgtgtggctgggaacgttcaacgaggaagacgaggcggcgcgtgcgtacgacgtcgccgtgcagcgattccgcggcaaggacgccgtcacaaacttcaagccgctctccggcaccgacgacgacgacggggaatcggagtttctcaactcgcattcgaaatccgagatcgtcgacatgctgcgtaagcatacgtacaatgacgagctggaacaaagcaagcgcagccgcggcttcgtacgtcggcgcggctccgccgccggcgccggaaacggaaactcaatctccggcgcgtgtgttatgaaggcgcgtgagcagctattccagaaggccgttacgccgagcgacgttgggaaactgaaccgtttggtgataccgaagcagcacgcggagaagcactttcctttacagagcgctgctaacggcgttagcgcgacggcgacggcggcgaagggcgttttgttgaacttcgaagacgttggagggaaagtgtggcggtttcgttactcgtattggaacagtagccagagttacgtcttgaccaaaggttggagccggttcgttaaggagaagaatctgaaagccggtgacacggtttgttttcaacggtccactggaccggacaggcagctttacatcgattggaagacgaggaatgttgttaacgaggtcgcgttgttcggaccggttgtcgaaccgatccagatggttcggctctttggtgttaacattttgaaactacccggttcagattctatcgccaataacaataatgcaagtgggtgctgcaatggcaagagaagagaaatggaactcttttcattagagtgtagcaagaaacctaagattattggtgctttgtagcgttacgttactttttttgagttttttttttttttttgagttttgtgactgatgaaagaaagaaggtacaagaagaacggcggtgtagtggcatagtggcatcgcaagttggc

SEQ ID NO: 4821 - DNA, 1253 bp, Artificial Sequence; identical to SEQ ID NO: 1907
  P21500 (35S::G3451)

SEQ ID NO: 4822 - DNA, 1081 bp, Artificial Sequence; identical to SEQ ID NO: 1909
  P21501 (35S::G3452)

SEQ ID NO: 4823 - DNA, 980 bp, Artificial Sequence
  P21521 (PRSUC2::G1073)
tcgaccccccgacctgcctctacagagacctgaagattccagaaccccacctgatcaaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctactagctatagcggttgcgaaatgcgaatattaggttgc

SEQ ID NO: 4824 - DNA, 847 bp, Artificial Sequence
  P21522 (PRSUC2::G481)
tcgacccacgcgtccgagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaataccaaatccttaaattaa

SEQ ID NO: 4825 - DNA, 1297 bp, Artificial Sequence
  P21524 (PRSUC2::G867)
tcgacccacgcgtccgcacaacacaaacacatttctgttttctccattgtttcaaaccataaaaaaaaacacagattaaatggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtaacaactcttcttctttttttttcttttgttgttttaataatttttaaaaactccattttcgttttctttatttgcatcggtttctttcttcttgtttaccaaaggttcatgagttgtttttgttgtattgatgaactgtaaattttatttataggataaattttaaaaaaaaaaaaaaaaaaaa

SEQ ID NO: 4826 - DNA, 468 bp, Artificial Sequence
  P23304 (35S::G3396)
tcgacaaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtaggacgaggagtgtgatagct

SEQ ID NO: 4827 - DNA, 649 bp, Artificial Sequence; identical to SEQ ID NO: 3832
  P23322 (PRCUT1::G682)

SEQ ID NO: 4828 - DNA, 649 bp, Artificial Sequence; identical to SEQ ID NO: 3832
  P23328 (PRLTP1::G682)

SEQ ID NO: 4829 - DNA, 1141 bp, Artificial Sequence
  P23348 (35S::G3453)
caaagttagttcgttaaccgttacaaacacaaaatggatggaggcagtgtcacagacgaaaccaccacaaccagcaactctctttcggttccggcgaatctatctccgccgcctctcagccttgtcggcagcggcgcaaccgccgtcgtctaccccgacggttgttgcgtctccggcgaagccgaatcccggaaactcccgtcctcgaaatacaaaggcgtggtgccgcaaccgaacggtcgttggggagctcagatttacgagaagcaccagcgcgtgtggctcggcaccttcaacgaggaagacgaagccgccagagcctacgacatcgccgcgcatcgcttccgcggccgcgacgccgtcactaacttcaagcctctcgccggcgccgacgacgccgaagccgagttcctcagcacgcattccaagtccgagatcgtcgacatgctccgcaagcacacctacgacaacgagctccagcagagcacccgcggcggcaggcgccgccgggacgccgaaaccgcgtcgagcggcgcgttcgacgcgaaggcgcgtgagcagctgttcgagaaaaccgttacgcagagcgacgtcgggaagctgaaccgattagtgataccaaagcagcacgcggagaagcactttccgttaagcggatccggcggcggagccttgccgtgcatggcggcggctgcgggggcgaagggaatgttgctgaactttgaggacgttggagggaaagtgtggcggttccgttactcgtattggaacagtagccagagctacgtgcttaccaaaggatggagccggttcgttaaggagaagaatcttcgagctggtgacgcggttcagttcttcaagtcgaccggactggaccggcaactatatatagactgcaaggcgaggagtggtaaggttaacaataatgctgccggtttgtttattccggttggaccggttgttgagccggttcagatggtacggcttttcggggtcgaccttttgaaactacccgtacccggttcggatggtattggggttggctgtgacgggaagagaaaagagatggagctgtttgcatttgaatgtagcaagaagttaaaagtaattggagctttgtaacattacatagtttttgagt

SEQ ID NO: 4830 - DNA, 488 bp, Artificial Sequence
  P23384 (35S::G3394)
tcgacggaggtgggatggcggatgggccggggagcccggggggaggaggggggagccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggacct

SEQ ID NO: 4831 - DNA, 708 bp, Artificial Sequence
  P23418 (35S::G3660)
tcgactctgtaataataatgtacggacatggcgagataaccacggcagcagaatcagattacgctttgctggagtcaatacgacgtcacttgctaggtggagacaacgagttacgattcagtgagtcaataccgagttcatgtttcactcagagttggggagacttgccattgaaagagaacgactccgaggatatgttagtgtacagtgtcctcaacgacgccttcaacggagcctttgaaacgtcgtcgccgtcgtcggacttgagctgtctcagcgattttaacgattttccggcggttaaaatggaaacttcggagaacttagcagcggaggcggaaaaaatgaaggcggtggcggcgccgccgtcaaagggaaagcattacagaggggtgagacagaggccgtgggggaaattcgcggcggagatacgtgatccggcgaaaaaaggagcgagggaatggttagggacgtttgagacggcggaagatgcagctttggcttacgatagagctgcttttaggatgcgtggttcccgcgctttgttgaattttccgttgagggttaactccggtgaacctgacccggtaaggatcaagtcaaagaggtcttataagtcttcttcgtcgtcctcttctgaaaacgggaagccgaagcagaggagaagaacagagaacgtgccatagttcaggtgaagggcgatgttgt

SEQ ID NO: 4832 - DNA, 844 bp, Artificial Sequence
  P23419 (35S::G3661)
tcgaccaggatgctgctgaacccggcgtcagaggcgtcggtgctagacaccatccggcagcacctcctcgaggagccagccgacgagagcttcgggagcctggtggcggaccagtggagcggctcgctcccgttccgcaccgacgacgccgacgacatggtggtgttcggggcgctgcaggacgccttcgcctacggctggctgcccgacggctcattcgtgcacgtgaagcccgagccggtgcggtcccccgactcgtcctcctacccctgctcctacgacggctcaccctgcttcggcctcctggacccggagccgccgctgacgcccggcaccaccacgcccagtagtagggggcaggaggaggccgcggcggccatggcccggggcaagcactacaggggggtgaggcagcgcccgtggggcaagttcgcggcggagatcagggaccccgccaggaacggcgcgcgcgtctggctcggcacgtacgacaccgccgaggacgccgcgctcgcctacgaccgcgccgcctaccgcatgcgcggctcgcgcgcgctcctcaacttcccgctccgcatcggctccggggacaagcgcccgtcgccggcgccgcccgagcccgccacctcctcggactcctcctcgtcttcggccagcggctcgcacaagaggcggaagcgaggcgaggccgcggctgccaacatggccatggcgctggtgcccccgccctcccagcttaaccggccggcccagccgtggttccctgccgcgccggtcgagcaggcggcgatggctccgcgcgtggagcagatcgtcgtctagtctagccatgcgccggagaaat

SEQ ID NO: 4833 - DNA, 803 bp, Artificial Sequence
  P23421 (35S::G3717)
tcgacggagaccaccggagatatgtacggacggagtgattcttacgaatccgatttggcgcttctggattcgattcgccgccacttgctgggagagtccgaattgatattcggagccccgaatttcggttcgggtcggagctccagtttcagcagcttggactcgtgtttgagtgatgattggggagagcttccgtttaaggaggacgattcagaagatatggtgttgtacggcgttctccgtgacgcagttaatgtggggtgggtcccatccctcgatgccggctcgcccgagagcgtctcgtcgggttttccggcggtgaagctggagcctgatgtcatgccggcgttgattaatccgtgtccgcctccggcgccggcggtggaggagaagaaggttgttccgccgaaggggaagcactaccgcggcgtgcggcagcggccgtggggaaagttcgcggcggagatccgggacccggcgaagaacggggctagggtttggctggggacgtttgagacggcggaggacgcggcgttggcgtacgaccgcgccgcctaccggatgcgagggtcgagggcgctgctgaattttccgttgagggttaactccggcgagccagatccggtgagggtgacgtcgaagcggtcgtcgtcgccggaaagtatggcggcggcggcgccgaagagaaagaaagttatggtggtggggacggtgcaagagcaagtggggagtcaagtggtggagtgtacacgtggcgaacagttattggttagctgagagagattctaaaattggtattgtgt

SEQ ID NO: 4834 - DNA, 1018 bp, Artificial Sequence
  P23423 (35S::G3718)
tcgaccacgaaatgtacggacaaagtagctatgagtccgatttggcccttttggactccattcgccgccacttactcggcgactccgaggaacacagattcggagccccgaatgttaattcgggtagcactccattgtactctcggagctccagtttcggcaggttgtacccttgcctgagtaacgattggggcgaacttcctcttatggaagacgattcagaagacatgcttctttatggtgttcttcgcgacgccgtgaacgtaggctgggtcccatctctcgacgcttcctcaccggagagtttctcgtcggctttcatgccgccggtgaccgtgaaatccgaaacggatctatttccggcaccggaaccgatttgtaaccctccggtggttcagggcccggcgccggcggtagttccggcgaaagggaagcactaccggggcgtgcggcagcgaccgtggggaaaattcgcagcggagatccgcgacccggctaaaaatggggctcgggtttggcttgggacttttgagacggctgaggacgccgcgctggcttacgatcgagccgcgtatcgaatgcgcggctcgcgggctttgttgaattttccgctccggattaattcgggcgagcccgaaccggttcgagttacggcgaagcgggcttcagcagaaccgtgttcttcgtcggagagtggatcttgggtgaagaagcggaagaaggtggtgggttgagaacggggcacgtggagagcagttgttggtgaagtaatttgtgatgctaaaaaggggtggaataaatgggttggcatgctcactcattgctcaagtgggactgtgggactgatcaaatctaaagctaaaaaagaaaacaaaccacatttggaaaaactgattagggtcgaggttctgtttggctttgtgaatacagttacaagatttcttattttttggttcaattctataataatatctgtaacatagttgggtagggcacccaccctgtgctgaactaagtt

SEQ ID NO: 4835 - DNA, 821 bp, Artificial Sequence
  P23441 (PRCUT1::G28)
tcgagctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattgc

SEQ ID NO: 4836 - DNA, 783 bp, Artificial Sequence; identical to SEQ ID NO: 2053
  P23452 (35S::G3659)

SEQ ID NO: 4837 - DNA, 869 bp, Artificial Sequence
  P23455 (35S::G3644)
tcgacctcacgtaccggccagaaatatcacagcacacacacacggttaacttttttcccgcgcgaaatctctcgaagtgaaacatcccaagcaaaaatccgatcgattcggcgagctagcaggtcaactcgccatggctgacctcccatgcatatatatacgcgtagtacgtacacttgctttcccaacgctcgcgaatcaaatcgagggtgaaattaagtcaagaacggagagagatcacggtgaggttgatctcagctcgccggaggaggcaatgagccgggcggagtgcggcggcggcgaggaggaggagcggtgcaggtacaggggcgtgcggcggcggcggtgggggaagtgggtgtcggagatccgggtgcccggcacgcgggagcggctgtggctggggtcctacgccacgccggaggccgccgccgtcgcgcacgacacggccgtctacttcctccgcggaggcgcgggcgacggcggtggcggcggcgcgacgctcaacttcccggagcgcgcggcggccacgtacggcggcggcgccgccgtggcgcgcctgtcgccgcggtccgtgcagcgcgtggcgtccgacgccggcatggccgccgacgcgcagctcgtggcggcgcgggacgccgcgcccgcgcccgcgccggcgacggcgtacgcgcgcccggatcactgcgccggcgcgacgacggcgcggcacgacgagctggcgcgccgcgggatgtacggcgctcacgcgcatgccgccggcgcgaacgccaggacgagcggcgagcggcagctcgtctgtgccgaggagattagcgtggatgacatggagatcctgatgtaatcacgcagtgacaaaatagcaaagc

SEQ ID NO: 4838 - DNA, 707 bp, Artificial Sequence
  P23456 (35S::G3649)
acgagctcgagctcagagtgatctcagatcgtcgtcgcggtcagcgccgacgacgagcaagcttcgccggagggggaagacggtacgtacatgggccgggtggcggcgagcggcggcggcggcggcggaggggagatgatgaggtacaggggcgtgcggcggcggcggtgggggaagtgggtgtcggagatccgggtgcccgggacgcgggagcgcctgtggctcggctcctacgccaccgccgaggccgccgccgtcgcgcacgacgccgccgtctgcctcctccggctcggcggcggccgccgcgccgccgcaggcggaggcggcgggctcaacttccccgcccgcgcgctcgccgcggcggcggccgcctcctcctacggcggcgccggcggtctcctgtccccgcgctccgtgcagcgcgtggcgtccgacgccggcatggccgccgacgcgcagctcgtggacctgcgccgcgaccacccgcccgccgccgccgccgcctcatcctccggcagcggcgtggcgggagacggtgcaagaaagcaagggacacgtggcgaggttagcgacacgtattggtgtaggaatggagaggatgggagcagaagccggagctccgggagtgaggagctcattgtttacgagggcttaagtgtagatgacatggaaattttgatgtaaacagtgattattttattaatatg

SEQ ID NO: 4839 - DNA, 631 bp, Artificial Sequence
  P23465 (35S::G3643)
tcgacgcgtccgcttcttctctcagaatacacaacacaaagtcaatataattatagtatatccctatgagtaggagttcggcgatgcatggaattacaagcacaaacaacaagttgaagggagttcggcgtcgaaaatggggcaaatgggtgtcggagattcgtgttccgggcacgcaagagcgtttgtggttgggaacctacgccacgccggaggctgccgcggtggctcacgacgttgccgtctactgtctaagtaggccttcttcgttggacaaacttaacttccccgaaaccttgtcttcgtacagtgttcagctcagggacatgtctccgaggtctgtgcagaaggtggcttccgatgttggcatggatgttgatgcaagaaacattgttgcgggcaaaacttcaacggtgggggcagaaactaattgcgagagtgatgagaggactagtactgcgtctgtgtgtaatgttgttggagaaggtggtgctgatcattcggatgtgttttggtgggatgatgatggtgggtcttggcatggaagtggtggagattctacggaaagggatgccttgagcatttccattgaagattatctttagctgttctaggtttcaactttagttgc

SEQ ID NO: 4840 - DNA, 517 bp, Artificial Sequence
  P23481 (35S::G3394)
tcgacggaggtgggatggcggatgggccggggagcccgggggggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggacct

SEQ ID NO: 4841 - DNA, 624 bp, Artificial Sequence
  P23482 (35S::GAL4::G682)
gatctatgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacatggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactggc

SEQ ID NO: 4842 - DNA, 267 bp, Artificial Sequence
  P23516 (OPLEXA::G682)
tcgacatggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgaaaagtgatcaatatatctctatagtttcactggc

SEQ ID NO: 4843 - DNA, 512 bp, Artificial Sequence
  P23517 (OPLEXA::G682)
tcgacccacgcgtccgctctctcagagtactctcttagtttctttcttcttcttctttgtaatacggtgccgtttgacatggataaccatcgcaggactaagcaacccaagaccaactccatcgttacttcttcttctgaaggtaagctgaaaacttaaacaccttcgttttctcatttttccatgtttttttatacttatctatatataatgagaaatctgaattttggtgatgacaaggaacagaagtgagtagtcttgagtgggaagttgtgaacatgagtcaagaagaagaagatttggtctctcgaatgcataagcttgtcggtgacaggtttgatcttttaactaataatgaatactatttcgtaggaaaataatttaattgtaacaccatagtaaaagctgaattttgtgtgttattatttgatgaaaggtgggaactgatagctgggaggatcccaggaagaaccgctggagaaattgagaggttttgggtcatgaaaaattga

SEQ ID NO: 4844 - DNA, 544 bp, Artificial Sequence
  P23523 (35S::G3383)
tcgaccactcatcatatatcaaagcaagcagagctagctctagctagcttaatccatcttcgtcttcctctcgatcgatcgatcgatcgctgccatggaggacaaccggagcaaggacacggcgaccaagtaccgcggcgtgaggaggcggccgtggggcaagttcgcggcggagatccgcgacccggagcgcggcggggcgcgcgtctggctcggcaccttcgacaccgccgaggaggcggcgcgtgcctacgaccgcgcggcctacgcccagcgcggcgccgccgccgtgctcaacttcccggccgccgccgccgccggcaggggtggaggagccggcggcgccgcttccgggtcgtcgtcgtcgtcgtccgcgcagcgcggcaggggcgacaagatcgagttcgagtacctcgacgacaaggtgctcgacgatctcctcgacgacgagaagtaccgtggtaaatgatcaagatcatgatcagagctaggcatcttgttcttgcatgcatgcacaagaacaaatgacctaattaaacaacgc

SEQ ID NO: 4845 - DNA, 814 bp, Artificial Sequence
  P23541 (PRARSK1::G28)
ctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataatt

SEQ ID NO: 4846 - DNA, 814 bp, Artificial Sequence; identical to SEQ ID NO: 4845
  P23543 (PRLTP1::G28)

SEQ ID NO: 4847 - DNA, 814 bp, Artificial Sequence; identical to SEQ ID NO: 4845
  P23544 (PRRBCS3::G28)

SEQ ID NO: 4848 - DNA, 821 bp, Artificial Sequence
  P23554 (35S::G3000)
tcctcccctctaacaataagcagcatctctataatccctaagattcacaatggagcttggaggaaaatgcaatgcaattacaaccacaacaatgatctcaacagaagtaaagccacatacggatccggaaccagaagccaaacccgaatcagatccatccatggctttattcccgatcaagaaagaaaaccaaaaaccaaagacacgtgtcgaccaaggagctaagtaccgggaatgtcagaagaaccacgcggcctcaaccggaggacacgtggtggacggatgctgcgagttcatggccggcggagaagaaggtacactcggtgctttaaaatgcgccgcctgtaactgtcaccggagcttccaccggaaagaagtgtacggacacaggaacagtaaacaagatcatcagctgatgataactccggcgttttacagcagtaacagctcgtacaagccacgtgtaatgcatccaacgggtgagattggacggaggacttcatcttcaagcgaggatatgaagaagattctgagtcatcgtaaccaaaacgttgatgggaaaagtttgatgatgatgatgatgaggaagaagaagagagtgaggacaaagatcaatgaagaacaaaaggagaagatgaaggaatttgcagagagattagggtggaggatgcagaagaaagatgaagaagagattgataagttttgtaggatggtgaatctgaggagacaagtttttaaggtttggatgcataataacaagcaagcaatgaagagaaacaatagtaacattagtgaatagtttgatgatctgataaaagtga

SEQ ID NO: 4849 - DNA, 1302 bp, Artificial Sequence
  P25086 (35S::G30::GR)
atggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaagcggccgctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaatatcaaaaagcttctgtttcatcaaaaatctagacaggcctcgtaccggatcctctag

SEQ ID NO: 4850 - DNA, 445 bp, Artificial Sequence
  P25089 (35S::G3737)
atacaagtagtagtgagcatggaggacgacaagaaggaggcggcgagcaagtaccgcggcgtacggaggcggccgtggggcaaattcgcggcggagatccgcgacccggagcgcggcggctcacgcgtctggcttggcacgttcgacaccgccgaggaggccgcgcgagcgtacgaccgcgccgcattcgccatgaagggcgctatggccgtgctcaacttcccaggcaggacgagcagcaccggctcttcgtcgtcatcgtcatccacgccgccagctccggtgacgacgagccgccactgcgccgacacgacggagaaggtggagcttgtgtaccttgacgacaaggtgctcgacgagctccttgcggaggactacagctaccgcaacaacaacaactactgatccggccgtcgatgaactgagacggatcgacatggggccg

SEQ ID NO: 4851 - DNA, 484 bp, Artificial Sequence
  P25090 (35S::G3739)
gtcgccatcgctatggacggcgactggtccaaggacggcggaggtggagagccgaccaaatatcgcggcgtgcggcggcggccctggggcaagtacgcggccgagatccgcgactcgagccgccacggcgtccgcatctggctgggcaccttcgacaccgccgaggaggccgccagggcgtacgaccggagcgcctactccatgcgcggcgccaacgccgtcctcaacttcccggaggacgcgcacgcctacgccgccgcctgccgcggctccggatcctcctcatcctcgtccaggcataggcagcagcagcagcagggctccggcagggacgtgatcgagctcgagtacctcgacgacgaggtgctgcaggagatgctcaggaaccacgagccgtcgtcgtctgcgaggaagaagatgtaatgcaagacgactggtacacgtggcgaatgcacgttgcacatcagaatgccatgtatgcgtg

SEQ ID NO: 4852 - DNA, 422 bp, Artificial Sequence
  P25092 (35S::G3794)
agaccactgtgatatcgatggacgacggcggcgagccaaccaagtaccgcggcgtgcggcgccggccgtcggggaagttcgccgccgagatccgcgactccagccggcagagcgtgcgcatgtggctgggcaccttcgacacggccgaggaggccgcaagggcgtacgaccgcgcggcctacgccatgcgcggccaaatcgccgtgctcaacttccccgccgaggcgcgcaactacgtgcgcggcgggtcgtcgtcgtcccgccagcagcagcagggaggaggaggaggaggaggaagtggcggcggcgccggtcagcaggtgatcgagctggagtgcctggacgatcaggtgctgcaggagatgctcaagggcggcgacgggaaaaaatagttgttagcgtatctgatcacaggtgcacgt

SEQ ID NO: 4853 - DNA, 858 bp, Artificial Sequence
  P25118 (OPLEXA::G1792::(10A)12XHA)
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagagcggccgcggctgccgccgcagccgctgctagttacccatacgatgttcctgactatgcgggctatccctatgacgtcccggactatgcaggatcctatccatatgacgttccggattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccagatcctctag

SEQ ID NO: 4854 - DNA, 997 bp, Artificial Sequence
  P25119 (OPLEXA::G1792::(9A)TAP)
catggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagagcggccgctgccgctgcggcagcggccatggaaaagagaagatggaaaaagaatttcatagccgtctcagcagccaaccgctttaagaaaatctcatcctccggggcacttgattatgatattccaactactgctagcgagaatttgtattttcagggtgagctcaaaaccgcggctcttgcgcaacacgatgaagccgtggacaacaaattcaacaaagaacaacaaaacgcgttctatgagatcttacatttacctaacttaaacgaagaacaacgaaacgccttcatccaaagtttaaaagatgacccaagccaaagcgctaaccttttagcagaagctaaaaagctaaatgatgctcaggcgccgaaagtagacaacaaattcaacaaagaacaacaaaacgcgttctatgagatcttacatttacctaacttaaacgaagaacaacgaaacgccttcatccaaagtttaaaagatgacccaagccaaagcgctaaccttttagcagaagctaaaaagctaaatggtgctcaggcgccgaaagtagacgcgaattccgcggggaagtcaacctga

SEQ ID NO: 4855 - DNA, 1245 bp, Artificial Sequence
  P25147 (35S::G2999::GAL4)
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 4856 - DNA, 945 bp, Artificial Sequence
  P25158 (35S::G3674)
atggatttcgacgaccatgacgagggtgacggcgacgaggagatgcctccgatgcctctgagctcgggctacgacgcgccgatgcagcccgggcttggaggtggcggtggcggggtgcccaagccgggaggtggagtcggcggcggcggtggtggtggtggtggtggtggaggaggaggggcgaggtatcgggagtgcctcaagaaccacgccgtcggcatcggcgggcacgccgtggacggctgcggcgagttcatggcttccggcgaggagggctccatcgacgcgctccgctgcgccgcctgcggctgccaccgtaacttccaccgcaaggagtcggagtcccccacgggcgtcgggccggccgagccttccgccgtgtcccccgccgccatctcggcctacggcgcctcgccgcaccaccagttctccccctactaccgcaccccggcagggtacctccaccaccagcagcaccagatggcggccgcggcggcggccgcggccgccgccgcagcgggcggctacccgcagcggcccctcgcgctgccgtccacctcccactcgggacgcgacgagggcgacgacatgtccgggatggtcggccccatggtgattggccccatggtcggcatgtccctcggctccgccggcccctccggctccggctccggcaagaagcggttccgcacaaagttcacgcaggagcagaaggacaagatgctcgccttcgcggagcggctcgggtggcgcatccagaagcacgacgaggccgccgtgcagcagttctgcgaggaggtctgcgtcaagcgccatgtcctcaaggtttggatgcacaacaacaagcacaccctgggcaagaaggcgccatagctaagctaagccaagcaagctcagctcagctcatctcctcccggtgctaggtacctgcactgcaactgcaac

SEQ ID NO: 4857 - DNA, 774 bp, Artificial Sequence; identical to SEQ ID NO: 2061
  P25159 (35S::G3676)

SEQ ID NO: 4858 - DNA, 1098 bp, Artificial Sequence; identical to SEQ ID NO: 2065
  P25163 (35S::G3681)

SEQ ID NO: 4859 - DNA, 1009 bp, Artificial Sequence; identical to SEQ ID NO: 2067
  P25165 (35S::G3683)

SEQ ID NO: 4860 - DNA, 821 bp, Artificial Sequence
  P25166 (35S::G3685)
ccggaccggaccggacagaggcatgtcctgatggaattcaggggccatgacgaacccgtcgacgagatgggagtcgcgtacggcaggacgccaccctcctcctcctcctcccccgccgcctccgcctccgcggggaacggcgccggcgcggcggaggtgaggtaccacgagtgcctgcgcaaccacgccgcggcgatgggcggccacgtcgtggacggatgcagggagttcatgccgatgccgggggacgccgccgacgccctcaagtgcgccgcctgcggctgccaccgcagcttccaccgcaaggacgacgggcagcagcagcagcagctgcgcctgctcatcccgtccccgcccacgccgcgcgtcccgctgctcatgccgccgccgcagccgcagccgcacccgcacccgcaacacccctacctgcacccgccgttcccgtaccaccacaccccaagcggcagcggcggcacgacgaccgagtcgtccagcgaggagcgggggcctccctcctcgtcggcggcggcggcgcaggggcggcggaagcggttccggaccaagttcacgccggagcagaaggagcagatgctggcgttcgcggagcgggtggggtggcggatgcagaagcaggacgaggcactcgtcgaacagttctgcgcgcaggtcggcgtgcggcgccaggtgttcaaggtgtggatgcacaacaacaagagcagcatcggcagcagcagcggcggcggcagtaggaggcagccgcaggagcaacagtcacaacagcagcagcagcagcagtagccatgggaggagacaagcatttg

SEQ ID NO: 4861 - DNA, 743 bp, Artificial Sequence; identical to SEQ ID NO: 2071
  P25167 (35S::G3686)

SEQ ID NO: 4862 - DNA, 1200 bp, Artificial Sequence
  P25173 (35S::GAL4::G2999)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgattgccaccggagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4863 - DNA, 435 bp, Artificial Sequence
  P25182 (35S::G47(AA1-27)::G1277(AA35-61)::G47(AA55-144))
atggattacagagaatccaccggtgaaagtcagtcaaagtacaaaggaatccgtcgtcggaaatggggcaaatgggtatcagagattcgagaacccaacaagcgttcaagactttggctcggctcttactctactcccgaagcggcggcgcgtgcatacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttga

SEQ ID NO: 4864 - DNA, 825 bp, Artificial Sequence
  P25186 (35S::GAL4::G47)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccgtcgacatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4865 - DNA, 689 bp, Artificial Sequence; identical to SEQ ID NO: 2079
  P25204 (35S::G3719)

SEQ ID NO: 4866 - DNA, 666 bp, Artificial Sequence
  P25205 (35S::G3720)
atggcggcagtcggagcgcacccagtgctgtaccaccacccggcgccggcgggcgacgcctcctccatgtcctcctacttctcccacggaggcagctccaccacctccagctctgcgtccagcttcaccgccgcgctcgcgccgacgacgacggcgctcgccgagcatttcgacatctccgagttcctcttcgacgacgctgcgggcgctggggtcgccggcgcgccaggtgtgttcgccgatggcgcggcccgccccgtcgtcctgccggtgccggatgccgctggtggtggtgcaattatcggcgcagccgctgggggcgcggctgcggcgtcggaggtgccagagcggccgcggacgacgcggatcgcgttccggacgaggtcggagatcgagatcctggacgacggctacaagtggaggaagtacggcaagaagtccgtcaagaacagccccaacccaaggaactactaccggtgctcgacggaagggtgcaacgtgaagaagcgggtggagcgggacaaggacgaccccagctacgtggtgacgacgtacgaggggatgcacaaccacgtcagccccagtacggtgtactacgccagccaggacgccgcctccggccgcttcttcgtcgccggcacgcagccaccgggctccctcaactga

SEQ ID NO: 4867 - DNA, 680 bp, Artificial Sequence; identical to SEQ ID NO: 2085
  P25207 (35S::G3722)

SEQ ID NO: 4868 - DNA, 625 bp, Artificial Sequence; identical to SEQ ID NO: 2087
  P25208 (35S::G3723)

SEQ ID NO: 4869 - DNA, 831 bp, Artificial Sequence; identical to SEQ ID NO: 2091
  P25210 (35S::G3725)

SEQ ID NO: 4870 - DNA, 729 bp, Artificial Sequence; identical to SEQ ID NO: 2093
  P25211 (35S::G3726)

SEQ ID NO: 4871 - DNA, 618 bp, Artificial Sequence
  P25213 (35S::G3728)
atggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagccttctga

SEQ ID NO: 4872 - DNA, 744 bp, Artificial Sequence
  P25214 (35S::G3729)
gatgtcgtcgctgtacccgtctctcctctcgctgagcgagagccccgccgagtaccggcaggtcggcggtggccgctacgcgggggaggacgtcgtcgacgacgacgacgacatggctgccgtcgccgacgctgtgtccagctacctctccttcgacatggacgacgtcgagtattacacgccggaggtgggcttccactcaaagcagcacaacccgccgccagttgctgcggcgccactggaagccggaggaggcagggagcaaagccggcgggaagccgccgtcaatcttggcaagatggacaggggaccggcgccggtgagcggcggcgcggcgactggcggcgtgccgaggagcaagaacggcagcaagatcgcgttcaagacgaggtcggaggtggacgtgctggacgacggctaccggtggaggaagtacggcaagaagatggtcaagaacagccccaacccaaggaactactaccggtgctcgagcgaggggtgccgcgtgaagaagcgggtggagcgcgcccgggacgacgcgcgcttcgtcgtcaccacctacgacggcgtccacaaccacccggcgccgctgcacctcaggccgcagctgccgccgcccggcggctactcgatcgccggggcaccggccgtggtggcgccgcacggccgcctcgggctggaggaggccgaggtgatcgctctcttcaggggcaccaccgccacctcgctgctgcttccttgacc

SEQ ID NO: 4873 - DNA, 731 bp, Artificial Sequence; identical to SEQ ID NO: 2101
  P25215 (35S::G3730)

SEQ ID NO: 4874 - DNA, 628 bp, Artificial Sequence; identical to SEQ ID NO: 2133
  P25218 (35S::G3803)

SEQ ID NO: 4875 - DNA, 621 bp, Artificial Sequence
  P25219 (35S::G3804)
caatggcgacttcgctgggactgaaccctgaagatctcttcacttcgtactcgtcttcctactactcctcgccgccgttcatgtccgactacgcggcgagcttcacgccggcggccggggactccacggccttctcctcggagctcgacgaccttcaccacttcgactactcaccggcgccgatcgtcactgctgccggagccggggctgggggcggcgatcgcaacgagaagatgatgtggtgtgagggtggtggtgacgagagaagactcagaagcaacggaaggatcgggttcagaacgaggtcagaggtggagatcttggacgacggattcaagtggaggaagtacgggaagaaggccgtcaagaacagcccaaatccaaggaactactaccgctgctcgtcggagggctgcggcgtgaagaagcgggtggagagggaccgcgacgacccccgctacgtcatcaccacctacgacggcgtccacaaccacgccagccccggagccgctgctatcatcgtcccgtacggcagcggcggcggcaatagcggcttctacagcccgccgcacagcggctccccgtcggccacctcctactcgggctccctagtcttctgac

SEQ ID NO: 4876 - DNA, 1164 bp, Artificial Sequence; identical to SEQ ID NO: 2111
  P25230 (35S::G3746)

SEQ ID NO: 4877 - DNA, 885 bp, Artificial Sequence
  P25233 (35S::G3750)
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcatgagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctag

SEQ ID NO: 4878 - DNA, 712 bp, Artificial Sequence
  P25241 (35S::G3765)
atgaaaggtgttggaaactatagtggggtcaatggcaatgatggtgaacttagtctatctatgaacagaatgaagaatcacattagcttctcatcaataagtccttcttcttccttgggaatgctatcaccaacctccaaaatgggcacggagggtattagggtaactagacctgaggatgggagacagggaagttgcaatggtgatgctcgatattatggtcctggattcccttatgcttcttggaatgagccctcacaccccaaaagacagcgaagtagtaatgatgagttactttttgattctcagaatggagagccaggaaatcaagttcaaaggctttcgcatcatttgagtttgccaagaacgtcgtcggagatgtttgctatggataatttgcttcagttctcagattctgttccttgtaaaatcagagcaaagagaggctttgctactcatcctcgaagcattgccgaaagggtgagaagaacaaggatcagtgaacgaataagaaaattgcaagagcttgttccaaccatggacaagcaaactagcacagcagagatgttggacttggctttagactacataaaagatcttcagaaacaattcaagactctgagcgataaacgggctaaatgcaaatgtataaacatgcagaagtcagaagcagatcgagttgcttgagtttcttttgtacagggctgccagg

SEQ ID NO: 4879 - DNA, 380 bp, Artificial Sequence
  P25242 (35S::G3766)
taatatgttatcacatcacttgagtttaccaaaaacttcagcagagatgattactatggagaagttgcttcagttccctgattctgttccttgtaaaatcagagcaaagcgaggctgtgctactcatcctcgaagcattgctgaaagggtgagaagaactcggatcagtgaaagaatgaggaaattacaagagcttgtcccacacatggataagcaaaccaacacagcagacatgttggacttggctgttgaatacattaaagatcttcagaaacaattcaagactctaagtgaaaaaagggcaaactgcaagtgtataagcatgccaaaggcagatacaaatcaaattgcttgatcacctttctttatgagcaatgcat

SEQ ID NO: 4880 - DNA, 666 bp, Artificial Sequence
  P25243 (35S::G3767)
atggggactttgggggctgttaataacagtatcgaagatgcaaaattttctagttcgagaaggttgaagaatcaaccgaactattcttcgtcggggagaatgtcgtccattgctgaaattggggacaaagggaatcgagaaagtagtccagacaatgaagcttttgctgatggtaacgattttatcaccggtttccaagttggtcattgggatgatgctgcaatcatgtctgacaacgttggtggtctcaaaagatttagagaaaacgattcaaaaccattttctggcttaaatgcggctgagactcagaatgaaacaggacagactcatgctcctttggcccatcagttgagtttgccaaatacttcagctgaaatagctgccattgagaagtttctgcagttttcagattctgttccgtgcaaaatccgtgccaaacggggctgtgccactcacccaagaagcattgcagagagggttagaagaactaaaattagtgagcgtatgaggaaacttcaagatcttgtcccaaacatggacaagcaaactaacacagctgatatgttggacttggctgtggattacatcaaagaccttcaaaagcaagttcagacgctttcagattgtcatgcaaagtgtacgtgttcacacgagaagcaacaataa

SEQ ID NO: 4881 - DNA, 798 bp, Artificial Sequence
  P25244 (35S::G3768)
atggagcaaggatcgttttcaatgggactcaggcatagtggaaataattctaaccttaccaggcatagtagctctcccgcaggactattttcccaaattaacattgaaaatgtgtatgctggtgtgagaggcatggggagtttgggagctgttaacaacagtatcgaagatgcgaaattttctagttcgaggaggttgaagaatcaaccgaactattcttcgtcggggagaatgtcgtccattgctgaaattggggacaaagggtatagagaaagtagtccagacagtgaagcttttgctgatggtaacgattttatggccggtttccaagttggtcattgggatgatactgcaatgatgtctgacaacgttggtggtctcaaaagatttagtgaagaagattcaaaaccattttctggcttaaatgcggttgagactcagaatgaaacgggacagactcatgctcctttggcccatcagttgagtttgccaaatacttcagctgaaatggctgccattgagaagtttctgcagttttcagattctgttccgtgcaaaatccgtgccaaacggggctgtgccactcacccaagaagcattgcagagagggttagaagaactaaaattagtgagcgtatgaggaaacttcaggatcttgtcccaaacatggacaagcaaactaacacagctgatatgttggacttggctgtggattacatcaaagaccttcaaaagcaagttcagacactttcagattgtcatgcaaagtgtacgtgttcacacgagaagcaacaataa

SEQ ID NO: 4882 - DNA, 948 bp, Artificial Sequence; identical to SEQ ID NO: 2127
  P25245 (35S::G3769)

SEQ ID NO: 4883 - DNA, 474 bp, Artificial Sequence; identical to SEQ ID NO: 2129
  P25246 (35S::G3771)

SEQ ID NO: 4884 - DNA, 1554 bp, Artificial Sequence
  P25263 (35S::G1073::GFP)
atggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4885 - DNA, 1161 bp, Artificial Sequence
  P25271 (35S::G1792::GFP)
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagatgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4886 - DNA, 1167 bp, Artificial Sequence
  P25281 (35S::G481::GFP)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4887 - DNA, 2241 bp, Artificial Sequence
  P25287 (PRRBSC3::G481::GFP)
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaaccttatcatcattatatatacaaggggatactagagaccaattattgtcaacaagatctggtaccatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4888 - DNA, 969 bp, Artificial Sequence
  P25290 (35S::G682::GFP)
atggataaccatcgcaggactaagcaacccaagaccaactccatcgttacttcttcttctgaagaagtgagtagtcttgagtgggaagttgtgaacatgagtcaagaagaagaagatttggtctctcgaatgcataagcttgtcggtgacaggtgggaactgatagctgggaggatcccaggaagaaccgctggagaaattgagaggttttgggtcatgaaaaattgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4889 - DNA, 1062 bp, Artificial Sequence
  P25296 (PRG306::G1816::GFP)
atggataacactgaccgtcgtcgccgtcgtaagcaacacaaaatcgccctccatgactctgaagaagtgagcagtatcgaatgggagtttatcaacatgactgaacaagaagaagatctcatctttcgaatgtacagacttgtcggtgataggtgggatttgatagcaggaagagttcctggaagacaaccagaggagatagagagatattggataatgagaaacagtgaaggctttgctgataaacgacgccagcttcactcatcttcccacaaacataccaagcctcaccgtcctcgcttttctatctatccttcctgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4890 - DNA, 1776 bp, Artificial Sequence
  P25301 (35S::G867::GFP)
atggaatcgagtagcgttgatgagagtactacaagtacaggttccatctgtgaaaccccggcgataactccggcgaaaaagtcgtcggtaggtaacttatacaggatgggaagcggatcaagcgttgtgttagattcagagaacggcgtagaagctgaatctaggaagcttccgtcgtcaaaatacaaaggtgtggtgccacaaccaaacggaagatggggagctcagatttacgagaaacaccagcgcgtgtggctcgggacattcaacgaagaagacgaagccgctcgtgcctacgacgtcgcggttcacaggttccgtcgccgtgacgccgtcacaaatttcaaagacgtgaagatggacgaagacgaggtcgatttcttgaattctcattcgaaatctgagatcgttgatatgttgaggaaacatacttataacgaagagttagagcagagtaaacggcgtcgtaatggtaacggaaacatgactaggacgttgttaacgtcggggttgagtaatgatggtgtttctacgacggggtttagatcggcggaggcactgtttgagaaagcggtaacgccaagcgacgttgggaagctaaaccgtttggttataccgaaacatcacgcagagaaacattttccgttaccgtcaagtaacgtttccgtgaaaggagtgttgttgaactttgaggacgttaacgggaaagtgtggaggttccgttactcgtattggaacagtagtcagagttatgttttgactaaaggttggagcaggttcgttaaggagaagaatctacgtgctggtgacgtggttagtttcagtagatctaacggtcaggatcaacagttgtacattgggtggaagtcgagatccgggtcagatttagatgcgggtcgggttttgagattgttcggagttaacatttcaccggagagttcaagaaacgacgtcgtaggaaacaaaagagtgaacgatactgagatgttatcgttggtgtgtagcaagaagcaacgcatctttcacgcctcgtgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 4891 - DNA, 1368 bp, Artificial Sequence; identical to SEQ ID NO: 2137
  P25313 (35S::G3810)

SEQ ID NO: 4892 - DNA, 1007 bp, Artificial Sequence
  P25360 (35S::G3760)
atgcagcccactacgcgggaaatgcaggccatggccgccgccggccagcagatctccctcgacgacctccgcgcggcagcaggcggcgtgcacgacgacttcctggaccagatgctcggaggcctgccgccgtcggcatggccggagctgtcgtccgcggcgggagggaaggcgccggatggcggcgcgcaggcggagcagatgcagcaccagccgcagcacttgggtgggggtgggggcctgtacgacgactccgccttgctggcgtcgcggctccggcagcaccaaatcagcggcggcggcggcggggaggccgtgaagcagatggtgctgcagcagctggccgatctgaggcaggaacaccatgtgttgctgcagggcatgggccgctcgacctcgacgggcggcagcagagacggcggcctgctcctcccgctctctctcggcagtggcggatcgggcggcgacgtgcaggcgctactcaaagctgtagccgactccgccggaggagaagccgcaggcgtcttcggcggttccttcgccggatcgctccaccaccaccagcagcagcagcagcattttcaatcacatccgcagcagcaaacggcgccgttgccggggcagggcttcggtggaggcgcgggcgcgtccggcggcgtgtcgcagccgcaggccggcgctgcgtgcggaggcgccgccgcgccgcccaggcagcgggtacgggctcggcgcggccaggccaccgacccccacagcatcgcggagcggctccggagagagaggatcgcggagaggatgaaggcgcttcaggagctggtgcccaacgccaacaagacggacaaggcgtcgatgctggacgagatcgtcgactacgtcaagttccttcagctccaagtcaaggtgctgagcatgagccggctaggtggtgccgctgccgtcgcgccgctggtggccgacatgtcctcggagggtcgaggcggcgtggcggtcgcggccgggagcgatga

SEQ ID NO: 4893 - DNA, 597 bp, Artificial Sequence
  P25368 (35S::G3721)
caatggcggcttccgtaggactgaaccctgaagctttcttcttcagcaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaagaaactactaccggtgctcgacggaggggtgcaacgtgaagaagcgagtggagagagaccgggaggaccaccgctacgtcatcaccacctacgacggcgtccacaaccacgcgagccccgccgccgccgccgcggcgctgcagtacgccgccgccgccggcgactactacagcccgccgctcagcagcgccggctcgccgccggccgcctattcggcaggcggctcgctgctcttctgagggctgatga

SEQ ID NO: 4894 - DNA, 455 bp, Artificial Sequence
  P25370 (35S::G3744)
atgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctagaaagc

SEQ ID NO: 4895 - DNA, 662 bp, Artificial Sequence; identical to SEQ ID NO: 2089
  P25384 (35S::G3724)

SEQ ID NO: 4896 - DNA, 663 bp, Artificial Sequence; identical to SEQ ID NO: 2095
  P25385 (35S::G3727)

SEQ ID NO: 4897 - DNA, 1286 bp, Artificial Sequence; identical to SEQ ID NO: 2063
  P25405 (35S::G3680)

SEQ ID NO: 4898 - DNA, 789 bp, Artificial Sequence
  P25407 (35S::G3690)
gcggcgcggatgggcgcgcacgtgctcgacggctgcggcgagttcatgtcgtcccctggcgacggcgccgcggcgctggcctgcgccgcgtgcggctgccaccgtagcttccaccgccgcgagccggcggtcgtcgcgccggcctcgctctcgctctgccccgcctccgcctccgcctccgccgccgccggcctggtgtccctatccccctccgcgacgcccaccggcgccaactcctcccggctcatgccgctcctcctcgccccgccgcacatgcagaagcgcccgcccgtcctccccgtgtccccggcgtctgcgcccgccgcgctggccgagtcgtcaagcgaggagctgcgcccgccgccgctcccctcttcccacccccacgcgcacgcggccgccgtggtggcggcgtcggcctccgcgccgccggggccgagcaagaagcgcttccggaccaagttcacggcggagcagaaggagcggatgcgtgaattcgcgcaccgcgtcgggtggcgcatccacaagcccgacgccgccgccgtcgacgcgttctgcgcccaggtcggcgtctcccgccgcgtcctcaaggtgtggatgcacaacaacaaacacctcgccaagacgcccccgtcgccgacatcgcagccgccgccgccgccgctccaccacgatccttctcctcctccccctcctcaccaccaccaccaccaccatcaccaccaccacccaccacaacaccatcagcagcagcagcagcagcatgatgcatgagagagtgagcgagta

SEQ ID NO: 4899 - DNA, 1356 bp, Artificial Sequence
  P25424 (35S::G3811)
atgatgtctctgtcagtttcacctagcttaggatctccctaccaaatgaaatgcgagcaaaggggtttggtattaatccatttgttgctcgctggtgctaattttgtagccaccggtgatttacaaaatgcaaacctcacacttgagcagatttcccagcatgcctctcttgatggggatactatgcagcgaattgcttcttatttttctgaagcactcgctgatcggatacttaaaacatggcctggcatccacagggccctcaattccagcagaataactatggtttctgatgaaattcttgttcaaaagctcttctttgagcttttacccttcctcaagttctcatatatcctcactaatcaggctattgttgaagccatggaaggggagaaaatggtgcatatagttgatctctatggggccggaccggcacagtggatttctctcctccaagttttgagtgcacgtcctgaaggtcctccccatttgagaatcaccggggtccatcacaagaaagaggttctggatcagatggctcataaactcactgaagaggcggaaaagttggatatcccattccaattcaaccctgtgctaagcaagttggaaaatcttgatttcgacaaacttcgcgttaaaactggggaggcactggcaataagttctattctgcagttgcactcccttttggccttggatgaagatgcctcgcggagaaaatcgcctcttttgtcaaaaaactcaaatgcaattcacctgcagaaaggcctcctcatgaaccataacacactgggagatttgcttgacggctatagcccgagtcctgattcggcctcatcctcaccagcagcgtcttcatctgctttgatgaattcggagagctttcttaatgccttgtgggggttatccccaaaagtcatggttgtaactgaacaagactttaaccacaactgtttgaccatgatggagagactggcagaagctctattttcttatgctgcatattttgattgcttggagtccacggtctcaagagcatccatggacagattaaaacttgagaagatgctttttggcgaggagataaagaacatcatagcttgtgaaggatgtgaaagaaaagaaaggcacgaaaagatggataggtggatccagagacttgacttatctggatttgcaaacgtgcctataagctattatgggatgctgcagggaaggaggttcttgcagacctatggttgtgaggggtacaagatgagggaggaatgtggtcgggtgatgatatgctggcaggagcgatccttgttttccataacagcttggagaccaaggaagtaagataaagaagaaaat

SEQ ID NO: 4900 - DNA, 583 bp, Artificial Sequence
  P25426 (35S::G3755)
actgagcttctcgtcacggcaggggtcattgatgtcccagatctcagagatggacagcgaggaggtcggagggagcagcccagaggcttccggcggcggcggcagggggtacatccctgggtacccaatgggctctgggtgggaggactcgtcggctctcttgtcagacaatttgtctggcgtcaaacgcccccgggactcgtcggagcctggccagagcggccttacgcaccagttcagcgtgcccaagacgtcgtccgagatggcaactattgagaaattcctccagttccaggacgccgtgccttgtaagatccgtgccaagcgggggtgcgccactcatccacgcagcatcgctgagagggtgaggagaacaaagatcagtgagcgaatccgaaagctgcaagaactcgttccaaatatggacaagcaaaccaacacatctgacatgctggatttggctgtcgactacatcaaggatctccagaagcaggttaaggtactaaaggagagccaagataactgcacctgctcagcaagcaagaaccagcagcactcctgctgaaaccgtaatgctcactgt

SEQ ID NO: 4901 - DNA, 585 bp, Artificial Sequence
  P25435 (35S::G1274(AA1-109)::G179(AA65-121)::G1274(AA167-194))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggatacaggtggaggaagtacggccaaaaagcagtcaagaacaatccattccccaggagctattataagtgcacagaagaaggatgcagagtgaagaagcaagtgcagaggcaatggggagacgaaggagtggtggtgacgacataccaaggtgttcatacacatgagagtctctctaatgtctattacaatgaaatggttttatcttatgatcatgataactggaaccaacactctcttcttcgatcttaa

SEQ ID NO: 4902 - DNA, 348 bp, Artificial Sequence
  P25437 (35S::G1792(AA1-115))
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagataa

SEQ ID NO: 4903 - DNA, 691 bp, Artificial Sequence
  P25438 (35S::G1792(AA1-115)::GAL4)
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 4904 - DNA, 444 bp, Artificial Sequence
  P25439 (35S::G179(AA1-64)::G1274(AA110-166)::G179(AA122-147))
atggaggataggaggtgtgatgtgttgtttccatgttcatcatcggttgatcctcgcttgacagagtttcatggggtcgacaactctgctcagccgacaacatcatccgaagagaagccaaggagtaagaagaagaagaaagagagagaagcgaggtacgcgttccagacaagaagccaggttgatatactggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgccgttgataaaccctctgataatttccaccacatcttgacacaaatgcacatcttccctcccttttgcttgaaggaatga

SEQ ID NO: 4905 - DNA, 1124 bp, Artificial Sequence
  P25440 (35S::G45(AA1-321)::G1792(AA116-139))
atggtacgtgtgtgtgtgtatacacagaaaacccctgattttatgtggaacctaaaaccctccatgaaatgcggtcagtaccttagaacacaagtttcaccaactgtacttcccaattatcctgccgcagatttcccattcaacgtacacacaaaacccccaaagcaacaatctctttaaaatgccctaaatctcaccaacacatactcctctctgattcaacaatggcttttggcaatatccaagaactagacggcgagatcctaaagaacgtttgggcgaattacatcggaacaccacaaaccgatacaagatcaattcaagttccagaagtttctagaacttgggaagcgttgcctacccttgatgacataccagaaggttctagagaaatgcttcaaagcctagatatgtcgacggaggaccaggaatggacagagattctcgatgctattgcttctttcccaaacaaaaccaatcatgatccattaaccaaccctaccattgattcatgttctttgtcttctcgggtttcttgcaaaacaagaaaatacaggggagtacggaagcgtccgtgggggaaatttgcagccgaaatcagggattcgacgagaaacggtgttagggtttggctcggaacgttccaaactgcagaggaagcagctatggcttacgataaagccgcggttagaattagaggtactcaaaaagctcacacaaattttcagctcgaaacagttataaaagctatggaaatggattgcaacccaaactactaccggatgaacaactcaaatacgtccgatccattaagaagcagccgcaaaatcggattgagaacaggaaaagaggcggttaaggcttatgatgaagtcgttgatgggatggttgaaaaccattgtgcccttagctattgttcaactaaggagcactcggagactcgtggtttgcgtgggagtgaagaaacttggttcgatttaagaaagagacgaaggagtaatgaagattctatgtgtcaagaagttgaaatgcagaagacggttactggagaagttttcgagtttgagtatttggacgataaggttcttgaagaacttcttgattcagaagaaaggaagagataa

SEQ ID NO: 4906 - DNA, 402 bp, Artificial Sequence
  P25445 (35S::G1792(AA1-80)::G30(AA81-133))
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtataacatgggaaccggatcctcatccactgcggctaattcttcttcctcgtcgcagcaagtttttgagtttgagtacttggacgatagcgttttggatgaacttcttgaatatggagagaactataacaagactcataatatcaacatgggcaagaggcaataa

SEQ ID NO: 4907 - DNA, 420 bp, Artificial Sequence
  P25446 (35S::G30(AA1-80)::G1792(AA81-140))
atggatcaaggaggtcgtagcagtggtagtggaggaggaggagccgagcaagggaagtaccgtggagtaaggagacgaccttggggtaaatacgccgcggaaataagagattcgaggaagcacggagagcgtgtgtggctagggacattcgacactgcggaagacgcggctcgagcctatgaccgagccgcctattcaatgagaggcaaagctgccattctcaacttccctcacgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 4908 - DNA, 411 bp, Artificial Sequence
  P25447 (35S::G1792(AA1-80)::G1795(AA76-131))
atggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtataacatggggagtggtgtctcttcttccaccgccatggctggatcttcctccgcctccgcctccgcttcttcttcttctaggcaagtttttgaatttgagtacttggatgatagtgttttggaggagctccttgaggaaggagagaaacctaacaagggcaagaagaaatga

SEQ ID NO: 4909 - DNA, 405 bp, Artificial Sequence
  P25448 (35S::G1795(AA1-75)::G1792(AA81-140))
atggatcaaggaggtcgaggtgtcggtgccgagcatggaaagtaccggggagttcggagacgaccttggggaaaatatgcagcagagatacgagattcgaggaagcacggtgaacgtgtgtggcttggaacgttcgatacggcagaggaagcggctagagcctatgaccaagctgcttactccatgagaggccaagcagcaatccttaacttccctcatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 4910 - DNA, 957 bp, Artificial Sequence; identical to SEQ ID NO: 2167
  P25571 (35S::G3848)

SEQ ID NO: 4911 - DNA, 988 bp, Artificial Sequence
  P25572 (35S::G3856)
ggaagttcatttcatttggagaggacacgctgacaagctgactctagcagatctggtaccgtcgacatgctgcttaacccggcgtgcgaggcggcagcgccgatggacagcatccggcatcacctcctggacgagccggcggcggcggcgaccgcgagcgcggctccgcggccggtgtactgccgcagcacgagcttcggcagcctagtggcggaccaatggagcgagtcgctcccgttccgccccgacgacgccgacgacatggtcgtcttcggcgcgctccgcgacgccttttcccagggctggctccccgacggctccttcgccgccgtgaagcccgagcccctggcgttcccggactccccctacgagcgcggatcctatccctgccttggtggcttccttctcgcggaggggcctgagacgccgaccgaggcggcgacgacgcccgggagcgaggaggaggccgcggcggcggtgtccagggggaagcactaccgcggggtgaggcagcggccgtggggcaagttcgcggcggagatccgggacccggccaagaacggcgcgcgcgtgtggctgggcacgtacgacagcgccgaggacgccgccgtggcctacgaccgcgccgcgtaccgcatgcgcggctcccgcgcgctcctcaacttcccgctccgcatcggctccgagatcgccgcggcggccgccgccgtcgcggccactgcccctgccgcgggagacaagcgggcgtccccagagccgaccgcgagctccgactcctccccttcggcctcctctgcgacaccgaagcggaggaagagaggcgaggccgctgccgcgaccatggccatggcccttgtgccgcccccgccggcggcgcaggcgcccgtccagctgaccctcccggcccgtccgtggttcgccgccggccccgtccagcagctagtgagctaatctagacaggcctcgtaccggatcctctagctagagc

SEQ ID NO: 4912 - DNA, 705 bp, Artificial Sequence; identical to SEQ ID NO: 2157
  P25573 (35S::G3841)

SEQ ID NO: 4913 - DNA, 557 bp, Artificial Sequence; identical to SEQ ID NO: 2189
  P25657 (35S::G3876)

SEQ ID NO: 4914 - DNA, 936 bp, Artificial Sequence
  P25658 (35S::G1274::GAL4)
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 4915 - DNA, 936 bp, Artificial Sequence
  P25659 (35S::GAL4::G1274)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccatgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4916 - DNA, 1499 bp, Artificial Sequence
  P25660 (35S::G3086::GAL4)
atggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaagctag

SEQ ID NO: 4917 - DNA, 917 bp, Artificial Sequence
  P25661 (35S::G3742)
atggcctcgcatcagcagcagctcatgtaccagtcgcatcagcagcagcagcagatggcttccgccatggagggactctaccgcaccgtcagctccggcggcacggagtccaccgccgccgccgccggcaacagcctcctccggcagagcagctcccccgccggcttcctcaaccatcttaccatggacaacggatacgggaatatgctaagagcgggcatgggcggcggcggcggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacagccgttccagctgcacctgctcggcgagcaagcagaagcacttcgccggctaaatcaatcaagtcaatcaatcgccatg

SEQ ID NO: 4918 - DNA, 1491 bp, Artificial Sequence
  P25662 (35S::GAL4::G3086)
atgcccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagggtaccatggaatcagaattccagcaacatcacttccttctccacgatcatcaacaccagagaccaagaaactcaggattgattcgttaccaatcagcaccaagttcgtacttttcgagtttcggtgaatcaatcgaagagtttttagatcgacccacaagtcctgaaactgagcgaatcttatctggctttttacaaaccaccgacacaagcgacaacgttgatagtttccttcaccatacttttaacagtgatggaactgagaagaaacctccggaagttaaaacagaggacgaagatgctgaaattccggtgactgcgacggcgacggcgatggaggttgttgtttccggtgatggtgaaatctcagtgaatcctgaagtatcgattgggtatgtggcttcggtttcgaggaataagagaccaagagagaaagatgatcggactccggtgaataatctagctcgtcataatagttcaccggccggattattttcatccattgatgttgaaacagcttatgcagctgtaatgaaaagtatgggaggttttggaggaagtaatgtgatgagtacaagcaatactgaagcttcgtctcttactcctagaagcaagttacttcctcctacttctagagcgatgagtccgatctctgaggttgatgttaaacccggtttctcgtctagattgcctcctcggacgctttccggtgggtttaatcgttcttttgggaatgaagggtctgcttcttccaagcttacagctcttgctaggacccaatctggaggtctagatcaatacaaaaccaaggatgaggattcagcaagtagacgtcctcctttggcacatcacatgagtttgcccaagtctttatcagatattgaacagttactgtcagattctatcccatgtaagatcagagccaagcggggttgtgcaactcatcctcgaagcatagccgagagggtgagaagaaccaagatcagtgaaagaatgaggaagctgcaagaccttgttccaaacatggacacgcaaacaaacacagcagacatgttggatcttgcggttcaatacatcaaggacctgcaagaacaagtgaaggcgctcgaagagagtcgggcaagatgtagatgctctagtgcgtga

SEQ ID NO: 4919 - DNA, 1048 bp, Artificial Sequence
  P25703 (35S::G1073L)
ttttgtctttgtctctcactagctataaccaaaaaaaaatccaaaaacccaaaccacagtttcttgtttttgttatcaatgtctagttatatgcaccctcttctagggcaagaactgcatctacagagacctgaagattccagaaccccacctgatcaaaataacatggaacttaacagatctgaagcagacgaagcaaaggccgagaccactcccaccggtggagccaccagctcagccacagcctctggctcttcctccggacgtcgtccacgtggtcgtcctgcaggttccaaaaacaaacccaaacctccgacgattataactagagatagtcctaacgtccttagatcacacgttcttgaagtcacctccggttcggacatatccgaggcagtctccacctacgccactcgtcgcggctgcggcgtttgcattataagcggcacgggtgcggtcactaacgtcacgatacggcaacctgcggctccggctggtggaggtgtgattaccctgcatggtcggtttgacattttgtctttgaccggtactgcgcttccaccgcctgcaccaccgggagcaggaggtttgacggtgtatctagccggaggtcaaggacaagttgtaggagggaatgtggctggttcgttaattgcttcgggaccggtagtgttgatggctgcttcttttgcaaacgcagtttatgataggttaccgattgaagaggaagaaaccccaccgccgagaaccaccggggtgcagcagcagcagccggaggcgtctcagtcgtcggaggttacggggagtggggcccaggcgtgtgagtcaaacctccaaggtggaaatggtggaggaggtgttgctttctacaatcttggaatgaatatgaacaattttcaattctccgggggagatatttacggtatgagcggcggtagcggaggaggtggtggcggtgcgactagacccgcgttttagagttttagcgttttggtgacaccttttgttgcgtttgcgtgtttgacctcaaactactaggctacctata

SEQ ID NO: 4920 - DNA, 505 bp, Artificial Sequence
  P25732 (35S::G47(V31E))
cttcttcttcacatcgatcatcatacaacaacaaaaaatggattacagagaatccaccggtgaaagtcagtcaaagtacaaaggaatccgtcgtcggaaatggggcaaatgggtatcagagattagagagccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4921 - DNA, 505 bp, Artificial Sequence
  P25735 (35S::G47(V55T))
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacacagctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatctt

SEQ ID NO: 4922 - DNA, 954 bp, Artificial Sequence
  P25736 (35S::G2999(CHR123-125GLL))
gcttagggttttggagagagattactaagaaagttttaatgtttgtttaagagaaaagttatatattagggttttctttattcagaagcttcaagatcagaaaagatggaagttagagagaagaaagatgagaaaatggagatgacaagaagaaaatcatcagctctagatcatcatcgtcttcctccgtacacttactcccaaaccgccaacaaagagaaacccaccaccaaaagaaacgggtcggacccggatccggatccggatcttgatactaacccaatttctatatctcatgctccaagatcatacgctaggcctcaaactacttctccggggaaggcaaggtatagagaatgccaaaagaatcacgcggcgagctccggtggacacgttgtcgacggttgcggcgagtttatgtcttccggggaagaaggcacggtggagtctcttctttgtgcagcttgtgatggcctcctgagcttccatagaaaagagatcgatggtttgtttgttgtcaatttcaatagctttggccattcacagagaccactcggaagccgccacgtgtctccgataatgatgagttttggtggtggtggtggttgtgcggcggagtcatcgacggaggatctaaacaagtttcatcaatcttttagtggttatggagtggatcagtttcatcattatcaacccaagaaacggtttaggacaaagtttaatgaagaacagaaggagaagatgatggagtttgctgagaagattggttggagaatgacaaaactagaagatgatgaagtgaatcggttttgtcgtgagattaaagttaaaagacaagtgtttaaagtttggatgcacaacaataaacaagcagcaaagaagaaggatttgtaagagatttctatatatatatatatactatttttacttctctttgttcaacattgctttaac

SEQ ID NO: 4923 - DNA, 679 bp, Artificial Sequence
  P25738 (35S::G1792(E119V))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgtgtttgagtatttggacgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4924 - DNA, 679 bp, Artificial Sequence
  P25739 (35S::G1792(D124G))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttgggcgataaggttcttgaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4925 - DNA, 679 bp, Artificial Sequence
  P25740 (35S::G1792(L128G))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttggggaagaacttcttgattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4926 - DNA, 679 bp, Artificial Sequence
  P25741 (35S::G1792(L132G))
gtcgagaatccatagatctcttattaaataacagtgctgaccaagctcttacaaagcaaaccaatctagaacaccaaagttaatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttggggattcagaagaaaggaagagataatcacgattagttttgttttgatattttatgtggcactgttgtggctacctacgtgcattatgtgcatgtataggtcgcttgattagtactttataacatgcatgccacgaccataaattgtaagagaagacgtactttgcgttttcatgaaatatgaatgttagatggtttgagtac

SEQ ID NO: 4927 - DNA, 585 bp, Artificial Sequence
  P25742 (35S::G1274(K120Q))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggccagaaatctgtcaaaaacaacattaacaagaggaattactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4928 - DNA, 585 bp, Artificial Sequence
  P25743 (35S::G1274(N131S))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggagttactacaaatgctcaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4929 - DNA, 585 bp, Artificial Sequence
  P25744 (35S::G1274(S136T))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgcacaagtgaaggttgctcggtgaagaagagggtagagagagatggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4930 - DNA, 585 bp, Artificial Sequence
  P25745 (35S::G1274(D149S))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagaagtggtgacgatgcagcttatgtaattacaacatatgaaggagtccataaccatgagagtctctctaatgtctattacaatgaaatggttttatcttatgatcatgataactggaaccaacactctcttcttcgatcttaa

SEQ ID NO: 4931 - DNA, 585 bp, Artificial Sequence
  P25746 (35S::G1274(Y155V))
atgaatatctctcaaaaccctagccctaattttacgtacttctccgatgaaaactttattaatccgtttatggataacaacgatttctcaaatttgatgttctttgacatagatgaaggaggtaacaatggattaatcgaggaagagatctcatctccgacaagcatcgtttcgtcggagacatttaccggggaaagcggcggatccggcagcgcaacaacgttgagtaaaaaggaatcaactaatagaggaagtaaagagagtgatcagacgaaggagacgggtcatcgagttgcatttagaacgagatcgaagattgatgtgatggatgatggttttaaatggaggaagtatggcaagaaatctgtcaaaaacaacattaacaagaggaattactacaaatgctcaagtgaaggttgctcggtgaagaagagggtagagagagatggtgacgatgcagctgtagtaattacaacatatgaaggagtccataaccatgagagtctctctaatgtctattacaatgaaatggttttatcttatgatcatgataactggaaccaacactctcttcttcgatcttaa

SEQ ID NO: 4932 - DNA, 507 bp, Artificial Sequence
  P25777 (35S::G3873)
ggcgacccatgtccgatgctccggcgagtccatgcggcggcggcggcggaggcagccacgagagcggcgagcacagtccccgctccaatttccgcgagcaggaccgcttcctccccatcgccaacatcagccgcatcatgaagaaagcgcttcctcccaacgggaaaatcgccaaggacgccaaggaaaccgtgcaggaatgcgtctccgagttcatcagcttcgtcaccagcgaagcgagcgataagtgtcagagagagaagaggaagaccatcaacggcgacgatttgctttgggctatgaccactttaggtttcgaggagtatattgatccgctcaaggtttacctcgccgcttacagagagattgagggtgattcaaagggttcggccaagggtggagatgcatctgctaagagagatgtttatcagagtcctaatggccaggttgctcatcaaggttctttctcacaaggtgttaattatacgaattcttagccccaggctc

SEQ ID NO: 4933 - DNA, 526 bp, Artificial Sequence
  P25778 (35S::G3874)
catggccgacggtccggctagcccaggcggcggcagccacgagagcggcgaccacagccctcgctctaacgtgcgcgagcaggacaggtacctccctatcgctaacataagccgcatcatgaagaaggcacttcctgccaacggtaaaatcgcaaaggacgccaaagagaccgttcaggaatgcgtctccgagttcatcagcttcatcaccagcgaggcctctgataagtgtcagagagaaaagagaaagactattaacggcgatgatttgctctgggcgatggccactctcggtttcgaggattatatggatcctcttaaaatttacctcactagataccgagagatggagggtgatacgaagggctctgccaagggtggagactcatctgctaagagagatgttcagccaagtcctaatgctcagcttgctcatcaaggttctttctcacaaaatgttacttacccgaattctcagggtcgacatatgatggttccaatgcaaggcccggagtagtatcaagtt

SEQ ID NO: 4934 - DNA, 862 bp, Artificial Sequence
  P25889 (35S::G481(S66G))
ccacgcgtccgagcgtttcgtagaaaaattcgatttctctaaagccctaaaactaaaacgactatccccaattccaagttctagggtttccatcttccccaatctagtataaatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactggggaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaaaaaaaaaaaaaaaaaaaaa

SEQ ID NO: 4935 - DNA, 426 bp, Artificial Sequence
  P25891 (35S::G481(AA1-19)::G485(AA20-110)::G481(AA111-141))
atggcggatacgccttcgagcccagctggagatggcggagaaagcggcggttccgttcgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggagttggagggtgataataagggatcaggaaagagtggagatggatcaaatagagatgctggtggcggtgtttctggtgaagaaatgccgagctggtaa

SEQ ID NO: 4936 - DNA, 486 bp, Artificial Sequence
  P25892 (35S::G485(1-19)::G481(20-110)::G485(111-161))
atggcggattcggacaacgattcaggaggacacaaagacggtggaaatgcttcgacaagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttcttaa

SEQ ID NO: 4937 - DNA, 339 bp, Artificial Sequence
  P25893 (35S::G481SV)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggaggtatggtga

SEQ ID NO: 4938 - DNA, 1158 bp, Artificial Sequence
  P25896 (PRRBSC3::GFP::G481)
atggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggaggcggccgcatggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaa

SEQ ID NO: 4939 - DNA, 1362 bp, Artificial Sequence
  P26037 (35S::G1821::(9A)CFP)
atggcagagggcagtatgcgtcctccagaattcaaccagcctaacaaaaccagtaatggtggtgaggaggagtgcacggtgagggagcaagacaggttcatgcctattgccaacgtgatacggatcatgcggaggatcttacctgctcacgccaagatctcagatgactccaaggagacgatccaagagtgtgtttcggagtacatcagcttcataacaggggaggctaatgagcggtgccagcgggaacagcgcaagaccatcactgctgaggacgtcttgtgggcaatgagcaagctcggttttgatgactacatcgaacccctcacgttgtacctccaccgctacagagagttggaaggtgaaagaggggttagctgcagtgctgggtccgttagtatgaccaacggcttggtggtcaagaggcctaatgggaccatgaccgagtatggagcctacgggcctgtgccagggattcacatggcgcagtaccattatcgtcatcagaacgggtttgttttcagtggtaacgaacctaattctaagatgagtggttcatcttcaggagcaagtggcgccagagttgaagtatttccgactcaacaacataagtacgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4940 - DNA, 1236 bp, Artificial Sequence
  P26039 (35S::G2631::(9A)CFP)
atggatccgatggatatagttggaaaatcaaaggaagatgcttcgcttccgaaagctaccatgacgaaaattataaaggagatgttacccgcagatgttcgtgttgctagagatgctcaagatctattgattgagtgttgtgtagagttcataaatcttatatcgtcggagtcgaatgaagtgtgtaacaaagaggataaacgaacaatagcccctgagcacgtactcaaagctttacaggttcttggctttggggaatacgtagaagaagtttatgccgcgtatgagcaacataaatatgaaaccatgcaggattcgcagagaagtgtgaagatgaatagcggagcagagatgacggaagaagaggcggcagcggaacaacagaggatgtttgcagaagctcgagcaagaatgaatggaggtgttacagttcctcaaccagagcaactagaagaaccccaacaacaacaacaaacaagtctacaaagcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4941 - DNA, 1170 bp, Artificial Sequence
  P26040 (35S::G481::(9A)CFP)
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctgggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4942 - DNA, 1317 bp, Artificial Sequence
  P26041 (35S::G482::(9A)CFP)
atgggggattccgacagggattccggtggagggcaaaacgggaacaaccagaacggacagtcctccttgtctccaagagagcaagacaggttcttgccgatcgctaacgtcagccggatcatgaagaaggccttgcccgccaacgccaagatctctaaagatgccaaagagacgatgcaggagtgtgtctccgagttcatcagcttcgtcaccggagaagcatctgataagtgtcagaaggagaagaggaagacgatcaacggagacgatttgctctgggctatgactactctaggttttgaggattatgttgagccattgaaagtttacttgcagaggtttagggagatcgaaggggagaggactggactagggaggccacagactggtggtgaggtcggagagcatcagagagatgctgtcggagatggcggtgggttctacggtggtggtggtgggatgcagtatcaccaacatcatcagtttcttcaccagcagaaccatatgtatggagccacaggtggcggtagcgacagtggaggtggagctgcctccggtaggacaaggactgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4943 - DNA, 1342 bp, Artificial Sequence
  P26043 (35S::G1781::(9A)CFP)
atgactgaggagagcccagaagaagatcatgggtctcctggagtagctgaaacaaatccaggaagcccttcttcaaagaccaacaacaacaacaacaacaacaaagaacaagaccggtttcttcccattgcgaatgtcggaaggatcatgaaaaaagttcttcccggtaacggtaagatctcaaaagacgctaaagaaaccgttcaagaatgtgtctcggagttcattagtttcgtcactggtgaagcttctgacaagtgtcaaagagaaaagaggaagaccatcaatggagatgatatcatttgggctatcacaactctcggtttcgaagactacgtggctccattaaaggtctacctctgcaaatatagagacaccgaaggagagaaagttaacagcccaaaacaacaacaacaaagacaacaacaacagcagattcaacaacagaatcatcataattatcagtttcaagaacaagaccaaaacaataacaacatgtcatgtactagttacatctctcatcatcatccttctccattcctaccagtggatcatcaaccttttcccaatattgctttctctcctaaatcattgcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4944 - DNA, 1230 bp, Artificial Sequence
  P26044 (35S::G485::(9A)CFP)
atggcggattcggacaacgattcaggaggacacaaagacggtggaaatgcttcgacacgtgagcaagataggtttctaccgatcgctaacgttagcaggatcatgaagaaagcacttcctgcgaacgcaaaaatctctaaggatgctaaagaaacggttcaagagtgtgtatcggaattcataagtttcatcaccggtgaggcttctgacaagtgtcagagagagaagaggaagacaatcaacggtgacgatcttctttgggcgatgactacgctagggtttgaggactacgtggagcctctcaaggtttatctgcaaaagtatagggaggtggaaggagagaagactactacggcagggagacaaggcgataaggaaggtggaggaggaggcggtggagctggaagtggaagtggaggagctccgatgtacggtggtggcatggtgactacgatgggacatcaattttcccatcatttttctgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4945 - DNA, 1308 bp, Artificial Sequence
  P26052 (35S::G1836::(9A)YFP)
atggagaacaacaacggcaacaaccagctgccaccgaaaggtaacgagcaactgaagagtttctggtcaaaagagatggaaggtaacttagatttcaaaaatcacgaccttcctataactcgtatcaagaagattatgaagtatgatccggatgtgactatgatagctagtgaggctccaatcctcctctcgaaagcatgtgagatgtttatcatggatctcacgatgcgttcgtggctccatgctcaggaaagcaaacgagtcacgctacagaaatctaatgtcgatgccgcagtggctcaaactgttatctttgatttcttgcttgatgatgacattgaggtaaagagagagtctgttgccgccgctgctgatcctgtggccatgccacctattgacgatggagagctgcctccaggaatggtaattggaactcctgtttgttgtagtcttggaatccaccaaccacaaccacaaatgcaggcatggcctggagcttggacctcggtgtctggtgaggaggaagaagcgcgtgggaaaaaaggaggtgacgacggaaacgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4946 - DNA, 1569 bp, Artificial Sequence
  P26053 (35S::G2632::(9A)YFP)
atgggaattgaagacatgcattcaaaatctgacagtggtgggaacaaggttgattcagaggttcatggtacagtatcgtcgtcgataaatagtttaaacccttggcatcgtgctgctgctgcttgcaatgcaaattctagtgtggaagctggagataaatcttctaagtcaatagcattagcattggaatcaaacggttccaaatcaccatccaatagagataatactgttaacaaggaatcacaagtcacaacgtctccacaatcagctggagattatagtgataaaaaccaagaatctctgcatcatggcatcacacaacctcctcctcaccctcaacttgttggccacacagttggatgggcatcctcaaatccataccaggatccatattatgcaggagtgatgggagcctatggacatcatcccctggggtttgttccatatggtgggatgcctcattcaagaatgccactgccgcctgagatggcacaagaaccagttttcgtgaatgctaaacagtaccaggcgattctgaggcgaaggcaggcacgcgccaaggcagagctagagaagaagctaataaaatccagaaagccttatctacatgaatctcggcatcaacatgctatgaggaggccaaggggtactggaggacggtttgcaaagaaaaccaacaccgaagcttcaaagcgtaaagctgaagaaaagagcaatggtcatgttactcagtccccgtcatcatctaattctgatcaaggtgaagcttggaatggtgactatagaacacctcagggagatgagatgcagagctcagcttatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4947 - DNA, 1449 bp, Artificial Sequence
  P26057 (35S::G715::(9A)YFP)
atggataccaacaaccagcaaccacctccctccgccgccggaatccctcctccaccacctggaaccaccatctccgccgcaggaggaggagcttcttaccaccaccttctccaacaacaacaacaacagctccaactattctggacctaccaacgccaagagatcgaacaagttaacgatttcaaaaaccatcagcttccactagctaggataaaaaagatcatgaaagccgatgaagatgttcgtatgatctccgcagaagcaccgattctcttcgcgaaagcttgtgagcttttcattctcgagctcacgatcagatcttggcttcacgctgaggagaataaacgtcgtacgcttcagaaaaacgatatcgctgctgcgattactaggactgatatcttcgatttccttgttgatattgttcctagagatgagattaaggacgaagccgcagtcctcggtggtggaatggtggtggctcctaccgcgagcggcgtgccttactattatccgccgatgggacaaccagctggtcctggagggatgatgattgggagaccagctatggatccgaatggtgtttatgtccagcctccgtctcaggcgtggcagagtgtttggcagacttcgacggggacgggagatgatgtctcttatggtagtggtggaagttccggtcaagggaatctcgacggccaaggtgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4948 - DNA, 1332 bp, Artificial Sequence
  P26059 (35S::G490::(9A)YFP)
atgaggaggccaaagtcatctcacgtcaggatggaacctgttgcgcctcgttcacataacacgatgccaatgcttgatcaatttcgatctaatcatcctgaaacaagcaagatcgagggggtctcttcgttggacacagctctgaaggtgttttggaataatcaaagggagcagctaggaaactttgcaggccaaactcatttgccgctatctagggtcagaaagattttgaaatctgatcctgaagtcaagaagataagctgtgatgttcctgctttgttttcgaaagcctgtgaatacttcattctagaggtaacattacgagcttggatgcatactcaatcatgcactcgtgagaccatccggcgttgtgatatcttccaggccgtaaagaactcaggaacttatgatttcctgattgatcgtgtcccttttggaccgcactgtgtcacccatcagggtgtgcaacctcctgctgaaatgattttgccggatatgaatgttccaatcgatatggaccagattgaggaggagaatatgatggaagagcgctctgtcgggtttgacctcaactgtgatctccaggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4949 - DNA, 1407 bp, Artificial Sequence
  P26060 (35S::G489::(9A)YFP)
atgaactatggcacaaacccataccaaaccaacccgatgagcaccactgctgctactgtagcaggaggtgcggcacaaccaggccagctggcgttccaccagatccatcagcagcagcagcagcaacagctggcacagcagcttcaagcattttgggagaaccaattcaaagagattgagaagactaccgatttcaagaaccacagccttccccttgcgagaatcaagaaaatcatgaaagcggatgaagatgtccgtatgatctcggctgaggcgcctgtcgtgtttgcaagggcctgtgagatgttcatcctggagctgacactcaggtcgtggaaccacactgaggagaataagaggcggacgttgcagaagaacgatattgctgctgctgtgactagaaccgatatttttgatttccttgtggatattgttccccgggaggatctccgagatgaagtcttgggaagtattccgaggggcactgtcccggaagctgctgctgctggttacccgtatggatacttgcctgcaggaactgctccaataggaaatccgggaatggttatgggtaatcccggtggtgcgtatccacctaatccttatatgggtcaaccaatgtggcaacaacaggcacctgaccaacctgaccaggaaaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4950 - DNA, 1398 bp, Artificial Sequence
  P26061 (35S::G714::(9A)YFP)
atggatcaacaaggacaatcatcagctatgaactatggttcaaacccatatcaaaccaacgccatgaccactacaccaaccggttcagaccatccagcttaccatcagatccaccagcaacaacaacaacagctcactcaacagcttcaatctttctgggagactcaattcaaagagattgagaaaaccactgatttcaagaaccatagccttccattggcaagaatcaagaaaatcatgaaagctgatgaagatgtgcgtatgatctcggccgaggcgcctgttgtgttcgccagggcctgcgagatgtttattctggagcttacgttaaggtcttggaaccatactgaggagaacaagagaaggacgttgcagaagaatgatatcgcggctgcggtgactagaactgatatttttgattttcttgtggatattgttcctcgggaggatcttcgtgatgaagtcttgggtggtgttggtgctgaagctgctacagctgcgggttatccgtatggatacttgcctcctggaacagctccaattgggaacccgggaatggttatgggtaacccgggcgcgtatccgccgaacccgtatatgggtcagccaatgtggcaacaaccaggacctgagcagcaggatcctgacaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4951 - DNA, 1353 bp, Artificial Sequence
  P26064 (35S::G1820::(9A)YFP)
atggctgagaacaacaacaacaacggcgacaacatgaacaacgacaaccaccagcaaccaccgtcgtactcgcagctgccgccgatggcatcatccaaccctcagttacgtaattactggattgagcagatggaaaccgtctcggatttcaaaaaccgtcagcttccattggctcgaattaagaagatcatgaaggctgatccagatgtgcacatggtctccgcagaggctccgatcatcttcgcaaaggcttgcgaaatgttcatcgttgatctcacgatgcggtcgtggctcaaagccgaggagaacaaacgccacacgcttcagaaatcggatatctccaacgcagtggctagctctttcacctacgatttccttcttgatgttgtccctaaggacgagtctatcgccaccgctgatcctggctttgtggctatgccacatcctgacggtggaggagtaccgcaatattattatccaccgggagtggtgatgggaactcctatggttggtagtggaatgtacgcgccatcgcaggcgtggccagcagcggctggtgacggggaggatgatgctgaggataatggaggaaacggcggcggaaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4952 - DNA, 1383 bp, Artificial Sequence
  P26065 (35S::G1819::(9A)YFP)
atggaagagaacaacggcaacaacaaccactacctgccgcaaccatcgtcttcccaactgccgccgccaccattgtattatcaatcaatgccgttgccgtcatattcactgccgctgccgtactcaccgcagatgcggaattattggattgcgcagatgggaaacgcaactgatgttaagcatcatgcgtttccactaaccaggataaagaaaatcatgaagtccaacccggaagtgaacatggtcactgcagaggctccggtccttatatcgaaggcctgtgagatgctcattcttgatctcacaatgcgatcgtggcttcataccgtggagggcggtcgccaaactctcaagagatccgatacgctcacgagatccgatatctccgccgcaacgactcgtagtttcaaatttaccttccttggcgacgttgtcccaagagacccttccgtcgttaccgatgatcccgtgctacatccggacggtgaagtacttcctccgggaacggtgataggatatccggtgtttgattgtaatggtgtgtacgcgtcaccgccacagatgcaggagtggccggcggtgcctggtgacggagaggaggcagctggggaaattggaggaagcagcggcggtaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4953 - DNA, 1266 bp, Artificial Sequence
  P26108 (35S::G1364::(9A)CFP)
atggcggagtcgcaggccaagagtcccggaggctgtggaagccatgagagtggtggagatcaaagtcccaggtcgttacatgttcgtgagcaagataggtttcttccgattgctaacataagccgtatcatgaaaagaggtcttcctgctaatgggaaaatcgctaaagatgctaaggagattgtgcaggaatgtgtctctgaattcatcagtttcgtcaccagcgaagcgagtgataaatgtcaaagagagaaaaggaagactattaatggagatgatttgctttgggcaatggctactttaggatttgaagactacatggaacctctcaaggtttacctgatgagatatagagagatggagggtgacacaaagggatcagcaaaaggtggggatccaaatgcaaagaaagatgggcaatcaagccaaaatggccagttctcgcagcttgctcaccaaggtccttatgggaactctcaagctcagcagcatatgatggttccaatgccgggaacagacgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4954 - DNA, 1671 bp, Artificial Sequence
  P26121 (35S::G1363::(9A)YFP)
atgcaagagttccatagtagcaaagattcattgccttgtcctgcaacttcttgggataactctgtcttcaccaactcaaatgtccaaggatcatcatccttgaccgataacaacactttaagcttgacaatggagatgaaacaaactggttttcaaatgcagcactatgattcctcctctactcaatccactggaggagaatcatatagtgaagttgctagcttaagtgaacctactaatcgttatggccacaacattgttgtcactcatctctcaggttacaaagaaaacccggaaaatcctattggaagtcattcgatatcaaaggtgtctcaagattcagtggttcttcctattgaggcggcttcttggcctttacacggcaatgtaacgccacatttcaatggtttcttgtcttttccttatgcatcacaacacacggtgcagcatcctcaaatcagagggttggttccgtctagaatgcctttgcctcacaacattccagagaacgaaccaattttcgtcaatgcaaaacagtaccaagccattctccgccgcagagagcgccgtgcaaagcttgaagctcagaacaagctcatcaaagtccgcaaaccatatcttcacgagtcgcggcacctccatgcactaaagagagttagaggctctggtggacgtttcctcaacacaaagaagcatcaagaatcaaattcctcactatctcctccattcttgattccacctcatgtcttcaagaactctccaggaaagttccggcaaatggacatttcaaggggtggggttgtgtctagtgtctcgacaacatcttgctcggacataaccgggaacaacaacgacatgttccagcaaaacccacaattcaggttctcaggttatccatcaaaccaccatgtctcagtcctcatggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4955 - DNA, 1497 bp, Artificial Sequence
  P26130 (35S::G1646::(9A)YFP)
atggacaataacaacaacaacaacaaccagcaaccaccaccaacctccgtctatccacctggctccgccgtcacaaccgtaatccctcctccaccatctggatctgcatcaatagtcaccggaggaggagcgacataccaccacctcctccagcaacaacagcaacagcttcaaatgttctggacataccagagacaagagatcgaacaggtaaacgatttcaaaaaccatcagctccctctagctcgtatcaaaaaaatcatgaaagctgatgaagatgtgcgtatgatctccgccgaagcaccgattctcttcgcgaaagcttgtgagcttttcattctcgaacttacgattagatcttggcttcacgctgaagagaacaaacgtcgtacgcttcagaaaaacgatatcgctgctgcgattactagaaccgatatcttcgatttccttgttgatattgttcctagggaagagatcaaggaagaggaagatgcagcatcggctcttggtggaggaggtatggttgctcccgccgcgagcggtgttccttattattatccaccgatgggacaaccggcggttcctggagggatgatgattggaagaccggcgatggatcctagcggtgtttatgctcagcctccttctcaggcatggcaaagcgtttggcagaattcagctggtggtggtgatgatgtgtcttatggaagtggaggaagtagcggccatggtaatctcgatagccaaggggcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4956 - DNA, 1305 bp, Artificial Sequence
  P26159 (35S::G1818::(9A)YFP)
atggagaacaacaacaacaaccaccaacagccaccgaaagataacgagcaactaaagagtttctggtcaaaggggatggaaggtgacttgaatgtcaagaatcacgagttccccatctctcgtatcaagaggataatgaagtttgatccggatgtgagtatgatcgctgctgaggctccaaatctcttatctaaggcttgtgaaatgtttgtcatggacctcacgatgcgttcatggctccatgctcaagagagcaaccgactcacgatacggaaatctgatgttgatgccgtagtgtctcaaaccgtcatctttgatttcttgcgtgatgatgtccctaaggacgagggagagcccgttgtcgccgctgctgatcctgtggacgatgttgctgatcatgtggctgtgccagatcttaacaatgaagaactgccgccgggaacggtgataggaactccggtttgttacggtttaggaatacacgcgccacacccgcagatgcctggagcttggaccgaggaggatgcgactggggcaaatggaggaaacggtgggaatgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4957 - DNA, 1632 bp, Artificial Sequence
  P26197 (35S::G927::(9A)YFP)
atggctatgcaaactgtgagagaaggtctcttctctgctccacagacttcttggtggactgcttttggatctcagccgttggctccggagagtctcgccggcgattctgactcattcgccggagttaaggtcggatctgtcggagagacaagacaacgtgtggataaacagagcaactctgcaacgcacttagctttctcacttggtgatgtaaagagtccaagacttgtgccaaagcctcatggagctactttctcaatgcaatcaccttgcttggaacttggattttctcagccaccgatctatacaaagtatccctatggagaacaacaatactatggagttgtttcagcctatggatctcagagcagggtaatgcttcctctaaacatggaaacggaagatagtaccatctatgtgaactcaaagcaataccatggaatcataaggagacgccaatcccgcgcaaaggctgctgctgttcttgatcagaagaaattgagtagtagatgccgcaagccatatatgcatcattcgcgccatctccatgcattgcggcgtcctagaggatccggtgggagattcttgaacactaaaagtcagaacttggaaaatagcggaaccaatgcaaagaaaggtgatggaagtatgcagattcagtctcagcctaagcctcagcaaagtaactctcagaattctgaagttgttcatccggaaaacgggaccatgaacttatcgaacggattaaatgtgtcgggatcagaagttactagcatgaactacttcctaagttctcccgttcattctcttggtggcatggtaatgcctagcaagtggatagcagcagcagcagcaatggataatggctgctgcaatttcaaaaccgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4958 - DNA, 816 bp, Artificial Sequence
  P26217 (35S::G926::(9A)YFP)
atgcaatcaaaaccgggaagagaaaacgaagaggaagtcaataatcaccatgctgttcagcagccgatgatgtatgcagagccctggtggaaaaacaactcctttggtgttgtacctcaagcgagaccttctggaattccatcaaattcctcttctttggattgccccaatggttccgagtcaaacgatgttcattcagcatctgaagacggtgcgttgaatggtgaaaacgatggcacttggaaggattcacaagctgcaacttcctctcgttcagtagataatcacggaatggaaggaaatgacccagcgctctctatccgtaacatgcatgatcagccacttgtacaaccaccagagcttgttggacactatatcgcttgtgtcccaaacccatatcaggatccatattatgggggattgatgggagcatatggtcatcagcaattgggttttcgtccatatcttggaatgcctcgtgaaagaacagctctgccacttgacatggcacaagagcccgtttatgtgaatgcaaagcagtacgagggaattctaaggcgaagaaaagcacgtgccaaggcagagctagagaggaaagtcatccgggacagaaagccatatcttcacgagtcaagacacaagcatgcaatgagaagggcacgagcgagtggaggccggtttgcgaagaaaagtgaggtagaagcgggagaggatgcaggagggagagacagagaaaggggttcagcaaccaactcatcaggctctgaacaagttgagacagactctaatgagaccctgaattcttctggtgcacca

SEQ ID NO: 4959 - DNA, 1341 bp, Artificial Sequence
  P26219 (35S::G929::(9A)YFP)
atgacttcttcagtacatgagctctctgataacaatgaaagtcatgcgaagaaagaacgtccagattcccaaacccgaccacaggttccttcaggacgaagttcggaatctattgatacaaactctgtctactcagagcccatggcacatggattatacccgtatccagatccttactacagaagcgtctttgcacagcaagcgtatcttccacatccctatcctggggtccaattgcagttaatgggaatgcagcagccaggagttccattgcaatgtgatgcagtcgaggaacctgtttttgttaacgcaaagcaataccatggtatactcaggcgcaggcaatcccgggcaaaacttgaggcacgaaatagagccatcaaagcaaaaaagccatacatgcatgaatctcggcatttacatgcgataagacggccaagaggatgtggtggccggtttctcaatgccaagaaggaaaatggagaccacaaggaggaggaggaggcaacctctgatgagaacacttcagaagcaagttccagcctcaggtccgagaaattagctatggctacttctggtcctaatggtagatctgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4960 - DNA, 1767 bp, Artificial Sequence
  P26223 (35S::G928::(9A)YFP)
atgatgcatcagatgttgaataagaaagattcagctactcattccactttgccataccttaatactagcatctcttggggagtggttccaactgattccgttgctaatcgtcgcggttctgctgaatcactaagcttgaaggttgattcaagacctgggcatatacaaactacaaagcaaatcagttttcaggaccaagattcatcttcaacacagtccactggtcaatcttatactgaagttgctagtagtggtgatgataatccttccagacaaatctccttttcggctaaatcaggatctgaaataactcaacggaaggggtttgcaagtaatcctaaacaaggctcgatgactggatttccgaatattcactttgctcctgcacaggctaatttctcatttcactatgctgatccacattatggtggtttattagctgcaacttacctaccacaggcaccaacatgcaatcctcaaatggtgagtatgattcctggtcgtgttcctttaccagcagagctcacagaaactgatccagtctttgtcaatgcgaagcaataccacgcaattatgaggaggagacagcaacgtgctaagcttgaggctcaaaacaaactaatcagagcccgtaagccctatcttcatgagtctcgacatgttcatgctcttaaaaggccaagaggatctggtggaagattcctaaacaccaaaaaacttcttcaagaatccgaacaggctgctgctagagaacaagaacaggacaagttaggccaacaggtaaacagaaagaccaacatgtctagattcgaagctcatatgctgcagaacaacaaagaccgcagctcaaccacttctggctcagacatcacctctgtttccgacggtgctgatatctttggacacactgaattccagttttcaggtttcccaactccgataaaccgagccatgcttgttcatggtcagtctaatgacatgcatggaggtggagacatgcaccatttctctgtccatatcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4961 - DNA, 1731 bp, Artificial Sequence
  P26230 (35S::G931::(9A)YFP)
atggataagaaagtttcatttactagctctgtggcacattcaactccaccataccttagtacttccatctcatggggacttccaaccaaatccaatggtgtgactgaatcactgagtttgaaggtggtagatgcaagaccagaacgtcttataaacacaaagaatatcagtttccaggaccaggattcatcttcaactctgtcctctgctcaatcttctaacgatgttacaagtagtggagatgataacccctcaagacaaatctcatttttagcacattcagatgtttgtaaaggatttgaagaaactcaaaggaagcgatttgcaattaaatcaggctcctccacggcaggaatcgctgatattcactcttctccttccaaggctaacttctcatttcactatgccgatccacattttggtggtttaatgcctgcggcttacctaccacaggcaacaatatggaatccccaaatgactcgagttccgctaccattcgatctcatagagaatgagcctgtctttgtcaatgcaaagcaattccatgcaattatgaggaggaggcaacagcgtgctaagctagaggcgcaaaacaaactaatcaaagcccgtaagccgtatcttcatgaatctcgacatgttcacgctcttaaacgacctagaggatctggtggaagattcctaaacaccaaaaagcttcaagaatctacagatccaaaacaagacatgccaatccaacagcaacacgcaacgggaaacatgtcaagatttgtgctttatcagttgcagaacagcaatgactgtgattgttcaaccacttctcgctctgacatcacatctgcttctgacagcgttaatctctttggacactctgaatttctgatatcagattgcccatctcagacaaacccaacaatgtatgttcatggtcaatcaaatgacatgcatggaggtaggaacacacaccatttctctgtccatatcgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4962 - DNA, 1554 bp, Artificial Sequence
  P26238 (35S::G1334::(9A)YFP)
atgcaaactgaggagcttttgtcgccaccacagactccttggtggaatgcttttggatctcagccgttgactacagagagcctttccggcgaagcttctgattcattcaccggagttaaggcagttactacggaggcagaacaaggtgtggtggataaacaaacttctacaactctcttcactttctcacctggtggtgaaaagagttcaagagatgtgccaaagcctcatgttgctttcgcgatgcaatcagcttgcttcgagtttggatttgctcagccaatgatgtacacaaagcatcctcatgttgaacaatactatggagttgtttcagcatacggatctcagaggtcttcgggccgagtaatgattccactgaagatggagacagaagaagatggtaccatctatgtgaactcaaagcagtaccatggaattatcaggcgacgccagtcccgagcaaaggctgaaaaactgagtagatgccgtaagccatatatgcatcactcacgccatctccatgctatgcgccgtcctagaggatctggcgggcgtttcttgaacaccaagacagctgatgcggctaagcagtctaagccgagtaattctcagagttctgaagtctttcatccggaaaatgagaccataaactcatcgagggaagcaaatgagtcaaatctctcggattctgcagttacaagtatggattactttctaagttcgtcggcttattctcctggtggcatggtcatgcctatcaagtggaatgcagcagcaatggatattggctgctgcaaacttaatatagcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccttcggctacggcctgcagtgcttcgcccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggataaccgaatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtggtgctgcccgacaaccactacctgagctaccagtccgccctgagcaaagaccccaacgagaagcgcgatcacatggtcctgctggagttcgtgaccgccgccgggatcactctcggcatggacgagctgtacaagtaa

SEQ ID NO: 4963 - DNA, 882 bp, Artificial Sequence
  P26259 (OPLEXA::12XHA(10A)::G1792)
atgagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccggatcctctacctagagaattccgccgctgccgctgcggcagcggctgcagcgggtaccatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 4964 - DNA, 1217 bp, Artificial Sequence
  P26263 (OPLEXA::12XHA::G481)
atgagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagttacccatacgatgttcctgactatgcgggctatccctatgacgtcccggactatgcaggatcctatccatatgacgttccagattacgcttctagatacccatacgatgttcctgactatgcgggctatccctatgacgtcccggactatgcaggatcctatccatatgacgttccagattacgctactagacaggcctcgtaccggatcctctacctagagaattccgccgctgccgctgcggcagcggctgcagcgggtaccgtcgacgcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaaaagaagttgcaagtagtgattaagaacaatcgccaaatgatcaagggaaattagagatcagtgagttgtttatagttgagctgatcgacaactatttcgggtttactctcaatttcggttatgttagtttgaacgtttggtttattgtttccggtttagttggttgtatttaaagatttctctgttagatgttgagaacacttgaatgaaggaaaaatttgtccacatcctgttgttattttcgattcactttcggaatttcatagctaatttattctcatttaatacaaaatccttaaattaaaaaaaaaaaaaaaaaaaaaaaa

SEQ ID NO: 4965 - DNA, 1164 bp, Artificial Sequence
  P26277 (35S::G486::(9A)CFP)
atgacagacgaagatagattgttgccaatagccaatgtagggagacttatgaagcaaatcctaccatcaaatgcaaagatctcaaaagaagcaaaacaaacagttcaagaatgtgcaacagagttcataagctttgttacatgcgaagcatcagagaagtgccacagggagaatcggaagacggtgaatggagacgacatctggtgggctctcagcactctcggcctcgataactatgctgacgccgtgggtaggcatcttcacaagtaccgcgaagccgagagagaaagaactgagcacaacaaaggtagcaatgatagtgggaatgagaaagaaaccaacactagaagtgatgtacagaaccaatcgacaaaatttattagagttgttgagaagggaagcagctcctcggcccgtgcggccgctgccgctgcggcagcggccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctggggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacatcagccacaacgtctatatcaccgccgacaagcagaagaacggcatcaaggccaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 4966 - DNA, 1281 bp, Artificial Sequence; identical to SEQ ID NO: 15
  P26372 (35S::G867(SULF))

SEQ ID NO: 4967 - DNA, 972 bp, Artificial Sequence
  P26378 (35S::G28(SULF))
ccacgcgtccggaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataattttgatttttctttgttggatgattatatgattcttcaaaaaagaagaacgttaataaaaaaattcgtttattattaaaaaaaaaaaaaaa

SEQ ID NO: 4968 - DNA, 1751 bp, Artificial Sequence
  P26383 (35S::G1919(SULF))
tctctagctctttactaatttatcgatttgtctttctgatttttgttttgtcattttcaagaaaacaatggagtacgatggacggagaccctactctgttctaacgagaaatgaaattaccgtaaagatgaagaaacagatcaatgaaatctctgacatcttcttcatatcaaactccgatgcgaccgtacttcttatgtatctccgatgggactcgcttcgtgtttcagagcgtttaggtgaaaacaaggagaaattattgatggattcaggtttgaaatcagtcatgatcgatcccagtccagattcatctagcgagattagcttggagactgatgtttatgagtttgatggtgataatgatttaatctccatgcccttttgttctcacaagttcgactcaaaatattggagagagtatcttgagaagaatttctactatgtggagaaaatccaaaccacaatctcttgtcctgatcaagattgtcgatctgcggttggaccagacacgattgagaaactaacagtacgtgatcaagagatgtacgagaggtacatttggagatcttacattgaaggaaacaaggtattgatgatcaaacagtgtcctgcacggaattgcgattatgttattgagtttcatcaagagaatgatgatgatgatgagtatagtttaaacgtggtgtgtatctgtggtcatatcttctgttggagatgcagacttgagtcacacagaccagtgagttgtaacaaggcctctgattggttgtgtagtgccacaatgaaaatatcagatgaatcatttagcctttatccgaccaaaaccaagacagtgacttgccctcattgcctctgttctctggagtctgatacaaaaatgccccagttcttgacttgtgtctgcaggtttcaccctaattttgacaattacatagaattggatttctctgtttaagtcttgatccttactcttttgtgttatcttgctttaggcttcgtttctgttcgaggtgtttgcggtcagaggaagcccacaaaattgaagcagtagactctggattctgtattaaaacagaagtggggattttatgtgaggatcgctggaacgtgtgtcagaagttactggagcaagccaaatccgatctagaagctttcgaggaaaccaacatcaagaaaccgagtgacttattaagggagcaagacattatgattataagagaagggttgatgttgattgttcaatgcagacgagtccttaaatggtgttgtgtgtatgactatttccacacagagtatgagaactcgaaggagtatctacgatacctccaaggaaatgcaatcgccacgctccagagttactcaaacactttacaagagcaaaaagatatcgtcctcgctgcagctacttatgaagagtgtactttcttcagacatacgatacctactgcgacaagcaacattggtaactacttttatgattttatgaaaactttacaagatggtttggtcgatgtaaaggtgaagtcatacaacggcgggactggtcctttctggtactgtgatcgctgcacgtatgcaaacacttgggaggataatgagtgtgagatgtgctatgatgatagtgcctctcttgtgggagagataagtgatttgtttcttaacaaagtttcttaaaaacacgagggaggcatgaaactttcaacttgtatattttacaattgttttgctctgcaatataataatcgagacgc

SEQ ID NO: 4969 - DNA, 930 bp, Artificial Sequence
  P26385 (35S::G1266(SULF))
ccacgcgtccggaaacagagtattttttctacatggatccatttttaattcagtccccattctccggcttctcaccggaatattctatcggatcttctccagattctttctcatcctcttcttctaacaattactctcttcccttcaacgagaacgactcagaggaaatgtttctctacggtctaatcgagcagtccacgcaacaaacctatattgactcggatagtcaagaccttccgatcaaatccgtaagctcaagaaagtcagagaagtcttacagaggcgtaagacgacggccatgggggaaattcgcggcggagataagagattcgactagaaacggtattagggtttggctcgggacgttcgaaagcgcggaagaggcggctttagcctacgatcaagctgctttctcgatgagagggtcctcggcgattctcaatttttcggcggagagagttcaagagtcgctttcggagattaaatatacctacgaggatggttgttctccggttgtggcgttgaagaggaaacactcgatgagacggagaatgaccaataagaagacgaaagatagtgactttgatcaccgctccgtgaagttagataatgtagttgtctttgaggatttgggagaacagttccttgaggagcttttggggtcttctgaaaatagtgggacttggtgaaagattaggatttgtattagggaccttaagtttgaagtggttgattaattttaaccctaatatgttttttgtttgcttaaatatttgattctattgagaaacatcgaaaacagtttgtatgtatttttgtgatacttgactttatcaatttcaagttagtgtaaaagtctttgtctcttactattcaactagtaagaaaactctcatttttcttatttatcgtaaaaaaaaaaaaaaaaaa

SEQ ID NO: 4970 - DNA, 507 bp, Artificial Sequence
  P26388 (35S::G47(SULF))
cttcttcttcacatcgatcatcatacaacaacaaaaaatggattacagagaatccaccggtgaaagtcagtcaaagtacaaaggaatccgtcgtcggaaatggggcaaatgggtatcagagattagagttccgggaactcgtgaccgtctctggttaggttcattctcaacagcagaaggtgccgccgtagcacacgacgttgctttcttctgtttacaccaacctgattctttagaatctctcaatttccctcatttgcttaatccttcactcgtttccagaacttctccgagatctatccagcaagctgcttctaacgccggcatggccattgacgccggaatcgtccacagtaccagcgtgaactctggatgcggagatacgacgacgtattacgagaatggagctgatcaagtggagccgttgaatatttcagtgtatgattatctgggcggccacgatcacgtttgatttatctcgacggtcatgatcacgtttgatcttgc

SEQ ID NO: 4971 - DNA, 140 bp, Artificial Sequence
  P26396 (PR2XW1BOX::M35S::G1795(-UTR))
cacacttaatttgaccgagtaacattcgcctctagtcacacttaatttgaccgagtaacattcgcctctagagcggcccgcaagacccttcctctatataaggaagttcatttcatttggagaggacacgctgcggccgc

SEQ ID NO: 4972 - DNA, 130 bp, Artificial Sequence
  P26398 (PR2XNBOX::M35S::G1795(-UTR))
ttctagccaccagatttgaccaaactctagtttctagccaccagatttgaccaaactctagagcggcccgcaagacccttcctctatataaggaagttcatttcatttggagaggacacgctgcggccgc

SEQ ID NO: 4973 - DNA, 128 bp, Artificial Sequence
  P26402 (PR2XJEREBOX::M35S::G1795(-UTR))
agaccgccaaagaggacccagaattctagtagaccgccaaagaggacccagaattctagagcggcccgcaagacccttcctctatataaggaagttcatttcatttggagaggacacgctgcggccgc

SEQ ID NO: 4974 - DNA, 127 bp, Artificial Sequence
  P26404 (PR2XSBOX::M35S::G1795(-UTR))
cagccaccaaagaggacccagaattctagtcagccaccaaagaggacccagaattctagagcggcccgcaagacccttcctctatataaggaagttcatttcatttggagaggacacgctgcggccc

SEQ ID NO: 4975 - DNA, 208 bp, Artificial Sequence
  P26406 (PR4XW2BOX::M35S::G1795(-UTR))
ttattcagccatcaaagttgaccaataattctagtttattcagccatcaaagttgaccaataattctagtttattcagccatcaaagttgaccaataattctagtttattcagccatcaaagttgaccaataattctagagcggcccgcaagacccttcctctatataaggaagttcatttcatttggagaggacacgctgcggccgc

SEQ ID NO: 4976 - DNA, 192 bp, Artificial Sequence
  P26407 (PR4XNBOX::M35S::G1795(-UTR))
ttctagccaccagatttgaccaaactctagtttctagccaccagatttgaccaaactctagtttctagccaccagatttgaccaaactctagtttctagccaccagatttgaccaaactctagagcggcccgcaagacccttcctctatataaggaagttcatttcatttggagaggacacgctgcggccgc

SEQ ID NO: 4977 - DNA, 188 bp, Artificial Sequence
  P26408 (PR4XWAMYBOX::M35S::G1795(-UTR))
ggattgacttgaccgtcatcggcttctagtggattgacttgaccgtcatcggcttctagtggattgacttgaccgtcatcggcttctagtggattgacttgaccgtcatcggcttctagagcggcccgcaagacccttcctctatataaggaagttcatttcatttggagaggacacgctgcggccgc

SEQ ID NO: 4978 - DNA, 216 bp, Artificial Sequence
  P26409 (PR4XDBOX::M35S::G1795(-UTR))
tacaattcaaacattgttcaaacaaggaacctctagttacaattcaaacattgttcaaacaaggaacctctagttacaattcaaacattgttcaaacaaggaacctctagttacaattcaaacattgttcaaacaaggaacctctagagcggcccgcaagacccttcctctatataaggaagttcatttcatttggagaggacacgctgcggccgc

SEQ ID NO: 4979 - DNA, 212 bp, Artificial Sequence
  P26410 (PR4XUBOX::M35S::G1795(-UTR))
agttgaaattcaataagttgaaattcaatatctagtagttgaaattcaataagttgaaattcaatatctagtagttgaaattcaataagttgaaattcaatatctagtagttgaaattcaataagttgaaattcaatatctagagcggcccgcaagacccttcctctatataaggaagttcatttcatttggagaggacacgctgcggccgc

SEQ ID NO: 4980 - DNA, 188 bp, Artificial Sequence
  P26411 (PR4XJEREBOX::M35S::G1795(-UTR))
agaccgccaaagaggacccagaattctagtagaccgccaaagaggacccagaattctagtagaccgccaaagaggacccagaattctagtagaccgccaaagaggacccacaattctagagcggcccgcaagacccttcctctatataaggaagttcatttcatttggagaggacacgctgcggccgc

SEQ ID NO: 4981 - DNA, 187 bp, Artificial Sequence
  P26412 (PR4XSBOX::M35S::G1795(-UTR))
cagccaccaaagaggacccagaattctagtcagccaccaaagaggacccagaattctagtcagccaccaaagaggacccagaattctagtcagccaccaaagaggacccagaattctagagcggcccgcaagacccttcctctatataaggaagttcatttcatttggagaggacacgctgcggccc

SEQ ID NO: 4982 - DNA, 652 bp, Artificial Sequence
  P26442 (PRAT2G43620::G1795(-UTR))
accagggttggtaagactaaaccgctttttattgatatgctggtttaattttgacgcatgactatttggaaattgcaataattgagttggatttttctaattttggttgattttgatttataaatagaaacattttggcttcactagtcatttttctcacaattccatacaatttttgttaaaaatcaaagtaagactttaaaagaacgttctaaatgctatattagttgaccaaaaaaaatgctatattagctaacaatatcgtttgagctaattaacaaaaacttggaactattcaatagaaaaatctcaaacgtttgaactaatctaaacttgattatctcaatcaagtttttatgagaatgattttcatccaagtaacttggctctttaaaattttgattacatattcgtttttgatctgatctatgaccgacatggaatttctcataacgacaagagaaaaaactgtgtcattgacttttgttaagtggtacaaagtggcattgactttgactcagaaaaagccaatcaataatcgtgaaagatgtctaacactgatcaatatttcaatttgaatagaccaaatttacactataaatacatcaacacaccttcttcatttcttcacacaacaccctccatacacaaa

SEQ ID NO: 4983 - DNA, 1200 bp, Artificial Sequence
  P26443 (PRAT3G02840::G1795(-UTR))
ctacgatgattgaaccaactggcttatgttttacctatctgcgttaaatttcgtggtaaactgaaccgggatgtaatgaatccggttttggtttgattttttttaaatgaaaataactttctgtggatcttttaatcgaaaataatattgaacgttacataattgggtgaaaattcgtatttatcagatatttggttttgatcgaatcttcgtgtggtttatcttagatactcgaacttttaaagcagtgtatgaatctacgcgtaaaatatttaatgtattgaagtaatattggaaaaacaatgacgcggggaaaagtaaacaaacacggacccgacgacggataagcgaccaagcccgagtcgcatcgtcttggtcttaagtctttccctactcgttttatcattttcttaaactaaaaactaatttaatcactcttaattatttacttttttcttttaattcaactatgactaattcttattcacagaatgagtctcacatgcctactcgtcgtactcgactccagtccaaatgttcccatacttgtaatctatactacatatattatacgtcatcgtcatgtatatacaagactcaatatataacgtccaaattaatcaaagatttaacatgatcgggaaccaatatctaatcatcgattagatatatttaagtctagtaactaattagtatattttctacaaattgtttaattaaacatatagtatacagttggtaaaggggaaacacgcgtaatctatatgtatatattaataatatatagttcttggtatgatcttcttagttatttatttactaagctttctagactttaacaatatttgaatgaaaaaaaaatttaattaaccgtcgaaaaaaaagtcataaatctggacgcagaatactaatccacagatttcaacggtcaacattccaattcagttcacaaacctaaatcaaacgttccatttcataccttttttctctttcaagcttatacaacctttgaccatgtctcactttattaataagtacaaaaccaccttacattacatgcatatatataaataaaacacgttaaggaacatatatttatacaaatcccataaaccccatttcattcttcatcgaatagtcgaaaaatatttgaactttcttaggaaaccaaaccaacaaaacaaaaaggaaaacgagata

SEQ ID NO: 4984 - DNA, 1174 bp, Artificial Sequence
  P26445 (PRAT3G18250::G1795(-UTR))
atctgaaacatactatacccaaaaatcgatgctcacacctagctagttcaaactgcgtacgtcaaaatatgtggtatggacgtaaagtattttataagttttgttagaaagttagatacttataaaataaaaaaattgatatttttttggtaaaaaatggaagtttggtattttttggcagttgtatacataaataaaaatatatattacggagttatatattcttgtttggtcaaatgtttcggaagcttttagattacgaaattacataatccatgatgaattaaatttggttagtggtagaagaataagacgccaaaagaaaaaagggaagaacattgggttacgtcgaaagtcctttgataagaatttgattttgcatagtcaaatttggaccaacaacaaaaatggagtccacgtgaaatagaagagagagacttaatagcttctcatgcataaagttatgaacaatcaatgataaccaatgataaataactaaacagtacaaaatctctgtatttttattggatttaacaaaggccatgaacaatcacttcaatatttataatttttttaaaaagacgaggcaattcaagctgatttatacattatgattaatgataattatattatggcatttgacttttctcacgctaatgtaaatggtcaaaaatccttatcttcaactaaacttcctcgacaaaaccttaactagaactatgtatgtaatttatcaaatattgaactttaaatttctttaaaagcataatataatcttgacctataaaattagcctagcctttcgaattacaagttttatatttttaaagaaacataatcttcaactagaaattattataaaccgggtcctatcttcatctaatatacgtgattccatcaaaattccgcagtcaaatgtgtttagttgagaggaggagaatagtagactaaaatggatgactttctggtaagtcttgtattgcagtcttttctatattttaacaaataagtcttcttttcttaaaaagaaaaatttaattacaaagaaatcttactactgaacgaataatttatcaaaagtcagtggccttacgtacgaatttatcggctataagtaggaaagcttttcacgttaaacaacttaatctcatccacattaactagagaaagagag

SEQ ID NO: 4985 - DNA, 1268 bp, Artificial Sequence
  P26446 (PRAT3G26830::G1795(-UTR))
ttatatgcaaagtacatgtcaaaacgttatcttatttacatccatttactaatcaaatatctattttaccacaaaaggtgtgttttataccctatcatgttttactcttgagatatgttctttgacaccacccacaaaatatctctacgaaatacgaagccactatatgtctctttaatttcactttttatagtttttttcaccgctaaaattgttgactaaaaaatatattgcataaaaataattgataatatatttataagaaaaactatgataagaaaaaatataatcggttgaaatgagtcatgactaacaataattaaaggttaggaaattaaaagaaaataaattctgaaataactaaaaaaaaaaaaatagaagatgatgatatatggatccctatactaatattttggaagtacattgaaaaactaactttcaaagacccaattaattaagctcattaaggataaacatgttaaatactaacttatggacattaattaaattaaaaattataaaacgaaaataaattgatgacaaaaaaaaaactatgaattttcttattaggatttgtaatctactttcttgaaaaaaattgaagtttactgacggcttcctttttttggaaactccaaaataacaaaacatatgaagaagttttggaatagcctttgactcaacaactttaacaatagaaagaaaacatgtttaattaatgttcatgcacttcgtctcggctgccccttgtggcctgtggggttgccgggttggcttagcttgagacgacccaatactgaatttgttagctcggtcagtgaagtctacatgcatgatacaaaaagattgactagtgtttaagtttttttttttttttttttttttttttcataaatggtagtgtctcatattagaaatggtagtttgaaaagtattcagtttgtttgttcactttggattatttgattttggttttgttaattgaatcagttttgtttgaaaagtattcacttttgaaaagtgttcactttaaaaagttttgtttgaaaagtgttcactttgaaaagtattctttgagaagtgctcagttttggtttgtccacttacgattattattcacaagctacagcggatagtagtgactagtgacttatgactttgaataaagaatttccctctaaaggaatgaatacattataaatagattattaacctaagcttgatagagaagacagaacaaaaaaaaacacaagaacagggcaaggaaa

SEQ ID NO: 4986 - DNA, 1178 bp, Artificial Sequence
  P26447 (PRAT1G02360::G1795(-UTR))
atgtaaacactagtcactaatcgacagaatatgaataaatccacagtaataagaaattacaatgaatgtcagttttttagaaggattacaaatatttctgtttgaatgtcttttgtaacattatcttcttcgaaagatgagatttgtttcatagagattgtgatttttttttttttggtaaaaggttaaattttatactaattttctgattttttctgtacattgttgatacaacttattaaaaagaagaatttaaaaagtttcatagagattgtgattttttaaaaaagtttaatcatgtatttggaatggacctaaaacacataaaaacggaagacttagttgatatgatagtaaggaaccgaaatttagtttttatttttggatgagaaatcagaaaaagaaacgagtttattgtcaaaaaacatttttgtcaacttttgcacaacttaaagtgttgtaatttgtttcggctctgaaataggaacatataataaaatgtatatacaactttaccaattagttagccgccgaacgagaattttttgtgtagattccaccacattaataaaaaatacgaatgagtcttccatcaagataaaataatgagattttccatagcaagaatgagtcttcaagcattaaaaattgaaatcagtctttttcggtaatactgctacgtcgaccgaataagaatatcgtcatccactatcattttaatcgtaatacacactatctatatcattcaatgattatattgataagttgtttttattttgtatgatctcggtttcatattaagtaatgtcagctaaaaaaaatgtcattttagtgaaaagccgttatttgtttttttctctacaataaaaaataattgcttttgttgtttttttccccttcacgtattcgctttttgttgttgtcttgatatctaatctaattaaggtgtaaactatatgaaaaattataccaaaaactatagaaaaagtttcacttaacgtgaaagaagcatcgtttgatgaatgaaaacacatgagagcatgtataaacgaaccttcagaccaatgaaaaaaaagtccaccgttaaagtcaaaagtcaacgcgttgatcatttacacatctatataacaaactcatcttcttacaccaaaaccatcaagatcgatccctctctaaaa

SEQ ID NO: 4987 - DNA, 704 bp, Artificial Sequence
  P26448 (PRAT1G16420::G1795(-UTR))
atattgactattggaccttacatattccgattgtgtttgctatttactacggactaccgttttgtttttgtctcactttgataattggtgaatttttcatttttggatcagctaagtgcgacccaaacagaaattcaaaagtcaagagcataattttagtttcctaaaataggaattaatttatggatcttagattcacaaccgcatgtggaataattagtaaagaaaatgccagcctttttattattttttctttgtcaacaagctaatgccaactcttttaaaatgaatgaaacctactcatataattcctttttggccacccgtagactattccagacgattaacttaatgacactcatgtttttttccttaataatagaccatagtccattaacactttctttttattaagagtaacatgagagttatattaacatttgataataaaaacgacaatggaaatagccgccactcaaaaaagaaagaccaaggaaaaaattaaaaatgagacgtaaaaggccaataacagcaaaccacacaaagtttctcttaggagaagaggcaaaataacagtcaagcatgttggtccgtcttcagacctttcgtggtagtttaaatgctaagtctttcgtttataaataaagtgaaaaataaatgcaattcataaagaaaaaacaaaggtataattcattcattcgtca

SEQ ID NO: 4988 - DNA, 1199 bp, Artificial Sequence
  P26449 (PRAT3G63380::G1795(-UTR))
ttaatttgttgcatgctgagagctttgttattactagttaccgttatgagtgagcttaattagttgtaatcttcccttctacttattcctgaaccattgtttagtttcataagatgatggttagtctatttattctcgagcaagccattgtatttgttggttgggattttgttaagcttgctactgcttttggtgcaaacactcttgtttctttcttatccacatacagtaactcgtgatctaatgtatgtcactgagcatctctgtgtatgtatgtatatgatttgaggagtttctcgacattcacttcatcgcttgtatcggaattttatgccaaatctggtctcacctcacgtctagttttagtggaggtcaacttattttgtttgtttataaaaataaagtcaactgcttttatgtcttgctgtcgtcacatgaacaaagaaagagatgacagcgaaaatggaaagtgctatgaagtttcggtgatcaaactcataatgccttcgtcgtacacgctgctccattttattatttctaaacatagatttgtggaaaagtagacggattttgagtttgagtagtataaatttcacttgatagatattataccaaaccaagttggtgtggaagattcaatctaaatcctttttttcttctttcgctttactatattcgccatttcttttcatttgtccgtgcggactaagcaagttggtacacgcacgctattcctcctcattctacaatgacggcttgtccacaccattacatcatacggctgctttagaaattactaccaaaatctcagattaactctctcttttagggcacagtggttccaaaccgaaacacgagacaacagataagtcaaaacacaagtacaaaaggatgtgcggcccatgtcctttgatcgacatgacttcgtgtttacaacgtttctgagtggttccaccgcctgaaaatattaaactaggacaagttactttacacgagatatttaatattttaaagcagataaatagcaatcaaaaggcggccaatacggatttaaatagtaccacgaagcttagggtattagagagagagaaatcattctttgcgagtcttaagtgtcttacaagtaacaccacatttagttgagagagagcgagactcttttccttctaaaaactctctttctttcacacaaataaagc

SEQ ID NO: 4989 - DNA, 874 bp, Artificial Sequence
  P26450 (PRAT4G01010::G1795(-UTR))
aaacaagatttcatgagtcagacaagacaaaagccataaacaacacaaaagtcctgcaagattgctcacttgggcggttgggcctatatgaaaatttactatctcaaaatttaactaagagcccataaaaactgtaagatctttgctttaaatcacattgtcttcatagactttgtgattcatggtagatttgtgaagatctttggtcatctttttgtttacatttggcttattgagtgtagagtgtgaacaatctgctatgaagttggtaaaattctttggatccaaacctttaaatcgtagcatatttactatttcacactgctaggatctgtttatagctgatgcattactggaatctatgatgtttactgtgttggtctgatatataacaagttctgaattttaaaatcaaattcaatatcgaattgggcttttaattaaggttaggcccatcaaatgtttttgactctttaataattccctctcttttgtcttttattgtaaaatgcacacaatttcgaagaaactgccaatggagtctccattttccagcgccatgccaagcttgactctacgatgatagcttatttgactgcttcaaaaaaaaacttcagagaattaatttcgagaattttcccaatttcagatcatcggaaaattcttactataatctttcttatatcgcttctctcagttacttcaacgttctggtcagtttcggatataaatgttttaatttcttagtttccgtttcttcttcttcttcttttttttttttttctgttactgtaaacttggggataacgaattaaagcgatcaaatcgatgttcttatgattcaggatccgttatagcaaaaaaagcttgactc

SEQ ID NO: 4990 - DNA, 1208 bp, Artificial Sequence
  P26452 (PRAT4G18250::G1795(-UTR))
tcaatacaaacacaaaggacaatttggccgagtggtctaaggcgccagatttaggctctggtccgaaagggcgtgggttcaaatcccacagttgtcatttagatttattttttccagactttttataagatttagagactaaaaaactttttaaaataagtataacatagattgttgcctaaacgaatattgttacgtaactgtaaggtttaactttgattttggtccacaacagaagagcttaagccttttacccatgtttgatcagttttggatgctaagatatagagagtgtgcatagtcttcactcttcactcttcaaattgataatgttatgtttcagtagaacgatcaacgcaaatagtgaaagcctaatgagtggccaatcatcaaaattagagcgaataaaaaggaacaaaaaaaaagaagacaatgagtttaatactttttagcctcaacaagtttcaatcttattttttttgtaagtatctagctagttctataaaatttatttaacttagtgattagataaaagggaacaaaaaaaaaaatgactttggtgtttgctagcctctacctcaagtcctcaacccatcattttatttgtgaattaggtagataaaaatttaaaaacggacacctaaaaaatctaaattctaaatctgaaattttaaactcttttaatttttttctagtaaaatgttacgaaagtaaatcgtttgtcccataactgttaataaatggtaaaatcattcgataaaacagtcgttttttttctcttttttcatgaaaaaacttattcccattgccactaaatggaattatttagaaaaaaataaaatacctcttctttcttggcaagttcccggaaaaaaatatggattgggaaaaggatagtattgtagttacatttatttcctctatctgtttccttccttctatttattcttgattgactctcatcaccaacgaatatgtactagtaatttctactaacaagcgaggaagaagcaagagaaattataacgcgaaattcacttctttggaacgtatatttttttttctttcagcagccaatggcgaaaaggctgccattgattttcctccttacttcacattttttagtatcgggtaggattttcttttcttgattgataataacaatggttttttgttaattgtttcttatttctaagcttagcggccgc

SEQ ID NO: 4991 - DNA, 1194 bp, Artificial Sequence
  P26453 (PRAT4G21390::G1795(-UTR))
tgagtatcaatatatgctttagtgccacttgctagtgcaatccacttgaggtttggctgcatcgatattagatataaatacttaagcgtcatgcaaaaaaaagattactaaataattgtagggttattatgggattttaggcgagcaaacaacatttaaactttgaaggaatacaatttgaaatatcaagatacgtaaaatatgtcacgtgcaataaaataaagagaagacccatccaaatcaagtgtgcgatactttgaccatatgagtcaatgtggcggccaaaggcaacaagcatatctaatctaagtattatataactaagcaaatattccactaaactagtatacaaagccaactgctccactaattgcctgacatacttatttattttcaaatttggtaaccacacctatagcttatacattttcttcgatggccttatacaataggaatatactattaccttctcattgttcttattatcatcaaccatttgataaatcctcatcactcttaaacattgactatgaactaaggacgtcagaagtagtccatacaagatatgaatggttggatcgtcctaagtcattgtattaatatacgtttctaatcaatggaaactatataattgtaatataatttttactaaatcatgtaacttgaaaacctaactttctttcttaataaaaattgaaccgctaaagtatctaatccatcatgtgtcaactgacaccgtccaaaatcctcttagagatgtaagaaaaagtttcaaaacaattaggtcagccaccaatcacatatttctatgcaggttgtataatcttgaaaaagaacaaaaaaagtagatgacaaaaaagaattaaaagacaataataataataccttataaagatgataataattcaaacagtttgacctttttatttcaattctctggtccaactttccaacctgacgagacaaaaatatagaaacttctcaacagcaataaaacagcaacctttcctttttgtatcccttctcctttgtcacctctcctcttacttttttatcaataggaagtttccgccattgtgacagacacagttcctctgtttctcttctttcatctttaagcaaacctcaaaaaccaatcctttattacgaagatcctcacttgtgtcttcttctccaacactaaaccccaagaaa

SEQ ID NO: 4992 - DNA, 1193 bp, Artificial Sequence
  P26454 (PRAT4G35110::G1795(-UTR))
tctcactcgtatttgtataaccgtcccacgttgttgtccacttctggaagataagtgaggtgtgtgattgattgccgtttccaacctcttttcaattaaatgcttctctctatcttcaattggtaatattggctttggtcaattcatcatcatcatcatattattattataccaaagacaatgtcacatgaaccttataatatacacaactgttataccttataaacaaaaataaaaatcaacattttattcatttttctccgctcatcacatttctctccctcttccgattctcctggtatatctctctctctctttctctttatttctctgtttgttgattgattgcatttttgtgtgaattaaaagtttggttctttgatccacaaatagattcttgatctcgatcagaatcgtgggtttgcttttgttttaagaattaattcaatgatcgatgatgaaactgattgatactgttttattgtcatatgctctgtttctttgctctgttctaaggaaattttgtgacaaacgacaatcatggaaaacgaaatttcaacctattaaaaaaatattatccacaagggtgggccttggaagtttttgtctgttcaagaaaacaagccggtcaaaataatctaccttttaactctggtctaagtcaataactgagtgcttccaccgttgaaatttagtatctcactggaaaattgtacttggaaattgcatggtcggtccatgaaagtattaaggagaagaaacaaaccaaaagtcgtctttttgtatctctctatacctatacattttatgatttgattggttttgtggggatcaatttcactattactcgtaagaaatttctttatggatatgttttggtgaatctctctctgcttctcacaatctccctctttactttttttctttcatcatataaagggttggtgaaatatgaatggaatccaatttcgttgggaggttgttgtatattataagtttttagtgtctaatctttttgaactatttgttgaaattaaggtgtaaaggtttgaccacttacttacccttaatgtgatatgttcagtcctttgacaccacaaatttgaagttcttgtgttgttctttgagtttgtcttctttgagctgattagttatcttgattttgttgcagttgttccattcatcaaaaagct

SEQ ID NO: 4993 - DNA, 1199 bp, Artificial Sequence
  P26456 (PRAT5G12930::G1795(-UTR))
gattattcaaaagacaactcatgtgcccgcgcatgtgcttgacgttcgtttgccgtgtattagaactttaaaaactgattcatataaatcatcggtcgattgaaatatattaacatggattatgatgacaacaatcattatacaattaagttttatgaaatgatcatccacaaaacataacttttgtcggctatttttttgttgacgtgacaaactaaattagtaaactgtgttttgagtgcaaaaagatgagaaatttgtgggattgattgcatagaataacacttacaaaaatgtaggtagtatgcaggggagtcaacaacagacgacttttcataattcagaaaacgaagaaaaacaaaaagaaaggtcgatttcccaaggactagggcatagcacgtgtctatatcactggaggatatatcacttagaccgttagacgtcacgtgtaatcgtgtattaatgcttgcaaaatgtggttcaatcaaatacccaattaagggttatgagaactaatacaaaaatgtggttcccgtaaataatgcatgagcaagcacatgactgacatgagagatagaccagcgaataaaggttaagtattgacgcaccatgcaaagcgtaacggtgaactggagctctactggctgagataattcacaaggtgaaggtgagatatattttaggagagccagaaaggtagaacccaagacaaataaagagagagaccaagtgagttttggactaatgtttttcaaagaatgtgtctataactatttattaagttccaaaaaaagacaaataaaagtatgatttttctatataggactactcgattaatcttaacaaaaagacgaataagcagaaaacatatatgtttgttttttcaaaacaataaccttggaaatcaaaacaccagaaaaatgtggctgtgaagaaaagtacaagagagacagtaaaaagaaaatgaaccaaaaaggcaaaaaaatgaatacgtggcttcaatgtagacccagacgatgaacgtcgcatcaccttccttacgggggaaatctcacattttgaaattacagaaaactccaaagaacccaaaattgaatattgaatattgaaaattgaaaaaatctctctttgaagaattgaaatctctctttgaagacgaacgaacctcgttgattcctccattcctcttcggctcgtcc

SEQ ID NO: 4994 - DNA, 1198 bp, Artificial Sequence
  P26457 (PRAT5G18470::G1795(-UTR))
tcagaaatctttgatcccactgacaacgtgaaaacatttttactgtattggttggctaaatgagttttagttattacaccaagagatttgagttcaaacttcaaaatatactatttttgtttgagtttgttgttcaagtattacatagctgattacagaaaccaaagaaatataagatccaatgtacttggacttcttttctttttttgtcgtcaatttcattaaatccttaaaaggattacatggtgaaaggaaaacccacatatacacaaagttaaagcccaattaacccaaatattgattacgatgaaagaacaaaatgggctaaaaagagacacgtgtgtacacgtggaggcatggatgaaatataagatccaatgtacttggacttctaaaataacaaataatgtaacactagattttagaaaacaaaaaccatccaactcgatcattcatcaatattatatagagaaaacagtcataatgttagagagagacgtatgaatcgaaattcatattactgtatttcgattacctaaaaagtttcgaaaaagaattaaaagtttgtgtggaagattccaatacacgttgctatcggaagaagacttggaaaattattcctcaagtcgttaatgcttggaattagtgactaacaatcatcattattccattgaaagagccgcccacgacgcgtttccattttccacaccagtcaaagttgatgtctcaaattagtaactgatttacaattttaaattacaaaatacaaagcccgtacaagctaatgtaaacggaagtaaaaccaaatacattaacaacttttagtttagctgttcaaaggacagagatatgacctcaaccttaacccaatctttcgtctgtgtttgaaacttctgctcgtaaagagactctagtaaaacccttcggaagaaattttttaggtagtcgccatcatataatttaaagcttatgagacttgttatgttacaagcagagaccaaagactattcataatcacttatcagagtataaaatactctttttttgtcaatcgagtataaaatactctgatatcacttatacaaagttctacgaaactcattaaagatttgagagtgtacaagggacaaaaggtgctataaatatctcttaaaagagagctaaaagttaaggaaacacttaaccaagcaaacaacaa

SEQ ID NO: 4995 - DNA, 998 bp, Artificial Sequence
  P26458 (PRAT5G22530::G1795(-UTR))
atttcttacaaacctctaaacctttatgatgtttctagaggaccgggaaatatattgcatgcacccgtaaactacctttcaattttctacataagtcacttcaacacaacatttgatggccaaaatgtaaactgtgattagcttactccttaaagagtgaacaaaagttgcagaagtgactctatttgaaccttactctttatctgataatagagagacattaccaaagtataaaagagtttagtaatcctaacgtgtctttgctaggagttacaaaaaaaggagtcacctttgatggcttggataattaaagacttttagtagtcctttttggactaatgaaagactaaagaaacgacttttgacccaaaaaaaaaaaaaaaaaaagacttaagaaacgactcttggactacggcctaaaaatttagtacttttagtctccaccaactctttcttattatataaataattttgcctacacaattttagacaaaacttcctaaaggtataacataattgcctagaagatgacataatttttacacattttttgttgaatctgcataatgcgacacagtttaagaagaccgttaaagataacataacttcctaaacttatgcagtctacaagatgacataatttgcacattttgaaagcaaaaattggatttatggcattttagacaaaacttcctaaaggtaaaagttttacaaagtgagttgcgtggacttagtatacttttttagtttttttttttgccctctctttttggtaatttcctgcaagtgagtggtggaagaaaggaagctgcgtggagtcccaaaaattaaaattgcagaaaaacaggtcttataataatcagcttaatagctcaggtctctttttctcattctgaagattaaacatcttcaaggaacctaatctttgtctctggttttaccttcgacaaacaagcacacatattgtttgttaaaaaatcatctatcccccaagaaaa

SEQ ID NO: 4996 - DNA, 1201 bp, Artificial Sequence
  P26459 (PRAT5G24110::G1795(-UTR))
taacagacatcaccgaaaaagtcgccgaaaaaattgaccggaaccacatatgtaaaaatgagttccaacaagaggcagtacaaaagaataggcataaccgtaccgcataagtgttcaagcccaaggcaaagccatatctaaaaatattttcatacaaaaaggtgtatacctaaaattttcttttgaagtaagaacaaaaaaaaagttaaaatttattttcatatgttctcgaaaagtatatttattctaatatgaaatggcaaataattttgccccgctggaatttctatatagtttgcgtttattagagtttgcgtttgtatttagcattattattatttgcattgtcgttagcttttacatctgcatttagtgttatgtttctagcttttgctttggcatttctattttttttttgttagagtttgattttgaatctattttaagatttatatatgacgaatttatttattatatatattatgaaatttcatatgttatactatatttttctaatgtatattgtttagtctcataaactttttaaacgcctagattgtctaaacgtcgattatgggttatatattgattattgacactaggtgatcaattgtcactccttattgtctacagttatcttaaacacttttatagaaactctagaaatgctatcttgtattgaatttggttccataaatggatcgataattaaacttgatccaaaacaaaatgaatattccaacataatgaccatatttgtctcttggaatttctaaactcaatattagaattttatagcaaaattaaaatttacaatagaaaatcatatcctaataagaatgaatagttattaacaaattaatattacgaatgtaagttaaatgattgagaccctaatattaaaacaaaaccagatcatgtaattcaaaatccaataaatcaaaaataaaaaggatcgagaagcagagaactggtcagcatgttggactttccaaattcattgaccaaagactggtctcacttctcacaaaccacatcagctttcttcgttcttcagtcaaaaagtcaaactatctctctcacacatcctctttaaattctcctctttctcagtttccagaagccatgcaaaaataaacatagtaacaatactttaaactatttacaccactttaatcttattctccactctttgaacgta

SEQ ID NO: 4997 - DNA, 939 bp, Artificial Sequence
  P26460 (PRAT1G24140::G1795(-UTR))
tgtaattaaaatctgtaactaaaatgaattagtcagtcaaaaatatcataactacgaaataaatgtacactaaacactatcaaacgtcccttagtttagattttggttaataaagctatgcgtttacaggcttctaagttttaataatgttggtgcaaacgtggttgaactaattctgaaaacaatttttagcctaaatggatctaacatgaaaatctacatttttctgtttatatgtatcctaattctgtttagaaagggcttcaaacttttggcccaaaactttatatgcatgtatgatatatcaattaattttaccgatggagacttgcatgttatacccattacaggaaaaaattagatagcctaacaaacaagtcatggcgttactcgtgtaaggtggagattttacgttgattttttcaaccaataacaacaacctccggaaaaattatcacaaaaagaaaaaagaccaattcaaacattcaacgacccaaaaaaaacaaaaacactttcaaccaatttagttgattctgccgccttcaaccatttttgttgcatggttctttttccaactttgcatttaaccggtcctttaccaccggtcaatcacaatttctagtcatccaagactaaatcgggcctaatctattgcaccaagccaccaatcaactttaattatccataaaacgacactatctattggcagaagcttcattagtctttttcttcgtgagaccctttgaaacgaggacggaggaagtttcctttgaataatgcagcattttcaacatagaaaattctccaaacgcaacgcagaaatgacctctgctttctccaacgtcaaacttgtttagttttatctatgtcatctctctaattctcttgtaaatctcaataatacctcttcacttaatctttttaatatttctcttttgg

SEQ ID NO: 4998 - DNA, 1008 bp, Artificial Sequence
  P26461 (PRAT5G48540::G1795(-UTR))
ctctttaaattttatttctaatggcatacctatgtaattacttacaaaaaataagattatatttaaaatgtacttcccaaataatatagcaggaagttttcatttttaattatatatgtgccttttcatttaacaaattttccaacatgaaaagaagatatgttggtaaatggtaatctacaaacccaaataaaaaagaatataaaaaaaattttagttaaagataaatataaattctttatcaatactatttccataccaacttgtaaatcttcaaattattttgattagtatctatctacaccaagtaccggaacaagtttttgtgcaatacggaatcttcacctcaaaccaagcctaacataggcattcatcaaggctgaaattgtgcacaataacacgtacaaaaaatcatcgtaaaataaatacgaacatctctcgaaacagagaagtggtcaatggtggttatattttttctttttttgtggtggtgatattatgtaatatgattagtcattgaagaccttttgtagagagaagtggtcgatgttgcgccactttagcgttaacgttgacgtttggaaataagaagcaataaataaatcgacggtcaataattcctgctccatatatgttgacctacacgtgatgccattttggaatcttccaacgaaaattatttagttttaattcaattcaatatattatccattttgtctttctacaatacacaaatgaaaaaaacaaagtaaaattgaccaactaatatttatttactgatttgattggtcacaaactcacaagattttggccacaatatagacttctcggtcaacaaaaatttgtatttgatcataaataaataaacaattatttcccacttgttgttatgcgttttgaccgacttctaaaaaaatcaacgttctagaatagataacgttttggtataaaatcagtctcttcttctagtgactcaaaacaaactgtaaagtttattaagaaataata

SEQ ID NO: 4999 - DNA, 706 bp, Artificial Sequence
  P26462 (PRAT1G26420::G1795(-UTR))
atattcgtttttataagaaatgaaatgaatacagataatatattagtaggtgctacaatctccaaagtttgcaaaaatttgagtttcttctattcggtaagaaactctaatatcaaaaaatctaaatcgctagaaggagggatcgaacctccgaccttgtggttaacagccacacgctctaaccaactgagctattccagcttttgttaatatgtgttagttaacttttatatatcttaccataacaaaaaaaaaattcaacaaagattaatcgtgcaccgggggtcggggggatatttttaagataacattcaacaaagattaatcgtattcaactttattaaattctctatctgtattcaacttttttccactattgaaatttgcaatatatatactagatagaaactacaataatataatcccaaaacatgcatgtcaaatagcgaagtaattccatagtcaatccctgatcccagtcatgactcatgacaacgacttctctgtaatagcgttggaaatcatttccactagcttgttcaaaccaaacatctacatgttgactaaagaaatttcaaaataaacctgcaaaaaccaaattcaaagtaaacctatatgacaaaacagaagtcaattatatattaatttctctctattctataaactaaaatcctaatagagacgtaagacaaaattaaataaaaat

SEQ ID NO: 5000 - DNA, 1062 bp, Artificial Sequence
  P26463 (PRAT1G26380::G1795(-UTR))
aatctgaaatttaaattattatcataaagctacttctttattttagttacttgtagtcttaaaatacttagggacggtttatattaagtcacataaaaatcatgaatcattctattatatactaaaagtataaaccagaatttatcagtagtatcatagttcatcaagaatatcacatttcatatcaaactttcagtatatatacgaatgtctgataaataagttagaaaaaaaaactaaaataattgtgaagcataacaattcacaaatcaaaattaacttgaaaaacatctaattaaaacaaaacaaaaaaaaaagatagttacatgcgtaaataggtttaagtctacataaattaatataacagtagacgcagacacaatttaatggtggtctgatttaacgatgacggataggatcgacatttctactataagaaaagtcaatcgcacttttaaattaaaagataagttatgtatcaaaatttctcggccatcttaaaataatgggaaaataataatatagtcattagtattttacaacaacgtagccttataaaatttgaattcaacgaggggggacaaagaaaacaaaggattcaaagagaagagagaggaaaattcagtgcattctacaaatacatttggcataaaattcaacaatacttaatcgcaattatttcaattagtagatagctaggtttggtcaaaatatgaatgaagtcttaccttaggtttccatttataaaatctcgtggtcacttaaaaaatctctgtattcaactacctaaaatgatcatttgaaataaagaagttcagttgatgcgactcaccccctgatctaaattatgaaagtcatttcccctgtactatacgtattacgtacgttgtaatttcataactttgttcaaaataaacagctacttgacgaaaagtcaaaccaaattcaaaagtacaccgatatggaaaaaatggtcaagattgtcaagttgaaattattgtctccatatatattggtattctataaattacaaagtagaggcataatgaaccaaacagcaaa

SEQ ID NO: 5001 - DNA, 1185 bp, Artificial Sequence
  P26465 (PRAT1G28190::G1795(-UTR))
ttcaaaaccaaaataaagtaatgaagaagcgagtcaaagtaaggcaacataattacgtacactatttgatgagtcaaacctacatctttctatgaccaaatttgagaggtggctacttctcttaggctttgcaacttgaaaaatatgttccgcatctaatctaataataggatgttgtcatgttcatatgtttcgttgaaaaatattaattctaattaaaactcgtgttaacatcaggattggatttttatgttcatagtgataattaaatatctccaagattagtgtaacaacaacaaaaaaaagaataatacttatatcataatctcaggatgatcatgattgctcaactaagtagggattgggtcaatcactggttaaaagagaagaaaaaggtgtaatgattattctagagttttcattaaagttgaaataccttaaaaccaagattgaaatgtctaaaaagaacactcgatacttccttttaattccaccggtctaagtcttctttcattttatatatttgtataacctaatgccgtcacgcacgttaaacatagtcaaattctttattcatatattattattttaatcgcttcttaatcacagttaacatacttggaccaaacctagtccatatatccaacttttaaagcatggatgtccgataacatagttgaaacatatacatataaggtgtgcataaaaatataaataatatgtatgcatgaaaaaaaagaaaaatacaaaacattactaaacgaatggaataaaaaaaatctgtatattaatagatgagtatacttattagtaaaaatttattttaaagtaaattgaaattagccaaaaagataaagtgaaaaagatgtaaaaaattgaatttttcttgaaagccaaaaattatttgtttgggcccctatttgtttaccaaataaaatgaaatgaaggagaactcatatatttgaatatgaaaattgaaaacaaacacatttttaaagggagataaattcttttgtatgtaaaatactctcagtgtatatatatacaaaccaaaacttcatttcatttgttcacactgaaactccaaaactctatctctctctctcctccacacaccaatttcttcatgaccttcttcttctagcagagaagattaaagaaacccccaaatccagcttatactaa

SEQ ID NO: 5002 - DNA, 1200 bp, Artificial Sequence
  P26466 (PRAT1G30700::G1795(-UTR))
caatatgaaagtcaaaccagccgctcaaatgtatccttcatgagttcatgttatatttcagtcaatacttttcatatttaaacacttattataattacgtaatatttttttgcccaaaaaaaaaaattacgtaatattcaacatctctaccttgtagagttccaaaacattgtcacaaaatatctataaagaatttattttaactaattaggtcgttaattgtccaagggtttttcatagttgatatagttctgttcaaatatagccatccttaatcgattcatgggatcgtaaattactacttcgagtgttgtaaaaaaaaatgaaacttctacattacaaactcgaatttaatgcatctggagtgatactataaaagtagggatgctctcaggtcgcatttgagagacacagaaatgattttaatggaattaatatattttcagtttttcacaaaaaaaaattgtgtttataacaactgcagattcaatgctgattttatgagtctcacctatagaatttatatttctatattcatagaggcagtataggtgttgacccaacatcgaaagaacacttcgtaaaaaattctttggaacaaggctgaaaatttactcccaaatttagctatccgatgaagataaatcatttaccgtttattaaagaattatcgagattttagtccaaaccaaaagagattatgagcctaagattttgaatttgtattggtaaaagaaattgaacgaaaatttcagaaaaaaatattaataaattgaacgatagagttcacttactacatagtcaactagtgcctagctataatagtttcaaaagacaaaaagaaacaaaatcggttaactacttccgtgacataattctcattttgatttttgaatccagtctaatttgaaaagtatattcaaaatctttaaatccattaatgataacttttataatacgttgacacacgcaattgtatatacaatattcttgaattttaaatgtaaattctagaatatattgcgatcaccacactaatcaaaatctttgggacaacttgaacccacatttgacttttcttggtcaaatattttggcatcatgcatgatcttctctataaaaaccaaaaggcctcaacgacattcataaactcagtcattatatttatttttgttgtatttcaacgttcaatctctgaaa

SEQ ID NO: 5003 - DNA, 1199 bp, Artificial Sequence
  P26467 (PRAT1G35230::G1795(-UTR))
cttctaagaatagttgcaagcctttaaatactccgacaaatctggcattagccgaaagatattccaaactcaaaatcggatcagatagtgtggtggtctaattttacctggatcgggagatgtccactctgtaccaccttgatgcatttttactgatactgatcagatcaaccgatataatatatatataaaaaaagaaagttcgtccaaaaggaatcattattttcttaaccaatagaatataggaaataataggataaatctatattagtggacaggtaatagaatgctttcattcacattgaaatcatattgtaataagcacacttttcttatcaaaaaaaaaaggcaaaaagaaatggccacgcaataaaatcattagggtaagttgaattttggtccataatattataaattaatttaatctcgaaagcttaatcttatgatctcatgtgatctttattgaatttacttacttccatagagttttgtattttgtctaaggaaagaaaaaaaaagtctgccagctttggaacgccgcccattcctctagactttcttggaaacaacgcgttgttcttgttggggtcgacgaagactcactaaatccatccgacgactcagattttatcttggcttcttttgatgtgtacacatatccaccctgatttgattcccaaagccaaaagcctgaacaatgtagtgtagaagaagtgacgggaaaaaacggtaatgaatccacaatggatatttacagaaagaaataaaattatatagattatagagaagcaaaattatgcaaataatctttatttaatactattaaaagagtagctgttggaaactataacaggtaatttaaaatattttacaagttcaacatataataattttgaaattcagtccaacataactatcagtatggaaataagccaaacaaattactcaaaataagaaatatgttttcacattattatttaaacatttttagtcatttgtttggcttatttccaaaacgatatttatgttggacttgttttcaaaagtattatgttgaacttgtaaaaaaaatttatatagctgttgaaatttccaagaaaataaggttttacacctaaacccttccactatatatataaaccccacttttgtctctatatctttactaatttcttaaaccctctcaacaatacgtaaca

SEQ ID NO: 5004 - DNA, 696 bp, Artificial Sequence
  P26468 (PRAT1G56060::G1795(-UTR))
tttaattgtcagtcatgcattaggttcacttacatggtaacggattatttgtggtgttgttgatttagtaaattggaatgttgaagaatgcagccaggtcccttgaatagtgggagctccttaaaaaatattccaagtcgatagtgtttagaagatgcgttcggtggctatttcctaaggaaacccacattgctcatttatcacttagtttaattatctcatctataaataaaacgtccagtttggacaccaaatcacgaatcacttattaatctttggtgatcttgtgtattagttttaagaggatgtcatttagagagttaataagctgattcgtgatttaacaccattggcccaaatacatgattgattatgggtcgtacaaggcaacaataaggttggttacttatcaaaacaccggtgagaacacgtccattgactcgttatgaagtgttttgacctggaaccttcagagacgaccagaatcaaggacgcctcctacttttatttgaaacgcgttgtgtcgtgttcggtctggctagaaaccggaagtttctacgaacacacctcctaacaaattcaatatcttaaaccggaagataacgtcagaaaatgtataaatatacactttgaattgaagcaattcacaaaaatcattcatcatctctcttaactcatcattacacagacatagca

SEQ ID NO: 5005 - DNA, 1165 bp, Artificial Sequence
  P26469 (PRAT1G57630::G1795(-UTR))
tcgagagtcgcatggtacagtataatgtcgctggggatttgcattgtggtctctggtttacagattttgtacttgaagcaatactttgaaaagaagaagcttatttagatcatggatagtttcttgttgaagattactagaaccaacagtttgctctgctttctttctcttgatcttctctttggaactgttagtgtaaaattttgttcactcatttaacttgtaatttgtctcctattattacatataacatataactagactctaattataggaattgcaactaaatttctcttgataaaaataataatgaatttctttggcatgtgtttttttatattatctgaactgaaccaaattgcagaattgtgacttgagaaaaacagaggactctgttgatatgaagtctcatagtataaacagaggactctatgtgaaacagagttacgaaaaattctaaagtaatgaaaaaaacacattgtggttttatctggattagaaaagccttcatatattttatctgacaacattaagaagcttaggagatttcttgggatgcaagcattttgtaacctgttttttgctacataacatgacattgtgttccagctaggtcaaaagagtattacagcattattcacataacacacagagcacaaagttaaatctttgtagagtttctataagacgacaagaacatatgtccacaatacgaaacataggctgatgcatgtggcgggggcaactgtggtggagaggttggtcataaatttggggcgtacacggaaactcagacttttcctcaatacaaaacatagtctgatgcattacgtcgtcggtgcatgattgtcaaggtagacgccgcaaataagcttctcggaaaaactctatacatgtgaacgtagactagtctatggaatccttttttgctatgactaagtccaaacattgaacttattgcttggaaactgcatatatttgaatttagattttgatggagactttcgttttcttcgctgaaattgcttgtgcgtttcattgctatttccttcttagaactagagaaccacaaccattttctgagttattacttcctacatagctctataacctctattattactttattagatctctgatcttaaatcgtctctctgtcgtagta

SEQ ID NO: 5006 - DNA, 1194 bp, Artificial Sequence
  P26470 (PRAT1G61560::G1795(-UTR))
aagaacacatttgaaccaatcatcgaaatatatggtggaaatatatttctaccaaagatttgttttttaaccaaataattgaacacaacgctaactgaatattttataaaactgatacagatttattaaaaattttgctaataaacattataaaattgcttttaccaattataggatgtattgtatctcttggactttaatatcgttgacgatcttgacaaataaaaagctggcgtttcattaaattggtatttacaatgagaaaaatgtgtgggatccaaaactggatataggattcgctttactgtatctggatccgaaactctaaaatatgatgtttcttatgatctggattttttcaaactataaatgatttctgaatttccgtgtatgtcaaccaatatttaaaaacagattatatttcttaaatatttttcagattttttgaaaaatattctgtaaattacaaatgcaaataaattatttaagaccgttaaggatcaaatatgtttttagtttattcaaatctctcgttctctcatatcgctattttgtacttagtttagataaaagtattaagtttggcttcttagaatttgatgtttctttttttcgtttttgctatcgacttttgttttttttttttttactattttgttgttatttatctattccttagattttggttttgtttctgatacttatattttctgtaatttatgtcgcaacttcaaaaataatataaatactttacattgatattaaaaaaaaaaaattgagctctaatgacctttggagctcatgctcatctatggaaaaaaaaatccatgcaggaagaaccaagaggaaacggtatacaaaataatattaaataaataattatttgtcaataaaataaataaaaactcaccaaagtacataacagttcacacagcatgtttttagaaaagatcatatactattggtttcaaagtctttgactttgaatgtttgaacttttcaaggttcgcctactcgccggtcgtctcctttaaccttcgtctctgtgtttatataagaacatatacgtatttgatgattacaaaaagacaattctttatccttctttagatttctgtggaaagttcactatttattaggagagacaatttcaaaaaggaaagctttttgcttggaactgttctgtgagttcta

SEQ ID NO: 5007 - DNA, 1125 bp, Artificial Sequence
  P26471 (PRAT1G67810::G1795(-UTR))
ttggtcagtacactcaagtgtagccgtaagctatgacgacgaaatgaaaacaactttaaattatttcccaagcctctttccgacagtatggggctctaaaagtatatcactaattcagtagtcgaatcgaatatgcctttgttctttcccttttaaatccataatttatttctaaaataataaaaaggagattgtcactggagaagccgcctcaaatgatgtccatatcgcatcataacatttaacgtcacacgataaaacaaaacatttcgtattttgttttgcaatctatttagtaattgcattattagtagtggcctatctcttttgaagttgaaagtctctagttgacttggtcgtatttgtatcattgtcacatataagtgaaaattaagatggacatttccgatattattagctaaattaaatcattctaattttttttaccagatattcaaaattccaactcatttagagtttcacgttggcatccaagtacttggattagctttcgactaaacaagaaattttacgtttttgcatagattataaaattagtttgaaaatttggttcaaaaatttcctgattaaaagaatataacgaagcattttataatgatgacaatgattcataatttttgtaagtgcttcagttgctacctaactcaaagtcgcaacttatattctaacagtttcatcattttaattttctaaaaaaaaaaaaaaatcaaagaccaaaaaattctaaattaaacctataatagtttcctttaaccaaaaaaaaaaaacctatactagtttcaaggctcgtagaggaagttagattacttaccatttaaaaatctacaatttaaatatataatttttttaaagtattttataaaataacattacaagatagatctttttttttttggtaaaaaataagatagattatatatagatagatcaataaacataaaaatagttttggcgcgttatagaaaggctctatgcatctaatcactatcctctctccgtcgcgtagttcaaggagttctcctttgattatccttaaatatctctcttctctcgttttcttctacctcctcctcccatttcttttcattgcccttgttacggaac

SEQ ID NO: 5008 - DNA, 664 bp, Artificial Sequence
  P26472 (PRAT1G24145::G1795(-UTR))
gggggtactgtttgctaattttggaatatttttgctaatttcatgattttttttgttaattatgggacttaataataatttaaaaaaacatagaaaacgtaaaaatttgagacccaatataaatgtttcaacattatgcgtaaaaggacaggccttcctaaaattagaacattttatatgatatcctcttaagtcttaagtactatcgaagccggagatttctaagttttacttttactaattaagctattgacacttgataaatgccatatttttgcattccctaaaacctcaaaactctctaaacacgtttttgtggacatattaaaatagtgtattttgtagtctcttccaggtttcttccttcttgtcaacgtcgcacaagtccgtttacggatatgggtgaataattgaatattatccatgtttccttattagcagtcgctattgtgggtttctttttggtagtctaatttattatttacttctttaaaatggggaaacagatacaaagttgcattacatatataacgcaatacaattagatcccatttgaccgagtaaacgctaagatccacacaaactcaatcgtcaactcctctctcttctctattctatatagttgcgtgaaatgtaatgaaagtgatcatcattcacttctaag

SEQ ID NO: 5009 - DNA, 1193 bp, Artificial Sequence
  P26474 (PRAT4G35180::G1795(-UTR))
atgttttagctggtcatcatcaactcgatttaagaaaactgaattcataaatttttagttgactacttgactggtgttcgttgactagttcacttatttaagtttttcttattaccagacctagaaagaaaaaaatgaaaaaaaaatcaccaaatgtccaaatgagatagcaatgtagtactagttaatagattgtttcttaagtcttatagatttgtatcaaagggcttcttgactgatacaagtttcttcctttaattcggtttataatagtattgatctaaaaccaaactacaaatacttacttaccactaaacttacttttcaaactttggcttgaagctaaacttgaagctaattctcacttaccactagacttgaagctacttttgaaactttggtctcacataactagagttgtaaaattagatgactagatgcctactctatatactttttaattatttttgctcataacaaaagtcgagtcaaaaacaactcgcacgtttatcatctttaattaactacttgattaatacttattaatcgtgtatacaaagagacgatgaaggaagatcagctcaaagttgacccttgcgttgaccaaaacatccgaagagcaaacaaagtccaattgaacaatgaacacaatctaacacaaactagtttggtttactttttagcctggcttgagttttaagctaccgaacaaaattagaagacttcgatttataccgatgggtctcgctttcgagagtatttgaaagtgacataaccgattacgtcatctttctcgtgtcattaatgcttacgtcatagctaataatttctaccgttcagaatatattttcttatatggtaattagagatatgaattgtttagtgttaaagtattgagattctcttgagcacttaaacagaaaaaaacaattccctaagaaaaataccttccttttttttgttttggaaaaagagattcaaagtcaatatacacagccaccgaacaaattactctatataaatccaatgaaagcagagtaaacatttatatagccatacaatttgtggctcgacgtaaataacgcgattggagtcgttagaggaaaataaagtttattttgtatacaatgtctatagcattgggaaacttatttgatttggaatcacaagaaagtggtggttctcctttattt

SEQ ID NO: 5010 - DNA, 1171 bp, Artificial Sequence
  P26476 (PRAT5G64905::G1795(-UTR))
caaaaaccttaaacgcagtgataatcatcctatcacaattcacaacgtgcattatgaatggtaatattatatacaaagttgacgagtgctctctatgagtaacgcatgatcgctctatgatttaataaaatatactccacgaggagcagaagcaacaccaacttcgaatataaaacacatttaacaatcttcactgtgactttagacatcatgatttttttggtgttctttttttaaaaaactcataatctggtgataagtctcgtagttacctcatcgtagaaccacaatttagtatttacacaagaaggtatggtctgattaaagtttgggggtctttgtaattaggcctacaataatcattcacaaatttgaaatattacaatttatgagggaccacaacacctaaaaaggcataaatgcattatgcccagtggcgacgaaaaaagtgcattaaaccaaaggaatatatgtttgatttttattttaatgtgggaatgggatatgcaatattacaattatgatattatctgaaattttatatctttacaaaatttgattttcaaacttaaattctatagtatgatctacatgaacactttatattcttatgcaagaaaaacaagtcctttgtccaatcattgacctcttaattgaatttgaaatatttaacaaagtacccaatagataattcttttgttcttgttaaattagattttcaaaatactaagctttagcattaatttgaataatcaaagatcttcctttgaattacctattcaacatttgtttaataacttaattcaaacaaaaaccaaagaagagcgtgaattgactttgaccaaaaccaaattctctcaagagttgctgccatattttgaccgcgcgccacgtagattagagtcaaaattgttattttattcacttcaacataaaaccaaataagcattatcggttttcaacataccggcaccaacttttccaaagtctgtatgtacctaacaaaaccggtttatcatagaaacggtcaacacaccaaaaatagttgaccaacaactacccaagtgatatccctttaaaaggagtcgcatatgtgttaccaagttccatcatcaacctaataacacacaacactaaatctctttaccaaaaaaagattaagaagtcaacg

SEQ ID NO: 5011 - DNA, 875 bp, Artificial Sequence
  P26477 (PRAT2G29460::G1795(-UTR))
tctcataacatatttttgttctgtaatttagatgataaattgataaccaatttgtattattacgaagaaaaagaaaacagtttgaactattcattaaaaaaagttattgtttaaaaggtattttattagattaaaatattaaattaattgtaattcacttttggaccacgcatttagcatcacacgtataactttaacaaatcaggtaaaaccaaatttctttaattaggtaaagaaacagaagactgaaagaaaaactagtttggaaacaaaaaatggtatttgcaggaattgtaaggaatttgggatactagaaatgtatggatctaagttagaaaaaatcaacaaaaatttgttgaatattatttataaagttggtatgtttgaggaaattgaaaaagataaaatatatttgaatatatggagagatgatataatgtgttcacggttcattggatatttagcagtgaatgaatcaagagaaagcaaaatagttattttcttctttcccgtcgttttagtatacttttcaagcacgagaacggaatcacaaaaactagtcaaaaaaggcgttaaatcctatagaacaaaaacatataagctatggtttcgaacgggaaccaaaccataatatgcgatgcacttctaatagcaatcaaaaatttgttaatatgtacatatatatttttgttttattaaaaccgtatcatactttatctgcagttaaaccgcacatctttattcggagcctatatatctacactgcctatatatcaaccgaccaaacattcacgaaaacaaaccacataaactagtcaaagaagaatagatgagttacattataaaaaagttcaagtgagagaaagagaggtcca

SEQ ID NO: 5012 - DNA, 1166 bp, Artificial Sequence
  P26479 (PRAT2G32210::G1795(-UTR))
aggacaatttgttattgtggctcaacgtaaccgggaccgcacgtttgataagttattgtttttttttttgttaaatgcagtcttgcgaccatgttggcctgttgcgtcctcgacgcatgcattttctgagttcggaggaagcagtcgattgtttattaaatttgacacttcatgcaaatatttttcattgtattttgcaagtagtttttgggattcgattagcttataacatttggacctcctatttgttgatttaattatttattactactttttttattttattacaacttagtttgtaatagtaaaatttattctactttgtgcccaaaactgtcaattgttgttcatttaaatttctggaattagatttagatacgctaaattaaatcacattttgcgtttatattcccacctaatttgaaaccagcaattattcttcttcataagaaaactttcatgtgctctctcgaaaataaagttttactctaataacaacacgcactttggacgagataaagcgattcaagtaaaattattatggttcaaactattatctaagatccgtttgtgtaaaacataacttctaataacatatatattctgatctacttttgttagtttttattagttaatataagcgttaattattgttctctcttttgcttaacatgtaaatattcccatggagaaagaagtacactttttgctttgagaaagaataaaaaaactctttattattactaaatcaagaaaaatataaaaccatgctgcatttatcatcattttacatattctatatataaggttctctaattcgtatacttttgtaaatagagaacaacgaattaaaagaccaaatcgatagcatcttacctttttgttgatatttattaagagaaaaaatcaacacattgttattcttcaagagaataaatttctggagacttagcagttaatgcaatctgacctcacgcgttttttttttttgacctcacgcggttttactaaaccgaccttcgtttacttcccttacctctctatatatatatctctatcttcatttgcatatttcaattcatttcataatcatacacctctctacatttgttactactttcttctaacttgttttcaaagagaaatcacaatctatctgttccaag

SEQ ID NO: 5013 - DNA, 1194 bp, Artificial Sequence
  P26481 (PRAT2G35980::G1795(-UTR))
agcagaatagtggggttttcacgttgactatatgcgttgatggacgcgtgaggtggaaggtcgggactcttactatagggaattatcatctccatgttcgttgtcaggcgttcataaaccaggctgataaagcagccggagttcatgtcggcgaaaacaccgttaagtacacgttgatcaataagtgcagtgtcaatttttaggaggtaaaaggacacaactttgacgccgtcaatgtttgcttttactctttcttcttcttttcatttttcttctactcggataatgtttttgcttctatatcgtttaattttctacctttttctgctgatcatataacatacataaaatcaaaaaatttaatatgataaattcatgttaaaagaacttgccaaataaaaaccgatacagaattttcttgtaaacattcttcaatcttttttatttatttttttaactttaaatttccacttaaattaaaataaagaggattacaaggttaaaaaccccaacatggccgcaggcctaaaaaagaaagataaattcttcaaatttatatttacgtaaaccttcaaatttaataaattttaaaaaaccagacataattatgttgagagcatcagcaacggtaatttctcaacttccgtttctcaatatatgtgtaaacataaataaaagtgtgaacacaaatattattaatatttaattgaaaagtattttaattaaaccaatgattgaatgacaactgtgagaaacgttgtcgataagtttctcttggtttctctaaagagaaactttcccttacctctctcctcctttggacatttcttttcttattttattggtgagagattttatgagaaactcccgttggagttggtctgacacaggcggccctaggttctagaacggtataacgagaaaccaacgtacgacgagagaccaaaaagtaatattaacatatacgatcttacaaaaagtactcattattggaagtttggggcaacatcacaagcctacaattgcataatattctttggtcaattattcaatcaaatcaccgcgtaacgtgaccttaccttaatctaataagttgaccaacgcataaatgaaagtgtatataaagatgacttacataaacctcttagccatatatccattcattccaatataattctccacaaaattactatc

SEQ ID NO: 5014 - DNA, 1650 bp, Artificial Sequence
  P26496 (35S::G481(GENOMIC))
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgagtatgcattcccaatttttcttctttcaatcgaatttgttggaaaatattttgctctttggtgaaaaaaattgatcatttgttggaactttgggtttgtgagagatagttttcttaaactagctatggattgagtttagctcagagagttttttgaagtttatagagcaaagattatgtttttttttttgtcacaatgttaatcaaccattgtttggtatgggtttaccttaacctagttcctttcctatagaccattttgcagattatttcacatgcttctactgtgttatatcttaactctgtcaaataaattgttagatttttttcttcatttaaccatcttagggtataaaagccgtatcttgatcatgtttcaaagattcttttatctttaggatctgtttgtttttgttcctttttgttcatttaaggcaaaagatatgtttttcatcatgaaggaattgcttgtgttgaatgcgttttaggtctctgattgatgagttttatgtttcttataacatcagatgcccccgttctttgttaggaagaaataagttatcatgtatgaaactatgatttatctattggttcaagataagcttgtctgatgttgcgcttaagtctcttttgctggtcttatgttgattcgttgactgtaatggccaattgactggtatctgtttctgctaatcagggccagtgataagtgtcaaaaagagaaaaggaaaactgtgaatggtgatgatttgttgtgggcaatggcaacattaggatttgaggattacctggaacctctaaagatatacctagcgaggtacagggaggtatgttgctttgactccctaatcatgtgttctgaaatccttaatatcctagtcaagagattagtagctgtgagtaacatcgaagcttgccatgatagcagttttacaatcccttcaatacgtcttgtgtagaatttttgaagcaagaaagataaatctagaccaacagtcaggatgcatattagtaaattttgaaagacatttattactctctcttttgtgcttttgttgttaacatacataataaaatcaaaatgtttcttattaagttgagactaattcggttcttttcattccctgggattggttgctgacacaccacctgctgatgcagttggaggtaaataaaccacatacttatttctactttatattccattccagtgttgcccattggcttcttacgttttgttgtgaaattatgatagggtgataataagggatcaggaaagagtggagatggatcaaatagagatgctggtggcggtgtttctggtgaagaaatgccggtatgattttgacaagtatagatgataccaatgctatacagcctatattgtacttagctctgacttcatcattttgattcaatcacagagctggtaaaagaagttgcaagtagtg

SEQ ID NO: 5015 - DNA, 1627 bp, Artificial Sequence
  P26497 (35S::G28::GFP)
gtcgacccacgcgtccggaaatctcaacaagaaccaaaccaaacaacaaaaaaacattcttaataattatctttctgttatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttatgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 5016 - DNA, 1097 bp, Artificial Sequence
  P26498 (35S::G1792(-UTR))
ctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatctggtaccgtcgacggtgagctccgcggccgcatggagagctcaaacaggagcagcaacaaccaatcacaagatgacaagcaagctcgtttccggggagttcgaagaaggccttggggaaagtttgcagcagagattcgagacccgtcgagaaacggtgcccgtctttggctcgggacatttgagaccgctgaggaggcagcaagggcttatgaccgagcagcctttaaccttaggggtcatctcgctatactcaacttccctaatgagtattatccacgtatggacgactactcgcttcgccctccttatgcttcttcttcttcgtcgtcgtcatcgggttcaacttctactaatgtgagtcgacaaaaccaaagagaagttttcgagtttgagtatttggacgataaggttcttgaagaacttcttgattcagaagaaaggaagagataa

SEQ ID NO: 5017 - DNA, 795 bp, Artificial Sequence
  P26499 (35S::G3396::GAL4)
aaaaactaagcgatgtcggaggggttcgacgggacggagaacggcggcggcggcggcggaggcggagtagggaaggagcaggaccggttcctgccgatcgccaacatcggccgcatcatgcgccgggccgtgccggagaacggcaagatcgccaaggactccaaggagtccgtccaggagtgcgtctccgagttcatcagcttcatcaccagcgaagcaagcgacaagtgcctcaaggagaagcgcaagaccatcaatggggacgacctgatctggtcaatgggcacgctcggattcgaggactatgtcgagcctctcaagctctacctcaggctctaccgggagacggagggtgacacaaagggttcaagagcttctgaactgccagtaaagaaagatgttgtacttaatggagatcctggatcatcgtttgaaggcatgtgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 5018 - DNA, 892 bp, Artificial Sequence
  P26500 (35S::G3470::GAL4)
tcaccgggtttgtgagatgtcggatgcaccggcgagtccgagtcacgagagtggtggcgagcagagccctcgcggctcgttgtccggcgcggctagagagcaggaccggtaccttcccattgccaacatcagccgcatcatgaagaaggctctgcctcccaatggcaagattgcgaaggatgcaaaagacacaatgcaagaatgcgtttctgaattcatcagcttcattaccagcgaggcgagtgagaaatgccagaaggagaagagaaagacaatcaatggagacgatttactatgggccatggcaactttagggtttgaagactacattgagccgcttaaggtgtacctggctaggtacagagaggcggagggtgacactaaaggatctgctagaagtggtgatggatctgctagaccagatcaagttggccttgcaggtcaaaatgctcagcttgttcatcagggttcgctgaactatattggtttgcaggtgcaaccacaacatctggttatgccttcaatgcaaggccatgaatgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtag

SEQ ID NO: 5019 - DNA, 1484 bp, Artificial Sequence
  P26537 (35S::G28(-UTR))
ctgcaggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatggtccgattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcgcaagacccttcctctatataaggaagttcatttcatttggagaggacacgctgacaagctgactctagcagatctggtaccgtcgacggtgagctccgcggccgcatgtcgatgacggcggattctcaatctgattatgcttttcttgagtccatacgacgacacttactaggagaatcggagccgatactcagtgagtcgacagcgagttcggttactcaatcttgtgtaaccggtcagagcattaaaccggtgtacggacgaaaccctagctttagcaaactgtatccttgcttcaccgagagctggggagatttgccgttgaaagaaaacgattctgaggatatgttagtttacggtatcctcaacgacgcctttcacggcggttgggagccgtcttcttcgtcttccgacgaagatcgtagctctttcccgagtgttaagatcgagactccggagagtttcgcggcggtggattctgttccggtcaagaaggagaagacgagtcctgtttcggcggcggtgacggcggcgaagggaaagcattatagaggagtgagacaaaggccgtgggggaaatttgcggcggagattagagatccggcgaagaacggagctagggtttggttaggaacgtttgagacggcggaggacgcggcgttggcttacgacagagctgctttcaggatgcgtggttcccgcgctttgttgaattttccgttgagagttaattcaggagaacccgacccggttcgaatcaagtccaagagatcttctttttcttcttctaacgagaacggagctccgaagaagaggagaacggtggccgccggtggtggaatggataagggattgacggtgaagtgcgaggttgttgaagtggcacgtggcgatcgtttattggttttataa

SEQ ID NO: 5020 - DNA, 578 bp, Artificial Sequence
  P26548 (35S::G3866)
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5021 - DNA, 705 bp, Artificial Sequence
  P26576 (35S::G3841)
atggatcaacagttaccaccgacgaacttcccggtagattttccggtgtatcgccggaattcaagcttcagtcgtctaattccctgtttaactgaaaaatggggagatttaccactaaaagtcgatgattccgaagatatggtaatttacggtctattaaaagacgctctaagcgtcggatggtcgccgtttaatttcaccgccggcgaagtaaaatcggagccgagagaagaaattgaatcgtcgcttgaattttcaccttctccggcggagaccacggcagctccggcggctgaaacaccgaaaggaagacattatagaggcgttagacagcgtccgtgggggaaatttgcggcggagattagagatccggcgaagaacggagctagggtttggcttggaacgtacgaaacagctgaagaagctgcaattgcttatgataaagctgcttatagaatgagaggatcaaaagcacatttgaatttcccgcaccggatcggtttgaatgaaccggaaccggttcgagttacggcgaaaaggcgagcatcgccggaaccggcaagctcgtcgggaaacggttccatgaaacggagaagaaaagccgttcagaaatgtgatggagaaatggcgagtagatcaagtgtcatgcaagttgaatgtcaaattgaacaattgacaggtgtccatcaactattggtcatttaa

SEQ ID NO: 5022 - DNA, 1188 bp, Artificial Sequence
  P26579 (PRAT2G18690::G1795(-UTR))
gtttgaaaaccggtttatgtaactatcaagaaataatcaaaacaaaaaatccaaaaataaacttcaatgtgaattttgatttgggctatatatttcaaatttcagtctaaaatttattggcaacaatattattaaaaaaaaaaacctacattgttattacaatggggaaacttatttattaagcggtataaaaggttttatacataagtaacgaaaaagtagtaagtaaacgaccatgagttggtaattaatttgcaaaaatgatggatgatacgtaaaagtttaattatattatgttaaaaattttacttaccttaaaaacaaaagagatcagatttaaagaaaagagaggttagattaaaggaggaagttctacaagaaggagaactatggatatgttttggtcatggaagaaatagtttgctagatttgtaagtgctctgtttttctttttttcaatcatatttggattagaagttataatcatttagcaatttgcaacgtcctcaaagaatgtttgaagctctaattcttctatgttcggttaaatataaatatataatgacggtttggtatagcatatagtttgaccctactgtttatgactcattcatgatgacttgttcgcttgaggaaacaaattttttttttagatagatgtttcattatcttacacggtttcttgacattttcaacacgaatagaggaagtgaatgttgatcacgtacatttgatgaagaagtcaacttgcaatgttaaacatgttcctcttattttctttatataacatcttcatttatgacgcggtcaggaagtcatcatttttagacttttcatcgatgcattatgcttcgggttctttgttcttggatttgtctaagtcttggtttcttcctttgattttggatataatatgtagtaataataatatattgagggttccgtgtacttggactcaatcaaatggatgacaagaatctccgtaagcgaagctaccccgaaatacaagccaaagacttctttttccatagaaaaatagctggtcataatctaaaggtatagtagtttttgaatgtttggttagtagtatataagccctagacagataggtttgatcttataaaccctcgccaccattaccaaaaaccaataagccaagagcttttctcatttttcttcttgaaaccc

SEQ ID NO: 5023 - DNA, 689 bp, Artificial Sequence
  P26580 (PRAT3G22060::G1795(-UTR))
gatgtagaagacaatctcttgacaactttcctattttgtttggttttgttttcttaattttgttttatttttggttacaagtcaaaacttttttggtttgaaataatataatgtataaatcccttttaaattagtgaaaaccctcaaacaagaaaaagaacaaaaaaaaaaattgatttaatatatttgagcagttaaagggagaaaattatcatttagataaaatacatttaaaaaaaaagaatttatgtccacaccgtacatatcttagtttcactcagtcaaacctttgaatgttgactttttcattcaccgcaataccaagttcccctcaactcatggccctctactttacatttctaatttcatctagaagcttgaaatgaaagttggatcaaatgggacaaaaaattgttgttttgacataattgcttcatcttagccaatcagctaaattgacttcttttttgttcaaaggaactctcgtgattggaaaatgaccaaatcccaattgtacaaaaatgaaaacttcaacccattctaatatttattaaataaataaataacttgtctcaccacccaaagaccaaaatcatctagccactctataaaacatccttacctcaacacttcttctatcaaaaaaaaaaaagacaccctccacaaaatatcaattttcttccaaaaca

SEQ ID NO: 5024 - DNA, 1178 bp, Artificial Sequence
  P26582 (PRAT2G18660::G1795(-UTR))
tgtaaatttaaacttggacgatgatataacaacacaaatgacatatgcttaaaagttaaaatctcattttttatattttgaatctttgattgatgaattatagcgacaagccgacaaaggcaacttcctcggtaagggcaatcgttatcttaagtttaatttgatcaaatctctttctcagcgatagaaagtttaattggtatatagagatttgggcctttacataaaatgatatttgaaggcccactaagcccaattattttccagaatgttgaattcataaacgcagatttacttgacatgataacaaagagaaatttgtcttgattcaaaaaaataaaataaagaagagacatttgtctttctcttgtaaaagaggtcaataaagcaaatttgtttttcatacttcatcatttgactaattttattggtgttatgtaacaaaccgaatattggagatatcttagggagcaagtacgtgaagtccgaagaatattctagatttcactattaccttttgttcaagttatttttttatatgtttagaaaagttgaagaacaatctgactcggataccatgatagatttgggcttttaatatgagatttcaactaaaaatcaattggtaataggtggagtgaccctaacactttatatactatttgataatttttaatttttaatgtgggactttcttcattaacacattttgttttagtagatggtcctaacgttagaacctaacactcatcagaaggtttaaaagacggttatacttttcccgatggttttggatttgggtaaggttgagaattttctcaaggtaggattcgaagtgatgttgagaataccctccttagtttcttcgaaatttccttcgcagctttgtgaaaataatatccacaaagaaaaaaaaaatgaactttaaatttcaaaccctcgtggaattttccttcacacatcatcatatattcatattcattcaattcaccaagaaaatttaggtggagtaaggaataacaaattgtcctgtatgaaatcaatacaataagtaatggaagacttgacgtagaccaaagacttttccttttacttacagtctttgagtccaattatatataaatactcgcttccctttgcttcgttatttcacaaacaagttaaagaaaatgataaaa

SEQ ID NO: 5025 - DNA, 934 bp, Artificial Sequence
  P26587 (35S::G3866::GAL4)
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactgcggccgccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagtaagc

SEQ ID NO: 5026 - DNA, 277 bp, Artificial Sequence
  P26589 (35S::G3930)
cagtacatactaatggataacacaaaccgtcttcgccgccttcactgtcataaacaacccaagttcactcatagctctcaagaagtgagtagtatgaaatgggagtttatcaatatgaccgaacaagaagaagatctcatctttagaatgtacagacttgttggcgacaggtgggatttaatagcaagaagagtggtgggacgtgaggcaaaggagatagagagatactggattatgagaaattgtgactatttctcccacaaatgacgcaaaagtc

SEQ ID NO: 5027 - DNA, 768 bp, Artificial Sequence
  P26590 (35S::G3889)
aatccatggacaaccagccgctgccctactccacaggccagccccctgcccccggaggagccccggtggcgggcatgcctggcgcggccggcctcccacccgtgccgcaccaccacctgctccagcagcagcaggcccagctgcaggcgttctgggcgtaccagcgccaggaggcggagcgcgcgtccgcgtcggacttcaagaaccaccagctgcctctggcccggatcaagaagatcatgaaggccgacgaggacgtgcgcatgatctccgccgaggcgcccgtgctgttcgccaaggcctgcgagctcttcatcctcgagctcactatccgctcctggctccacgccgaggagaacaagcgccgcaccctgcagcgcaacgacgtcgccgcggccatcgcgcgcaccgacgtcttcgatttcctcgtcgacatcgtgccccgcgaggaggccaaggaggagcccggcagcgccctcggcttcgcggcgcctgggaccggcgtcgtcggggctggcgccccgggcggggcgccagccgccgggatgccctactactatccgccgatggggcagccggcgccgatgatgccggcctggcatgttccggcctgggacccggcctggcagcaaggggcagcggatgtcgatcagagcggcagcttcagcgaggaaggacaagggtttggagcaggccatggcggcgccgctagcttccctcctgcgcctccgacctccgagtgatcgatcggcgcgtctcttggtcctg

SEQ ID NO: 5028 - DNA, 627 bp, Artificial Sequence
  P26591 (35S::G3911)
acaaccctagctgcccccgaatccatggatcctaacaaatccagcaccccgccgccgcctccagtcatgggtgcccccgttgcctaccctccgcctgcgtaccctcccggtgtggccgccggcgccggcgcctacccgccgcagctctacgcaccgccggctgctgccgcggcccagcaggcggcggccgcgcagcagcagcagctgcagatattctgggcggagcagtaccgcgagatcgaggccactaccgacttcaagaatcacaacctcccgctcgcccgcatcaagaagatcatgaaagccgacgaggacgtccgcatgatcgccgccgaggctcccgtggtgttcgcccgggcctgcgagatgttcatcctcgagctcacccatcgcggctgggcgcacgccgaagagaacaagcgccgcacgctccagaaatccgacattgccgctgccatcgcccgcaccgaggtattcgacttccttgtggacatcgttccgcgcgacgacggtaaagacgctgatgcggcggccgccgcagctgccgcggctgccgggatcccgcgccccgccgccggagtaccagccaccgaccctctcgcctactactacgtgcctcagcagtaa

SEQ ID NO: 5029 - DNA, 1091 bp, Artificial Sequence; identical to SEQ ID NO: 2325
  P26593 (35S::G4264)

SEQ ID NO: 5030 - DNA, 778 bp, Artificial Sequence; identical to SEQ ID NO: 2025
  P26595 (35S::G3552)

SEQ ID NO: 5031 - DNA, 638 bp, Artificial Sequence
  P26596 (35S::G3909 )
tgaccgccgtaacaccctaggcaatggagcccaaatccaccacccctcccccgccccccgtgatgggcgcgcccatcgcgtatcctcccccgcccggcgccgcgtaccccgccgggccgtacgtgcacgcgccggcggccgcgctctaccctcctcctcccctgccgccggcgcccccctcctcgcagcagggcgccgcggcggcgcaccagcagcagctattctgggcggagcaataccgcgagatcgaggccaccaccgacttcaagaaccacaacctgccgctcgcccgcatcaagaagatcatgaaggccgacgaggacgtgcgcatgatcgccgccgaggcgcccgtcgtcttctcccgcgcctgcgagatgttcatcctcgagctcacccaccgcggctgggcacacgccgaggagaacaagcgccgcacgctgcagaagtccgacatcgccgccgccgtcgcgcgcaccgaggtcttcgacttcctcgtcgacatcgtgccgcgggacgaggccaaggacgccgactccgccgccatgggagcagccgggatcccgcaccccgccgccggcctgcccgccgccgatcccatgggctactactacgtccagccgccgcagtaacgaatttgc

SEQ ID NO: 5032 - DNA, 756 bp, Artificial Sequence; identical to SEQ ID NO: 2227
  P26597 (35S::G3925)

SEQ ID NO: 5033 - DNA, 762 bp, Artificial Sequence; identical to SEQ ID NO: 2005
  P26598 (35S::G3543)

SEQ ID NO: 5034 - DNA, 760 bp, Artificial Sequence
  P26599 (35S::G3544)
agaggacatggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggtcccaggtgcaggaatagcgtatggtggtcagcaaggtcatccggggtatctgtggcaggatcctcaggaacagcaggaagagcctcctgcagagcagcaaagtgattaa

SEQ ID NO: 5035 - DNA, 1000 bp, Artificial Sequence; identical to SEQ ID NO: 2229
  P26600 (35S::G3926)

SEQ ID NO: 5036 - DNA, 824 bp, Artificial Sequence
  P26602 (35S::G3924)
gcattccgaggtgagcgagcatggagtcgaggccggggggaaccaacctcgtggagccgagggggcagggcgcgctgccgtccggcataccgatccagcagccgtggtggacgacctccgccggggtcggggcggtgtcgcccgccgtcgtggcgccggggagcggtgcggggatcagcctgtcgggcagggatggcggcggcgacgacgcggcagaggagagcagcgatgactcacgaagatcaggggagaccaaagatggaagcactgatcaagaaaagcatcatgcaacatcgcagatgactgctttggcatcagactatttaacaccattttcacagctggaactaaaccaaccaattgcttcggcagcataccagtaccctgactcttactatatgggcatggttggtccctatggacctcaagctatgtccgcacagactcatttccagctacctggattaactcactctcgtatgccgttgcctcttgaaatatctgaggagcctgtttatgtaaatgctaagcaatatcatggaattttaagacggaggcagtcacgtgcgaaggctgaacttgagaaaaaagttgttaaatcaagaaagccctatcttcatgagtctcgtcatcaacatgctatgcgaagggcaagaggaacgggtggacgcttcctgaacacaaagaaaaatgaagatggtgctcccagtgagaaagccgaaccaaacaaaggagagcagaactccgggtatcgccggatccctcctgacttacagctcctacagaaggaaacatgaagtagcggctcgaaacctagaacagtg

SEQ ID NO: 5037 - DNA, 649 bp, Artificial Sequence
  P26603 (35S::G3546 )
gagaaaccctagcaatggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaacattttcctaccgtata

SEQ ID NO: 5038 - DNA, 798 bp, Artificial Sequence
  P26604 (35S::G3542 )
agctgacatggaaccatcctcacagcctcagcctgtgatgggtgttgccactggtgggtcacaagcatatcctcctcctgctgctgcatatccacctcaagccatggttcctggagctcctgctgttgttcctcctggctcacagccatcagcaccattccccactaatccagctcaactcagtgctcagcaccagctagtctaccaacaagcccagcaatttcatcagcagctgcagcaacagcaacagcagcaactccgtgagttctgggctaaccaaatggaagagattgagcaaacaaccgacttcaagaaccacagcttgccactcgcaaggataaagaagataatgaaggctgatgaggatgtccggatgatctcggcagaagcccccgttgtcttcgcaaaggcatgcgaggtattcatattagagttaacattgaggtcgtggatgcacacggaggagaacaagcgccggaccttgcagaagaatgacattgcagctgccatcaccaggactgatatctatgacttcttggtggacatagttcccagggatgaaatgaaagaagaagggcttgggcttccgagggttggcctaccgcctaatgtggggggcgcagcagacacatatccatattactacgtgccagcgcagcaggggcctggatcaggaatgatgtacggtggacagcaaggtcacccggtgacgtatgtgtggcagcagcctcaagagcaacaggaagaggcccctgaagagcagcactctctgccagaaagtagctaaagatgatacag

SEQ ID NO: 5039 - DNA, 847 bp, Artificial Sequence
  P26606 (35S::G3550)
agtaagtcatcatggataaatcagagcagactcaacagcagcagcagcaacaacagcatgtgatgggagttgccgcaggggctagccaaatggcctattcttctcactacccgactgcttccatggtggcttctggcacgcccgctgtaactgctccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccatagccttcctcttgctcggataaaaaagataatgaaagctgatgaagatgtccggatgatttcagcagaagctccggtcatatttgcaaaagcttgtgaaatgttcatattagagttgacgttgcgatcttggatccacacagaagagaacaagaggagaactctacaaaagaatgatatagcagctgctatttcgagaaacgatgtttttgatttcttggttgatattattccaagagatgagttgaaagaggaaggacttggaataaccaaggctactattccgttagtgggttctccagctgatatgccatattactatgtccctccacagcatcctgttgtaggaccacctgggatgatcatgggcaagcccattggcgctgagcaagcaacactatattctacacagcagcctcgacctcctgtggcgttcatgccatggcctcatacacaacccctgcaacagcagccaccccaacatcaacaaacagactcatgatgactatgcaattcaattag

SEQ ID NO: 5040 - DNA, 750 bp, Artificial Sequence; identical to SEQ ID NO: 2197
  P26607 (35S::G3886)

SEQ ID NO: 5041 - DNA, 956 bp, Artificial Sequence; identical to SEQ ID NO: 2221
  P26608 (35S::G3920)

SEQ ID NO: 5042 - DNA, 628 bp, Artificial Sequence
  P26609 (35S::G3875)
attagggttccggcgagcatggccgacggtccggcgagtccaggcggcggtagccacgagagcggcgagcacagccctcgctctaacgtgcgcgagcaggacaggtacctccccatcgctaacataagccgcatcatgaagaaggcactacctgcgaacggtaaaatcgccaaggacgccaaagagaccgttcaggaatgcgtatccgagttcatcagtttcatcaccagcgaggcctctgataagtgtcagagggaaaagagaaagactattaacggtgatgatttgctctgggccatggccactcttggttttgaggattatatcgatcctcttaaaatttacctcactagatacagagagatggagggtgatacgaagggttcagccaagggcggagactcatcttctaagaaagatgttcagccaagtcctaatgctcagcttgctcatcaaggttctttctcacaaggtgttagttacacaatttctcagtgaattctgggtgaatgaaacaaattcattgaagtatcttaagctacaagggtacctgatccttaaattggtcaacatatgatggttccaatgcaaggcccggagtaggtatcaagtttattaaccctcctgt

SEQ ID NO: 5043 - DNA, 786 bp, Artificial Sequence
  P26610 (35S::G3548 )
aacatcaggggatgggcgttgccacaggtgctagccaaatggcctattcttctcactacccgactgctcccatggtggcttctggcacgcctgctgtagctgttccttccccaactcaggctccagctgccttctctagttctgctcaccagcttgcataccagcaagcacagcatttccaccaccaacagcagcaacaccaacaacagcagcttcaaatgttctggtcaaaccaaatgcaagaaattgagcaaacaattgactttaaaaaccacagtcttcctcttgctcggataaaaaagataatgaaagctgatgaagatgtccggatgatttctgcagaagctccagtcatatttgcaaaagcatgtgaaatgttcatattagagttgacgttgagatcttggatccacacagaagagaacaagaggagaactctacaaaagaatgatatagcagctgctatttcgagaaacgatgtttttgatttcttggttgatattatcccaagagatgagttgaaagaggaaggacttggaataaccaaggctactattccattggtgaattctccagctgatatgccatattactatgtccctccacagcatcctgttgtaggacctcctgggatgatcatgggcaagcccgttggtgctgagcaagcaacgctgtattctacacagcagcctcgacctcccatggcgttcatgccatggccccatacacaaccccagcaacagcagccaccccaacatcaacaaacagactcatgatgaccatgca

SEQ ID NO: 5044 - DNA, 799 bp, Artificial Sequence
  P26611 (35S::G3894)
gctcaaaatggatcaacatggaaatggacagcctccaggtattggagtcgttactagctcagctccaatatatggtgctccataccaagctaaccaaatggcagggccctctcctcctgcagtttcagctggtgcaattcaatctcctcaagcagctggtcttgctgcttcgtcagctcagatggcgcaacatcagctcgcttatcagcacattcatcagcagcagcaacaacagttgcagcaacaactccagactttctgggcaaatcaatatcaagaaatcgagcatgttactgatttcaagaatcatagcttgccattggcaaggatcaagaaaatcatgaaagcggatgaagatgttaggatgatatctgctgaagcaccagtcgtatttgctcgtgcctgtgagatgttcatacttgaattgacactgcgtgcatggaaccacactgaggagaacaaaaggaggacgctgcagaaaaatgatatcgctgcagccataacaaggactgacatatttgatttcttagttgacattgtcccaagagaggacttgaaagatgaggtgcttgcaacaattcctagaggaacgcttcctgttggaggcccaactgagggtctgccattctattatggcatgccaccacaatctgctcaaccgattggagctccagggatgtacatgggaaagcctgtcgatcaagctctgtatgcccagcagccccgcccatatatggcacagccaatttggccccagcagcagcaaccaccctcagattcttaagcagctcaaagctta

SEQ ID NO: 5045 - DNA, 458 bp, Artificial Sequence
  P26612 (35S::G3969)
ctctcgagaatatgaataccaacgagtccgaacatgttagcacaagcccagaggatactcaggagaacggtggaaacgctagctccagcggcagtttgcagcaaatttccacgctaagagagcaggacagatggctacccatcaacaatgtagcgcgactcatgaagaatactctcccaccgagtgctaaggtatcgaaagatgcgaaagagtgcatgcaggagtgtgtcagtgagctcatttcttttgtgactagcgaggccagcgatcgatgcgctgctgacaaaagaaagacgataaacggggaagacattctcatatcattgcacgccttaggattcgagaactatgcagaggtgttgaaaatctacttggctaaatacaggcaacaacaggcgctgaagaatcaactaatgtatgagcaggacgacgaagaggtgccttgagaagacaaaacc

SEQ ID NO: 5046 - DNA, 1207 bp, Artificial Sequence
  P26707 (PRAT5G62150::G1795(-UTR))
tggtatatgcacgacaggacaaccgatacaatgacagttggttccaaaaaaaaagtttaatcctaaatatatgaataatcgaatcgatcaataacacgttgacaaaaaacgaacaaataatcacactgatgaaccactttataatgaacagagaattttgtaatctgaaaattttgaaagtcaagaggttaatcaagtaattatagaaaggtagttgtaacgttggcttttgtggaactaataacttacgtgtctttaaacggcggctactttggaaggctacgtttcttaatttgaacctcattttctccattttccttcgtttatacgatatctttttcaaaaaagtgacccaataaccacacatataacatatttagtataactttgaatataaacgaatcaatgatatctgaattttattttgattttgatcttgatttttgttgttttttgtcgaggctattgccttgccactttggatgaaggaacccggctaaggtaagaccccctgcctaatattagcctccggcgaattttgcactcagaaattacattatgttatagttttggaattttagtttaaatttgtaaaagtattaaaacaattggtcaactattatattaattagctcaagagtgctttcaaaaacatatcttaaatttaataaagaaatattccaatatcttaaccagtactaaaagagaagatcagaaaatttcttataaaactttaatctaataaaatcatctacgactctaccattcaatatttttttgttattgttttatttacatatttcttttaatatttacatatctcttttcctttttgctaaaaaaaagttggcataaaaattactaaattttaagcgtaaaaaaataaaattaattattgtctattgccatttttggaggatggatatgatttggaggaatagttaaagaaagtgctaaaatctcctttagtgagtcacaaccgttgaccttcaccgcaaggcacaagagaccaagtctctaacccaacacaacacaaaacccataaactgaaaagactaacctaccctatcttgccatataaatccctctcgagcaacgcatgttaaataaacctaatttatacattcattctcaaagtcaaaaggagacagggagagagagagagagagagagaattcaaagcgttttttttttataaattaaaggc

SEQ ID NO: 5047 - DNA, 1216 bp, Artificial Sequence
  P26708 (PRAT5G24090::G1795(-UTR))
aaatggtccagttttggcccaaatatttaacaacatttgggttacgagtatttgccctttacaaatggatcaacaatctccctggatcaatatttagtggccggtttcatgaatcaacatattctttttttttttttgtctaaagaatcaacatattctaaatcaccaaaacactttggtcaacaattttcgacaatatatggaaattaggttggattatcatgcgacttttttctgattaattttatgtatttttaatttacgatgtaattcggactactaatttgtattatgataactttacattttccatactactcaagtccaagtaaaatactattgtatatatatctttggattttacataaattaatggggaggcctaataaaatatactcggagtatatcatttgactttgaaatttatcgagtcaaatcaatgattgtatttttggtaaaaacaattattatgaagactttgaaagtttttaatgattttaatttcaaaaattagtaaatgctggtctggttatccatccattggaagagaaaataagaccttttcaaagctagttgataaaaaaagttctcggtcctatccctcatcttataaagaaattattaatacgtttagggattcaattcacagaagatttaaaaacaaatggaaaataggatattaccataataattatggttcaacaacaatttcgatttctaatttgaataatggaaatttagatcaaaaatagttccgactcatagataaattgaaatgtgccaaatgtcacgtaaaccagcaagaggacaaagtcaacaccacaagagacgacgacgagcacagtgtgaggttatgatatataccctctgcgagactgcgactgctattactgatttgatcccaagttttttttttttttttgaaatttattttttctttatacacaattacatagtggtaagagattctagatggcttcttaatgtttgagatttatatctagtttaagtaggaaagctatattatttgaagaaagaaaaaaacaaccaatcaaagtcatgcaatgtgtgtgagagacattataacatacatagataagatataaaaattaaagcaaacaaaagtcatattttacttcttttataaaaaaagaagttaagcaataacaaacaaacacataaccacaaagaagacaaaacatctttaaccaaaaac

SEQ ID NO: 5048 - DNA, 736 bp, Artificial Sequence; identical to SEQ ID NO: 1937
  P26738 (35S::G3479)

SEQ ID NO: 5049 - DNA, 745 bp, Artificial Sequence; identical to SEQ ID NO: 1947
  P26744 (35S::G3484)

SEQ ID NO: 5050 - DNA, 752 bp, Artificial Sequence
  P26748 (35S::G4004)
atgaagcccaagacttgcgagctttgtcatcaactagcttctctctattgtccctccgattccgcatttctctgcttccactgcgacgccgccgtccacgccgccaacttcctcgtagctcgccacctccgccgcctcctctgctccaaatgcaaccgtttcgccgcaattcacatctccggtgctatatcccgccacctctcctccacctgcacctcttgctccctggagattccttccgccgactccgattctctcccttcctcttctacctgcgtctccagttccgagtcttgctctacgaatcagattaaggcggagaagaagaggaggaggaggaggaggagtttctcgagttcctccgtgaccgacgacgcatctccggcggcgaagaagcggcggagaaatggcggatcggtggcggaggtgtttgagaaatggagcagagagatagggttagggttaggggtgaacggaaatcgcgtggcgtcgaacgctctgagtgtgtgcctcggaaagtggaggtcgcttccgttcagggtggctgctgcgacgtcgttttggttggggctgagattttgtggggacagaggcctcgccacgtgtcagaatctggcgaggttggaggcaatatctggagtgccagcaaagctgattctgggcgcacatgccaacctcgcacgtgtcttcacgcaccgccgcgaattgcaggaaggatggggcgagtcctagctgatgatagctataccaat

SEQ ID NO: 5051 - DNA, 756 bp, Artificial Sequence; identical to SEQ ID NO: 2253
  P26749 (35S::G4005)

SEQ ID NO: 5052 - DNA, 687 bp, Artificial Sequence; identical to SEQ ID NO: 2245
  P26799 (35S::G3980)

SEQ ID NO: 5053 - DNA, 821 bp, Artificial Sequence; identical to SEQ ID NO: 691
  P26801 (35S::G926)

SEQ ID NO: 5054 - DNA, 734 bp, Artificial Sequence; identical to SEQ ID NO: 1201
  P26819 (35S::G1821)

SEQ ID NO: 5055 - DNA, 719 bp, Artificial Sequence; identical to SEQ ID NO: 2191
  P26821 (35S::G3883)

SEQ ID NO: 5056 - DNA, 912 bp, Artificial Sequence; identical to SEQ ID NO: 1613
  P26883 (35S::G2632(-UTR))

SEQ ID NO: 5057 - DNA, 217 bp, Artificial Sequence
  P26885 (35S::MIR169E)
tgatgatgatgatgagtcactaattaattgtatcatagagtcttgcatggaaaaatagaaaatgagattgagccaaggatgacttgccgattttctcaacgaatcttactgattatggtatccggcaagttgactttggctctgtttccttcccttcttttcgatgtcaaactctagatacctaaccacatatcatatatatcatcatcattcatca

SEQ ID NO: 5058 - DNA, 167 bp, Artificial Sequence
  Artificial sequence
  P26886 (35S::MIR169F)
gggtcttgcatgaaggaataacgaatggaattgagccaaggatgacttgccggtttaaacccaaccggtttatgaccattgatttggtctcattcacaatctgttgattcgtgtctggcaagttgaccttggctctgcttcgttctctattcttccatgttagattc

SEQ ID NO: 5059 - DNA, 379 bp, Artificial Sequence
  P26887 (35S::MIR169G)
tgcctataaataccttcatcacgagtatgacaagatcacaagacaagaaaagaaaggtagagaaaacatgataatgatgattacgatgatgagagtctctagttgtatcagagggtcttgcatggaagaatagagaatgaggttgagccaaggatgacttgccgggtttttttaccaatgaatctaattaactgattctggtgtccggcaagttgaccttggctctgtttccttctcttcttttggatgtcagactccaagatatctatcatcatgaatcgtgatcaaactttgtaatttcattgaaatgtgtttttcttgatgcgaattttttggcttacggtttttcgatttgaatgatcagatttttgtttttgca

SEQ ID NO: 5060 - DNA, 578 bp, Artificial Sequence
  P26888 (35S::G3866(I97L))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccctcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5061 - DNA, 578 bp, Artificial Sequence
  P26889 (35S::G3866(G110L))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctgctgtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5062 - DNA, 578 bp, Artificial Sequence
  P26890 (35S::G3866(P50L, A51L))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcctgcttaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatctgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5063 - DNA, 426 bp, Artificial Sequence
  P26891 (35S::G481(-UTR))
atggcggatacgccttcgagcccagctggagatggcggagaaagcggcggttccgttagggagcaggatcgataccttcctatagctaatatcagcaggatcatgaagaaagcgttgcctcctaatggtaagattggaaaagatgctaaggatacagttcaggaatgcgtctctgagttcatcagcttcatcactagcgaggccagtgataagtgtcaaaaagagaaaaggaaaactgtgaatggtgatgatttgttgtgggcaatggcaacattaggatttgaggattacctggaacctctaaagatatacctagcgaggtacagggagttggagggtgataataagggatcaggaaagagtggagatggatcaaatagagatgctggtggcggtgtttctggtgaagaaatgccgagctggtaa

SEQ ID NO: 5064 - DNA, 528 bp, Artificial Sequence
  P26921 (35S::G3434(G91L))
aagggttgcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttactattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctag

SEQ ID NO: 5065 - DNA, 528 bp, Artificial Sequence
  P26922 (35S::G3434(A36L, V37I))
aagggttgcggcggaggcgcccggtcgctggcgatggccgacgacggcgggagccacgagggcagcggcggcggcggaggcgtccgggagcaggaccggttcctgcccatcgccaacatcagccggatcatgaagaagctcatcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaaccaagggatgggctatatgcagccacagtaccacaatggggaaacctag

SEQ ID NO: 5066 - DNA, 208 bp, Artificial Sequence; identical to SEQ ID NO: 4975
  P27030 (PR4XW2BOX::M35S::G1792(-UTR))

SEQ ID NO: 5067 - DNA, 188 bp, Artificial Sequence; identical to SEQ ID NO: 4980
  P27035 (PR4XJEREBOX::M35S::G1792(-UTR))

SEQ ID NO: 5068 - DNA, 187 bp, Artificial Sequence; identical to SEQ ID NO: 4981
  P27036 (PR4XSBOX::M35S::G1792(-UTR))

SEQ ID NO: 5069 - DNA, 987 bp, Artificial Sequence; identical to SEQ ID NO: 2267
  P27042 (35S::G4220)

SEQ ID NO: 5070 - DNA, 845 bp, Artificial Sequence; identical to SEQ ID NO: 2269
  P27043 (35S::G4221)

SEQ ID NO: 5071 - DNA, 983 bp, Artificial Sequence; identical to SEQ ID NO: 2271
  P27044 (35S::G4222)

SEQ ID NO: 5072 - DNA, 1209 bp, Artificial Sequence; identical to SEQ ID NO: 2273
  P27045 (35S::G4223)

SEQ ID NO: 5073 - DNA, 1008 bp, Artificial Sequence; identical to SEQ ID NO: 2293
  P27047 (35S::G4234)

SEQ ID NO: 5074 - DNA, 1105 bp, Artificial Sequence; identical to SEQ ID NO: 2283
  P27048 (35S::G4228)

SEQ ID NO: 5075 - DNA, 915 bp, Artificial Sequence
  P27049 (35S::G4229)
tactaaagaaccagtttctgagtaaaacatggcggcgtcgccttccccgtccggcagcggcggcggcaaggccggcgtggaccggatcaagggcccctggagccccgaggaggacgaggccctgcagcgcctcgtgcgccgccacggcgcgcgcaactggtccctcatcagccgctccgtcccgggccggtccggcaagtcgtgccgcctccggtggtgcaaccagctgtcgccgcgggtggagcaccgccccttcacgcccgacgaggacgacgccatcctccgcgcgcacgccaggttcggcaacaagtgggccaccatcgcgcgcctcctctccggacgcacggacaacgccatcaagaaccactggaactccacgctcaagcgcgagcgcgagcgcaagcgcgagtactacgccgatgcgcgccccggccccggcgaccagcgctcgctcaagcgcaccagcagcgacgggccccccggaagcccgtccgggtccgacctcagcgactccagccaccagagccttcccaccgtgatgccgtcagccgcttctaccgccgtcacctcccagcagcagctacaacacgtgtactaccgccccgtgccgcgcgcgggcggcgtggtcctgctcccggtggcgccgccttctccgcaggctcctccagcaacctccttgtcgttgtccctctccctgccagggctggaccagcagcccgaaccatccccgccgccgccgccaacacctcaagcacaagcaagctcgccgttgagcgcggagttcctgttgatgatgcaggagatgatccggatcgaggtccggaactacatgtccgggtcgggcttcgacgcacacgccgtgatgggcatggccgagatcgactagtttcagcggcaggggtccaagaccaagac

SEQ ID NO: 5076 - DNA, 328 bp, Artificial Sequence
  P27085 (PR4XW2BOX::4XSBOX::M35S::G1792(-UTR))
ttattcagccatcaaagttgaccaataattctagtttattcagccatcaaagttgaccaataattctagtttattcagccatcaaagttgaccaataattctagtttattcagccatcaaagttgaccaataattctagtcagccaccaaagaggacccagaattctagtcagccaccaaagaggacccagaattctagtcagccaccaaagaggacccagaattctagtcagccaccaaagaggacccagaattctagagcggcccgcaagacccttcctctatataaggaagttcatttcatttggagaggacacgctgcggccgc

SEQ ID NO: 5077 - DNA, 342 bp, Artificial Sequence
  P27086 (PR4XW2BOX::2XSBOX::2XDBOX::M35S::G1792(-UTR))
ttattcagccatcaaagttgaccaataattctagtttattcagccatcaaagttgaccaataattctagtttattcagccatcaaagttgaccaataattctagtttattcagccatcaaagttgaccaataattctagtcagccaccaaagaggacccagaattctagtcagccaccaaagaggacccagaattctagttacaattcaaacattgttcaaacaaggaacctctagttacaattcaaacattgttcaaacaaggaacctctagagcggcccgcaagacccttcctctatataaggaagttcatttcatttggagaggacacgctgcggccgc

SEQ ID NO: 5078 - DNA, 202 bp, Artificial Sequence
  P27087 (PR2XSBOX::2XDBOX::M35S::G1792(-UTR))
cagccaccaaagaggacccagaattctagtcagccaccaaagaggacccagaattctagttacaattcaaacattgttcaaacaaggaacctctagttacaattcaaacattgttcaaacaaggaacctctagagcggcccgcaagacccttcctctatataaggaagttcatttcatttggagaggacacgctgcggccgc

SEQ ID NO: 5079 - DNA, 1194 bp, Artificial Sequence; identical to SEQ ID NO: 4991
  P27199 (PRAT4G21390::G1792(-UTR))

SEQ ID NO: 5080 - DNA, 1165 bp, Artificial Sequence; identical to SEQ ID NO: 5005
  P27201 (PRAT1G57630::G1792(-UTR))

SEQ ID NO: 5081 - DNA, 578 bp, Artificial Sequence
  P27228 (35S::G3866(L102A))
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatgcgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactaa

SEQ ID NO: 5082 - DNA, 1319 bp, Artificial Sequence
  P27229 (35S::G3866(L102A)::GFP)
tataagtgcaggaggagctcatggcggaagctccggcgagccctggcggcggcggcgggagccacgagagcgggagccccaggggaggcggaggcggtggcagcgtcagggagcaggacaggttcctgcccatcgccaacatcagtcgcatcatgaagaaggccatcccggctaacgggaagaccatcccggctaacgggaagatcgccaaggacgctaaggagaccgtgcaggagtgcgtctccgagttcatctccttcatcactagcgaagcgagtgacaagtgccagagggagaagcggaagaccatcaatggcgacgatgcgctgtgggccatggccacgctggggtttgaagactacattgaacccctcaaggtgtacctgcagaagtacagagagatggagggtgatagcaagttaactgcaaaatctagcgatggctcaattaaaaaggatgcccttggtcatgtgggagcaagtagctcagctgcacaagggatgggccaacagggagcatacaaccaaggaatgggttatatgcaaccccagtaccataacggggatatctcaaactgcggccgcatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctag

SEQ ID NO: 5083 - DNA, 709 bp, Artificial Sequence; identical to SEQ ID NO: 2249
  P27404 (35S::G4000)

SEQ ID NO: 5084 - DNA, 741 bp, Artificial Sequence
  P27405 (35S::G4011)
gatgggtggcgaggcggagcggtgcgcgctctgtggcgcggcggcggcggtgcactgcgaggcggacgcggcgttcctgtgcgcggcgtgcgacgccaaggtgcacggggcgaacttcctcgcgtcgcggcaccaccggaggcgggtggcggccggggcggtggtggtggtggaggtggaggaggaggaggggtatgagtccggggcgtcggcggcgtcgagcacgtcgtgcgtgtcgacggccgactccgacgtggcggcgtcggcggcggcgaggcgggggaggaggaggaggccgagggcagcggcgcggccccgcgcggaggtggttctcgaggggtggggcaagcggatgggcctcgcggcgggggcggcgcggcggcgcgccgcggcggccgggcgcgcgctccgggcgtgcggcggggacgtcgccgccgcgcgcgtcccgctccgcgtcgccatggcggccgcgctgtggtgggaggtggcggcccaccgcgtctccggcgtctccggcgccggccatgccgacgcgctgcggcggctggaggcgtgcgcgcacgtgccggcgaggctgctcacggcggtggcgtcgtcgatggcccgcgcgcgcgcaaggcggcgcgccgccgcggacaacgaggagggctgggacgagtgctcgtgttctgaagcgcccaacgccttgggtggcccacatgtcagtgacacagctcgtcagaaatgatacttatgcagagg

SEQ ID NO: 5085 - DNA, 676 bp, Artificial Sequence
  P27406 (35S::G4012)
tgtaatggaggtcggcaacggcaagtgcggcggtggtggcgccgggtgcgagctgtgcgggggcgtggccgcggtgcactgcgccgctgactccgcgtttctttgcttggtatgtgacgacaaggtgcacggcgccaacttcctcgcgtccaggcaccgccgccgccggttgggggttgaggtggtggatgaggaggatgacgcccggtccacggcgtcgagctcgtgcgtgtcgacggcggactccgcgtcgtccacggcggcggcggcggcggcggtggagagcgaggacgtcaggaggagggggcggcgcgggcggcgtgccccgcgcgcggaggcggttctggaggggtgggcgaagcggatggggttgtcgtcgggcgcggcgcgcaggcgcgccgccgcggccggggcggcgctccgcgcggtgggccgtggcgtcgccgcctcccgcgtcccgatccgcgtcgcgatggccgccgcgctctggtcggaggtcgcctcctcctcctcccgtcgccgccgccgccccggcgccggacaggccgcgctgctccggcggctggaggccagcgcgcacgtgccggcgaggctgctcctgacggtggcgtcgtggatggcgcgcgcgtcgacgccgcccgccgccgaggagggctgggccgagtgctcctgatcc

SEQ ID NO: 5086 - DNA, 787 bp, Artificial Sequence
  P27428 (35S::G4299)
aatggaacttctgtcctctaaactctgtgagctttgcaatgatcaagctgctctgttttgtccatctgattcagcttttctctgttttcactgtgatgctaaagttcatcaggctaatttccttgttgctcgccaccttcgtcttactctttgctctcactgtaactcccttacgaaaaaacgtttttccccttgttcaccgccgcctcctgctctttgtccttcctgttcccggaattcgtctggtgattccgatctccgttctgtttcaacgacgtcgtcgtcgtcttcgtcgacttgtgtttccagcacgcagtccagtgctattactcaaaaaattaacataatctcttcaaatcgaaagcaatttccggacagcgactctaacggtgaagtcaattctggcagatgtaatttagtacgatccagaagtgtgaaattgcgagatccaagagcggcgacttgtgtgttcatgcattggtgcacaaagcttcaaatgaaccgcgaggaacgtgtggtgcaaacggcttgtagtgtgttgggtatttgttttagtcggtttaggggtctgcctctacgggttgccctggcggcctgtttttggtttggtttgaaaactaccgaagacaaatcaaagacgtcgcaatctttgaagaaattagaggagatctcgggtgtgccggcgaagataatattagcaacagaattaaagcttcgaaaaataatgaaaaccaaccacggccaacctcaagcaatggaagaaagctgggctgaatcctcgccctaa

SEQ ID NO: 5087 - DNA, 1009 bp, Artificial Sequence
  P5284 LEAF-SPECIFIC RBCS3 PROM. DRIVER CONSTRUCT
aaatggagtaatatggataatcaacgcaactatatagagaaaaaataatagcgctaccatatacgaaaaatagtaaaaaattataataatgattcagaataaattattaataactaaaaagcgtaaagaaataaattagagaataagtgatacaaaattggatgttaatggatacttcttataattgcttaaaaggaatacaagatgggaaataatgtgttattattattgatgtataaagaatttgtacaatttttgtatcaataaagttccaaaaataatctttaaaaaataaaagtacccttttatgaactttttatcaaataaatgaaatccaatattagcaaaacattgatattattactaaatatttgttaaattaaaaaatatgtcattttattttttaacagatattttttaaagtaaatgttataaattacgaaaaagggattaatgagtatcaaaacagcctaaatgggaggagacaataacagaaatttgctgtagtaaggtggcttaagtcatcatttaatttgatattataaaaattctaattagtttatagtctttcttttcctcttttgtttgtcttgtatgctaaaaaaggtatattatatctataaattatgtagcataatgaccacatctggcatcatctttacacaattcacctaaatatctcaagcgaagttttgccaaaactgaagaaaagatttgaacaacctatcaagtaacaaaaatcccaaacaatatagtcatctatattaaatcttttcaattgaagaaattgtcaaagacacatacctctatgagttttttcatcaatttttttttcttttttaaactgtatttttaaaaaaatattgaataaaacatgtcctattcattagtttgggaactttaagataaggagtgtgtaatttcagaggctattaattttgaaatgtcaagagccacataatccaatggttatggttgctcttagatgaggttattgctttaggtgaaa

SEQ ID NO: 5088 - DNA, 1183 bp, Artificial Sequence
  P5287 EPIDERMAL AND VASCULAR-SPECIFIC LTP1 PROM. DRIVER CONSTRUCT
gatatgaccaaaatgattaacttgcattacagttgggaagtatcaagtaaacaacattttgtttttgtttgatatcgggaatctcaaaaccaaagtccacactagtttttggactatataatgataaaagtcagatatctactaatactagttgatcagtatattcgaaaacatgactttccaaatgtaagttatttactttttttttgctattataattaagatcaataaaaatgtctaagttttaaatctttatcattatatccaaacaatcataatcttattgttaatctctcatcaacacacagtttttaaaataaattaattaccctttgcatgataccgaagagaaacgaattcgttcaaataattttataacaggaaataaaatagataaccgaaataaacgatagaatgatttcttagtactaactcttaacaacagttttatttaaatgacttttgtaaaaaaaacaaagttaacttatacacgtacacgtgtcgaaaatattattgacaatggatagcatgattcttattagagtcatgtaaaagataaacacatgcaaatatatatatgaataatatgttgttaagataaactagacgattagaatatatagcacatctatagtttgtaaaataactatttctcaactagacttaagtcttcgaaatacataaataaacaaaactataaaaattcagaaaaaaacatgagagtacgttagtaaaatgtatttttttggtaaaataatcacttttcatcaggtcttttgtaaagcagttttcatgttagataaacgagattttaattttttttaaaaaaagaagtaaactaactatgttcctatctacacacctataattttgaacaattacaaaacaacaatgaaatgcaaagaagacgtagggcactgtcacactacaatacgattaataaatgtattttggtcgaattaataactttccatacgataaagttgaattaacatgtcaaacaaaagagatgagtggtcctatacatagttaggaattaggaacctctaaattaaatgagtacaaccaccaactactccttccctctataatctatcgcattcacaccacataacatatacgtacctactctatataacactcactccccaaactctcttcatcatccatcactacacacatc

SEQ ID NO: 5089 - DNA, 1176 bp, Artificial Sequence
  P5288 EPIDERMAL-SPECIFIC CUT1 PROM. DRIVER CONSTRUCT
tgtgaattatattttactcttcgatatcggttgttgacgattaaccatgcaaaaaagaaacattaattgcgaatgtaaataacaaaacatgtaactcttgtagatatacatgtatcgacatttaaacccgaatatatatgtatacctataatttctctgattttcacgctacctgccacgtacatgggtgataggtccaaactcacaagtaaaagtttacgtacagtgaattcgtctttttgggtataaacgtacatttaatttacacgtaagaaaggattaccaattctttcatttatggtaccagacagagttaaggcaaacaagagaaacatatagagttttgatatgttttcttggataaatattaaattgatgcaatatttagggatggacacaaggtaatatatgccttttaaggtatatgtgctatatgaatcgtttcgcatgggtactaaaattatttgtccttactttatataaacaaattccaacaaaatcaagtttttgctaaaactagtttatttgcgggttatttaattacctatcatattacttgtaatatcattcgtatgttaacgggtaaaccaaaccaaaccggatattgaactattaaaaatcttgtaaatttgacacaaactaatgaatatctaaattatgttactgctatgataacgaccatttttgtttttgagaaccataatataaattacaggtacgtgacaagtactaagtatttatatccacctttagtcacagtaccaatattgcgcctaccgggcaacgtgaacgtgatcatcaaatcaaagtagttaccaaacgctttgatctcgataaaactaaaagctgacacgtcttgctgtttcttaatttatttctcttacaacgacaattttgagaaatatgaaatttttatatcgaaagggaacagtccttatcatttgctcccatcacttgcttttgtctagttacaactggaaatcgaagagaagtattacaaaaacatttttctcgtcatttataaaaaaatgacaaaaaattaaatagagagcaaagcaagagcgttgggtgacgttggtctcttcattaactcctctcatctaccccttcctctgttcgcctttatatccttcaccttccctctctcatcttcattaactcatcttcaaaaatacc

SEQ ID NO: 5090 - DNA, 2244 bp, Artificial Sequence
  P5290 VASCULAR-SPECIFIC SUC2 PROM. DRIVER CONSTRUCT
aactaggggtgcataatgatggaacaaagcacaaatcttttaacgcaaactaactacaaccttcttttggggtccccatccccgaccctaatgttttggaattaataaaactacaatcacttaccaaaaaataaaagttcaaggccactataatttctcatatgaacctacatttataaataaaatctggtttcatattaatttcacacaccaagttactttctattattaactgttataatggaccatgaaatcatttgcatatgaactgcaatgatacataatccactttgttttgtgggagacatttaccagatttcggtaaattggtattcccccttttatgtgattggtcattgatcattgttagtggccagacatttgaactcccgtttttttgtctataagaattcggaaacatatagtatcctttgaaaacggagaaacaaataacaatgtggacaaactagatataatttcaacacaagactatgggaatgattttacccactaattataatccgatcacaaggtttcaacgaactagttttccagatatcaaccaaatttactttggaattaaactaacttaaaactaattggttgttcgtaaatggtgctttttttttttgcggatgttagtaaagggttttatgtattttatattattagttatctgttttcagtgttatgttgtctcatccataaagtttatatgttttttctttgctctataacttatatatatatatgagtttacagttatatttatacatttcagatacttgatcggcattttttttggtaaaaaatatatgcatgaaaaactcaagtgtttcttttttaaggaatttttaaatggtgattatatgaatataatcatatgtatatccgtatatatatgtagccagatagttaattatttgggggatatttgaattattaatgttataatattctttcttttgactcgtctggttaaattaaagaacaaaaaaaacacatacttttactgttttaaaaggttaaattaacataatttattgattacaagtgtcaagtccatgacattgcatgtaggttcgagacttcagagataacggaagagatcgataattgtgatcgtaacatccagatatgtatgtttaattttcatttagatgtggatcagagaagataagtcaaactgtcttcataatttaagacaacctcttttaatattttcccaaaacatgttttatgtaactactttgcttatgtgattgcctgaggatactattattctctgtctttattctcttcacaccacatttaaatagtttaagagcatagaaattaattattttcaaaaaggtgattatatgcatgcaaaatagcacaccatttatgtttatattttcaaattatttaatacatttcaatatttcataagtgtgattttttttttttttgtcaatttcataagtgtgatttgtcatttgtattaaacaattgtatcgcgcagtacaaataaacagtgggagaggtgaaaatgcagttataaaactgtccaataatttactaacacatttaaatatctaaaaagagtgtttcaaaaaaaattcttttgaaataagaaaagtgatagatatttttacgctttcgtctgaaaataaaacaataatagtttattagaaaaatgttatcaccgaaaattattctagtgccactcgctcggatcgaaattcgaaagttatattctttctctttacctaatataaaaatcacaagaaaaatcaatccgaatatatctatcaacatagtatatgcccttacatattgtttctgacttttctctatccgaatttctcgcttcatggtttttttttaacatattctcatttaattttcattactattatataactaaaagatggaaataaaataaagtgtctttgagaatcgaacgtccatatcagtaagatagtttgtgtgaaggtaaaatctaaaagatttaagttccaaaaacagaaaataatatattacgctaaaaaagaagaaaataattaaatacaaaacagaaaaaaataatatacgacagacacgtgtcacgaagataccctacgctatagacacagctctgttttctcttttctatgcctcaaggctctcttaacttcactgtctcctcttcggataatcctatccttctcttcctataaatacctctccactcttcctcttcctccaccactacaaccacca

SEQ ID NO: 5091 - DNA, 1326 bp, Artificial Sequence
  P5297 FRUIT-SPECIFIC POLYGALACTURONASE (PG prom. HIGH EXPRESSION) PROM. DRIVER CONSTRUCT
accaatgcgctatatattaatcaacttgataatataaaaaaaatttcaattcgaaaagggcctaaaatattctcaaagtattcgaaatggtacaaaactaccatccgtccacctattgactccaaaataaaattattatccacctttgagtttaaaattgactacttatataacaattctaaatttaaactattttaatacttttaaaaatacatggcgttcaaatatttaatataatttaatttatgaatatcatttataaaccaaccaactaccaactcattaatcattaaatcccacccaaattctactatcaaaattgtcctaaacactactaaaacaagacgaaattgttcgagtccgaatcgaagcaccaatctaatttaggttgagccgcatatttaggaggacactttcaatagtatttttttcaagcatgaatttgaaatttaagattaatggtaaagaagtagtacatcccgaattaattcatgccttttttaaatataattatataaatatttatgatttgttttaaatattaaaacttgaatatattatttttttaaaaattatctattaagtaccatcacataattgagacgaaggaataattaagatgaacatagtgtttaattagtaatggatgggtagtaaatttatttataaattatatcaataagttaaattataacaaatatttgagcgccatgtattttaaaaaatattaaatagtttgaatttaaaaccgttagataaatggtcaattttgaacccaaaagtggatgagaagggtattttagagccaatagggggatgagaaggatattttgaagccaatatgtgatggatgaaggataattttgtatcatttctaatactttaaagatattttaggtcattttcccttctttagtttatagactatagtgttagttcatcgaatatcatctattatttccgtcttaaattattttttattttataaattttttaaaaataaattattttttccatttaactttgattgtaattaatttttaaaaattaccaacatataaataaaattaatatttaacaaagaattgtaacataatatttttttaattattcaaaataaatatttttaaacatcatataaaagaaatacgacaaaaaaattgagacgggagaagacaagccagacaaaaatgtccaagaaactctttcgtctaaatatctctcatccaaactaatataatacccattataattaaccatattgaccaactcaaaccccttaaaatctataaatagacaaacccttcccatacctcttatcataaa

SEQ ID NO: 5092 - DNA, 1242 bp, Artificial Sequence
  P5303 FRUIT-SPECIFIC PHYTOENE DESATURASE (PD prom. MODERATE EXPRESSION) PROM. DRIVER CONSTRUCT
acgtgtaatagctaccatacaagagaagtaactcgcactgtccatgtcttatgtggctcgactcagaaagcattcagggggattgataaccaccctccaaaccaactgaaccattgtgaataaccacccttcaaatcaaccgagtcctcgtgaaggacaaatatgtggttttatatacattaaattttgtttttacatgcttcctcttacttctttagttttcttgaccatatcttgcgtttttcccttctgtaattgacacttttcttcaaaccatccagcaatgtggaagcttgacgattttccttcagagtagaaattgaaaagaatcaactaaaaaggatagtccttcgatttgatttccggcttaaaaataaactaataagaatgagagagcgaataatagaatattttgaaattttaaagatattcaactatgttaaattgcgttataaatttcttaaattagtagcacctaatagtttagttctcaaaagtcaaaactactacataatgtgctcatttttcacattaaaatgcctacatgatgtaaaagtaaaactcgtagcattctacgtgttttactcaactcaaacatcctgttcattttaataaacgtacgatgagcttctctctccaattttcttttcttttttttttttaaaaaaatatttttttttatatcaatccaaatgggctccaatttatcataaattaggtagaaacttagatattaaagaaagaaaagggtttatctcgcaagtgtggctatggtgggacgtgtcaaattttggattgtagccaaacatgagatttgatttaaagggaattggccaaatcaccgaaagcaggcatcttcatcataaattagtttgtttatttatacagaattatacgcttttactagttatagcattcggtatctttttctgggtaactgccaaaccaccacaaatttcaagtttccatttaactcttcaacttcaacccaaccaaatttatttgcttaattgtgcagaaccactccctatatcttctaggtgctttcattcgttccgaggtaagaaaagatttttgtttctttgaatgctttatgccactcgtttaacttctgaggtttgtggatcttttaggcgactttttttttttttgtatgtaaaatttgtttcataaatgcttctcaacataaatcttgacaaagagaaggaattttaccaagtatttaggttcagaaatggataa

SEQ ID NO: 5093 - DNA, 922 bp, Artificial Sequence
  P5310 ROOT-SPECIFIC RSI1 PROM. DRIVER CONSTRUCT
caatcaactaaatggacttttcttgtgcattggtcccatttttacgccctaatattcgcttacttgcttttttgtattttatttattttagttttaattttatctacctccaaattgatagaaataattacacttatagtccttttgaaaaattataattatagcattcaagtaaataaaaatacgtatttttagtcactttgtaatgtataattttgagttgaaaatgtatcaaaagtaaatttatattcttaagatatggataaagtttacatatacattatccgtttcataccctatttatagtattacattgcataagttattgtagatcttgatcgaaagtatgtgatattaatactatttttagaattatgttattctcagttatggagtgatatttaaaatcaatatagtatatcgataatcagatagtttaattcttattttctccatccaatttatataatgatattataatcaattttacgaatgagatggatattttgaaatttttagtttaaaataaattttaaattttttgtgggtctataaattatctaattaagaggtaaaatagaaagtttgaaattaattattacttactaaatatataaatatgtcattttttcttaaactgatttagaagaaaagagtgtcatatacatggacagaacgaatataatttgataattaaatttgtaaagattcatagttaatagggatcaaaattgcacgtatccattactataaggtcatatttgcttcataaaaatcatcaggatcaaaaatcagaatttatattatatttgagggactaaaaatgctaatatcacaaattaaaattagtctataaatattcacactttactcttctaattccatcaaatatttccatttatcttctcttcttcttaaatat

SEQ ID NO: 5094 - DNA, 2365 bp, Artificial Sequence
  P5311 ROOT-SPECIFIC ARSK1 PROM. DRIVER CONSTRUCT
ggcgagtgatggtatatttattggttgggcttaaatatatttcagatgcaaaaccatattgaatcaataaattataaatacatagcttccctaaccacttaaaccaccagctacaaaaccaataaacccgatcaatcattatgttttcataggatttcctgaacatacattaaattatttttcattttcttggtgctcttttctgtcttattcacgttttaatggacataatcggtttcatattgtaaatctctttaacctaacgaacaatttaatgaccctagtaataggataagaaggtcgtgaaaaatgaacgagaaaaaacccaccaaaacactatataagaaagaccgaaaaagtaaaaagggtgagccataaaccaaaaaccttaccagatgttgtcaaagaacaaaaatcatcatccatgattaacctacgcttcactactaagacaaggcgattgtgtcccggttgaaaaggttgtaaaacagtttgaggatgctacaaaagtggatgttaagtatgaagcggctaaggttttggatttggtctaggagcacattggttaagcaatatcttcggtggagattgagtttttagagatagtagatactaattcatctatggagacatgcaaattcatcaaaatgcttggatgaattagaaaaactaggtggagaatacagtaaaaaaattcaaaaagtgcatattgtttggacaacattaatatgtacaaatagtttacatttaaatgtattattttactaattaagtacatataaagttgctaaactaaactaatataatttttgcataagtaaatttatcgttaaaagttttctttctagccactaaacaacaatacaaaatcgcccaagtcacccattaattaatttagaagtgaaaaacaaaatcttaattatatggacgatcttgtctaccatatttcaagggctacaggcctacagccgccgaataaatcttaccagccttaaaccagaacaacggcaaataagttcatgtggcggctggtgatgattcacaatttccccgacagttctatgataatgaaactatataattattgtacgtacatacatgcatgcgacgaacaacacttcaatttaattgttagtattaaattacatttatagtgaagtatgttgggacgattagacggatacaatgcacttatgttctccggaaaatgaatcatttgtgttcagagcatgactccaagagtcaaaaaagttattaaatttatttgaatttaaaacttaaaaatagtgtaatttttaaccacccgctgccgcaaacgttggcggaagaatacgcggtgttaaacaatttttgtgatcgttgtcaaacatttgtaaccgcaatctctactgcacaatctgttacgtttacaatttacaagttagtatagaagaacgttcgtacctgaagaccaaccgacctttagttattgaataaatgattatttagttaagagtaacaaaatcaatggttcaaatttgtttctcttccttacttcttaaattttaatcatggaagaaacaaagtcaacggacatccaattatggcctaatcatctcattctcctttcaacaaggcgaatcaaatcttctttatacgtaatatttatttgccagcctgaaatgtataccaaatcatttttaaattaattgcctaaattattagaacaaaaactattagtaaataactaattagtcttatgaaactagaaatcgagatagtggaatatagagagacaccattaaattcacaaaatcatttttaaattacctaaattattacaacaaaaactattagacagaactaagtctataatgaaacgagagatcgtatttggaatgtagagcgagagacaattttcaattcattgaatatataagcaaaattatatagcccgtagactttggtgagatgaagtctaagtacaaacaactgaatgaatttataatcaataatattgattatattgtgattagaaaaagaaaacaacttgcgttatttttcaatattattgtgaggattaatgtgaacatggaatcgtgtttctcctgaaaaaaatatcagcatagagcttagaacaatataaatatatccaccaaaaataacttcaacatttttatacaactaatacaaaaaaaaaaaagcaaactttttgtatatataaataaatttgaaaactcaaaggtcggtcagtacgaataagacacaacaactactataaattagaggactttgaagacaagtaggttaactagaacatccttaatttctaaacctacgcactctacaaaagattcatcaaaaggagtaaaagactaactttctc

SEQ ID NO: 5095 - DNA, 4361 bp, Artificial Sequence
  P5318 APICAL MERISTEM-SPECIFIC STM PROM. DRIVER CONSTRUCT
agaatgtagcaatacaaatatatgacggtaccgttatccatcaccattatatgtatatatgtataatttgataaatattcactttgtgtttcgtcgtttgcttaataaacagctcatttccatggtattgagtcttctatatgcgagagaatcagattcccgctgggataacaaaagaacaaggtactgaaaaaaatagacaaaacttttttttaaattatataagctataaaagaaaagagtatagagagagattagccctactgtttaagagggagagagtagggtcattagggctttagagagagaagacattcggactgtccccacttgcttttctgtagaataacattatttaaatcttatttttaattaaatattacaactaaaagaagaaaccaacttttaaaataaatgcagattatatgctctgacttggactaaataaaacttgcaagtaacagtttcaagtccttttgttttagaactttttctttcgtagaagtgataaatgattgccctagacctgatagattctctaaaattctacgtattacagcataagttacctcctttatttgactattagaccatccatattggtgggcttttagcaaatgttcttaacaataattttataatttattttaatgttaagaggtttgataattttttttttttaagagtgtattttgtttattaaaatgtgttttgtttcttatataagaaccaaatcttaactattttaccaattaaacattaaatttaaattttaatatctctaagaattatattaagagccaatatagatgcttttaaaaccattggttgaataaataaatctaaccttcttaattatttctgtgtgaatattttctaaattttcattttaatttagcacaatataatccatgttctaaaaagaacaattaacataatatttacaaacctaaaaagattataaaacacaattttattttttacagcttataatgttttaaagttcaggtttattttttaaaagttcaggtttattacattaggtttgacttgtaatcatcatttatcacaacgatcaaactattattacaatcacaatagtagacaaaatttaggatatatatatatatatataattatgtataaactatgaacatttaaagtgagatttttcaaaataatatataaattcaaatagaaatagactatttggttcttaaatgagagacccccgaaaaaatctttttttttttctcatcaagctgtttacatttttagatataaaatcatattctttatagtttagaatatgaattaaatagttttatatgttattaacttatcataagatatgcgtgaggttggccaaaaactcatcaattaaccaaataagaaaagtaaaattgtattttgctttgctaaaaatgtaaatatttcattgaaaaatgaaaaaggtttaggtaatacaattaagtaaatcctacaattttggttccatggcaaaagaataaaattgtattgctttggtaaaagttgatccaactaatatattcagtagaaactgcaaaactgaagaaataagtttgtttagtagaattgctttcggttatgtaatgaatatacatccaaaatggctttttagtaatgatgtcttttcatactctttccaatccctactactttcagattatttgtcctactattatagagatatacgttcgttttcaataatatgaaaagtgatatatatttaaatagtgtgatatatatataagttttgcaagtgcatcacttcccaaaatcgcataaatcattaatcatattgtcgaaaacagtataataacttcttaaacgaaaacgcagcgcaattaaaaataacaactagagataattgacaaaacattgattaatatttacctataagttaattattgtatttaaaatttatttaaagttcataaggaaaacatatgcaaaaatatttatatctaatattttgctatgttatccttttttttttttacgttatcctaattttgtttatcctaatttgttgtggttaaaatcttattattgataaaaagagaacttttttttttgtcatcataaaaaagagaacttattacttcgattttaaaattctatgagcgtaggagacaaagaaaaaaaaaataaaaaaaaaaagaagagaaaaatcacttcttttcttctttttagtccagatccaacatattttggataactaaatgaagattttttaaaaaaatatattttagggtatatataaatcataatttgaagcaaatgaaataaaatccagtttggtaatatataaatatgatttgatgggttccttgtaatctctctctatctattagtttctcagttatcttttctttgccagaaatggcagtgaaggcagtggctgaggagagagttttttttcttctttcatggggaaagtaaaactttgccttgaagatttctctcttcaatatttttctaagacttttgatttcaacgaatcactgtccttaacctaaaagcaagaaaaattagctttatactggtctttacttttttttaacatatttatttttatatagtttacttataaacatagacatacgagtatgggaatatatagtatatccaacttctaaataatatttcgaatagtgataacaaaattagcaatacatacggctagtgaaatgttgatcgaataaacggcactgatgtaatgtacttatcaattttgataattttaattgtattgtttttctttttttcccacagtattgaactagacaattaaatttaaagtaaaattatacatttctttcgttgtgtattaaagtaacatgcataatatcattttccttcgtacaatcctccaaattgacaattgatgaattactttgtcaatcgtaaatgaatttttctcaagtctgtatactattttcagggataaacaggtacaggtgtcccatgcttattctcttgatagtaacatgtgtcctatgttgagtcaattctacgttcgaagaagtgctaacaattgttaatagcctcgtatattattctaattaaaatgcctcgatagatttggttagtggtctgaatgtgattggttattttttcaagtggcaagaggtctaccatctaatattacaatcaatcgaccaaaaaggtcgagaacatgataatggtggcaaatacaaatggttcattgttgtctaatataacaagccatcagttgtcactttttaaaaacaatacagaatacaagatactttttttttaaggtaaaatgtgtgtttaatattttcgtttatataacaaataaacagttacatgttttactctatgattatatttatgacatttttcttcttcttaacaacatttttttcccataagaacatttacaatagtattaaaactttgattgcaatcaaatgttagatcacttattataaaattactaagactgctatcttttcctattgacaaaagcgaatccaatatatgttactgaaacaaatgcgtaaattatactatatggagatctatcggttaattattgagagaatctaagaaagtttttgagtacaacagtcctaataatatcttcacataccatataatatacatatatacatatacacaaatgtactttttaaaccaacatcagcatacgtatatcccatcaggaaacttagacttttgggaattcatggtatgaaaaccaaaaccaaatgacaacattcgatttgatactcccgacccatggtaaagaaataacaaattccaatatatctttcactggactttccgaggcacattccggttttctccatttcaagaaattgtcaaaaataaattgagatccggtttattacctcaaaaaagaagaagagaaattacaacattaatttccgaaaaggcataaatgagaaatcatatttcagcagaagaacacaaaagagttaagaacccacagatcacacaacctctgtccatgtctgctttttacacttttttaaaataagtttctcctaaaaagttatttcctatttataataatttccttagatttatcttcctggtctctcttctgctgcttccctctcccccataactatcactatttagaattttcaatgtggaaaaggaagctgattgttgaagcataaatcccgggagaccacttttgcattttcaaataattaaattaaaccatagatacacacacacagttacttactcttttagggtttcccaataaatttatagtactttaatgtgtttcatgatattgatgataaatgctagctgtatttacaatgggggctcct

SEQ ID NO: 5096 - DNA, 4801 bp, Artificial Sequence
  P5319 EMERGENT PRIMORDIA-SPECIFIC AS1 PROM.
ggaccgtgtaatgggccattgggccaagttttcttgatataaaatctgaaatactactaaattacaatttttcttaaactcgatttcataattcatgtgggactcagttctccgcgtcttatgacttaagagttaagagtaaagacaattgattgtagtttgcattattaaggttgtgattttaaaggctatattggcccaggcaaagtggttatgaaagttaaaaggtattattaaatgtcgttatggactagctaaagaaaagagatggatatagaaacggatttgccagtttgtgaggttacgtactcgttactttctattgcatttttgtgtgtcattgtgcttgtgatttctttagtatatgtttttctttttgtcaaactctttagtacatgttatgctttattttcttgtttagcattgttattgttattttgatccatgttcttttacttaatgtgtagagtgttcacgtacgactctttatgatcgctatactaatatactatgaaactcgaatgagaacatgcatgtcataaatcaataaaacataacatacgacacttaacctaaatcatacattcattgattcatactatcatgatcctcatcacattagtatcatttgtctttatttattacttagctacttcgttatcttattatatctttacctgttctgctggtcatttgccataaacaccaagtacaagcaactctttagtccaatatcagaccaaattaacaaacatttccccaatccaaaacggaaatttaattataattagcatttaaataggttcgattacaaaaaaaaatcaacaaaggaacaagtcaatttcataatggtttgtcaattgtcacacaacgaaatggctagccggatcaagcatgcatgatccaaatttcaacatttccatgataacctgaattataacgtctacataaaccatatttaaataaataggatggtcgaaagatatcattaaaagaacgattcaatattctttattgttcaattgatacacatgttattctccttaaccagttatgaacatgtcctacaagtttcttgacccaaactcataatttcatataccataatcccaagttaagttttttttttttggggatcaaaatctcaagttaagttaagttcaattatttagctgtaatgctcggaaaaaagatcggatgaatatccaattggttcaatatataccccaatccggccaatctccctatctttatagcttaattattagagaatggtcaattcacgccatcagaaccagtttcatatcttcatgaaccaaaacgcctacaaccctattattcaagaaatcactataattgtccaagtaaaaccattaattaaccgagtcgatttttctatggtcctataggcatgttgttactcaaactactgattaattaataagaagttgtagtttgaaaaagaatctagctgaaaaatactcctactctaagaatttaagttagaataaaacatattaatacaaatataaaaatttagttattaaaaaagcgctactaccaagacgtcctaaagaaaaactagctttgtcttctaaaagaaaacctagcttaactacccaaaaaaatctagttttacaaacactaaagacaaattttatttttcaacaaatttaccaattaaagaaaattccatgtaggaatgtatccaaattgaaaatatccctacatattttgtaggaaaaaaggtttttataaatattaaaaaaacgagaaaaagaaaagagaaaagagaaaaaaaaaagccggagagaatggagcacatgaggtaaaaggcaagagatggcagagagaagatcagagaagggatctgcctcaatttgacaactcatatgtcatgtcatttccctcactactattattttcctatttcaaaaacacctttctctgataccatcaccttttaccttctctttttttttactgtctttgctctgtttcacattcccttctatatatacagtatagtatattttatccttcttttattgttttgcttactaaaagtttttttcctccggaatcaaaattctaaaatgtatatcatgttaggtcgcgagggccatgcaatattatgaactatgcatgatgattaatgtctgtggatccatcacaaatattattgaaggttgatcagagactatggaccaaaatggtccgaatcgcctgataataaaaaactattcatttttattttttattttttttattaaacatgtgattaatgatagatcttacgattcgcaactgggaaacatgcactaactcaaacttaaaacacacaatactaaaagttctattaaattttgaatgtaaagagaaatatattaggcaatcaaacggtcaagtaaatcatacacatcgataatttatttttttatccttcaaagcaggcccatccaaggcccaccactattctcatatcaacatacttttcttgttttggttaaatcaacctaccatgttggctgttctctccgctcctctgtgtaagatcacaccaacaccactgcataatttcttgtattattttgagacttgagagtaaactgattgacaaaaaaaaaaaaaaaaaaaaaaaattgagagtaaactagtttcttgaatattgattttttcagcttaatttgttggggaaagatattactactattgctgtaaaaaaaaaaaaaaaaaaaaaagatattattactatatttgtagtgattttattttgaaaattctcttcacttttttgtagttaacattctaattttgtgaaaagaacttttaatgtcaggtcatgtctcttaaaaagtttgcatgatgaaatgatttacaaattacaatagaaaatggaaaccattgcaaactaaatttttatcaaaaaaaatcgaaaataaaatgtattgacttagtaatgctgtgtctgctacgattaactattacacataatgcaacactgaattatccaaatacattattagaataatagtattacagtatcactattacaacaacaatgtcaacaataatcttattataataatatataaatagaccttagtgacatcatattatatagaaaacatgtggttgcctaatttgtataagctagatacttgggggtgatgagtgactagttgatgcaatgataaaagagtgaaagttttgtctgcctgattatagacgtcggagaaatactaaaatacgctatgaagattttggcgcatggtagcagaaaaaaaaaacggagggtgtgagtgagtagtggtagtcggatgtgatggaacaaagaaaagtatttttggtagggttatgggagagagaaggggaccattattacacacttacatgctttccccaaaagataccattcccattttctgacacgtgtccccctcatccccaattactcatacgtcaaatccaatttttagcctaaaagttttttttatttgtttagccaaatctattttactaattaaagttttcaaatggcaaatagaaagatcttctaaggttttataaaattacttgattatttctagttttgctcattttttaaataaaatttctcttttttttcttgcaacattattgattttttttttgatagggagtaacattagtgatgttctatctcttctcattgcaaaaactttattttctcatctctatttgatcatcattgcgaaatcttccattttcaacaaatacttttccatgttaatatgctgtttcaaaatataagtgtttggaaaataaatcaacaagtttaaatgttaactatttttatgctattataattatttttcttatgggtaagtggaaattaatgttactcaaattggacataaaattctattgtttgagtgaaggagtttataaatggagcattattttcttgaatggttagtttttcttctatcattttgacaagtaaatgacttttcagccactaaagtacaacactttttcatttaaatttaaagcatcccctacattagattgtcattttatttctcataatgttatagaaaaatgaattttgagatcccaatgtagtaaatatatataaaaaaaggtttaatattgtcaatgacaaacaacgaacttatggaatttcaacttttcacctccacgcgcctctgtcagagttttttttttccccacttgtgatgtaaaaaggggaaaacgtctgtgtctcagtcggtaaactttttctctctttttttttttaaagattttattttaattatgccgtctctgtggtctaatcgtgtacgtcgtctggttttaaaagcctctctcactttggtcttttcgttttctctcttccattttctccaactatataaaaaaaaaaaagtgagagagagagcaaatctgtgtgatggaagttgctcttgagtttgggattatttatcttttcaatatcatttggtaagcatttttattttgttttatagtaataattttaactctcttatcttcttaataagtctttgcttaatagtgttttggggtcagcattaatttcccctgtttggtttccagaatataggttgtatagtgtgataataacaaattattccaagttttgcttcaaacattgtcaaagtttttgtcattttcatttcttgaaacggaaatttttcagactttgtaatttctaattcgaaaattcgacagatcttgtagatttgtttcgatcttttagagttttgaattggagagatttatgaaacgggttgatttt

SEQ ID NO: 5097 - DNA, 1109 bp, Artificial Sequence
  P5324 FRUIT VASCULAR TISSUE AND COLUMELLA, SEED AND ENDOSPERM SPECIFIC CRUCIFERIN PROM. DRIVER CONSTR UCT
ctacacgttttgaaaagttaacctgttggttaaatggttagctatgactctcgcaacaaacccaacccttaagatgatgatggtttaacatttgacaacatagttaagactgtgtctatataatagtcaacaaattcagattgtagtattatggagtcaacatatttcgagatcaaaaacattcaaaacgtaaatctatcgacgtctcacatagttttgttatgaagctgatgaaaaaagttggaagacatagttttgcaaacatcatttgttgctaacgtataaacgttggtttgattaaatgtaataggataaggatatccgtttgttcatataattgagttaaattatattttggttattataatatgttaagttgaaaataaataggtccaacaaccttgtttaaatagattttttaggagtgattcccttttaatagtatagattatactctcttcctaatcgaccttccgtggggtaaagtggtcaattatattctttatggatgagcttgattgagaatgggtttatgggttatgacaagggcatgtacaaatgtcactgcctcttgacatgcaaccgaacagttggcgactcaagtcgcagaagatacaacggaccaaaccctccgagtgtcgccgcgtctgttatgtgtcacctttttgtctcctttccttaaaaattggtaactcatttttcaaaaaaagaagaggatagttttggctgtatctcctaaactattcgatcacaacgccagatattttaatactggatactagtgatgtaatttgatttgttaattgtcaaaaagtagattctcctatctcgtttttagttcaattattatatggttaaatgaatttaagtcgattagaaatgattagttaatcaaccagagttgctctataagtctatactgataacatgaaccattttctaaaaatgagatagatacatttgaattttgtcgtggtttggagtatgcggagatagtcgtacgcgcatgaacatcatgagacacttgcttcagctcacagagtgacgtgtaaagaccatagacccacgacttcatgcaaacccattcctacgtggcacaaaccttcatg

SEQ ID NO: 5098 - DNA, 3446 bp, Artificial Sequence
  P5326 FLORAL MERISTEM, STRESS INDUCIBLE-SPECIFIC AP1 PROM. DRIVER
cacggaccttggatctgaagttatgaacaataacatatttggcaaaacaaagaaaaaagaaacaacaatactaacatattttggtaaaagaacattgagaagtctcaaaaattaacttcttcttattttgtttcctaataagaccgtttgcttcatttcaagttcttaggaaataatttcatgtaacgtgtatgtagatatgtttatgtacagataaagagagatctgaaaatgatatatagagcttttgtggtgataagtgcaacaagcaggatatatatatcgaacgtggtggttagaagatagcgtcaaaatagatgctagctgctgcgtatacatcatattcatatcatatgtacttctcttttgtgatttctcatgtgattgaacatactacataaatcttgatagatttataaaaatgcaacaaattgttgtttatataagaaaaataaaacactgatatgatatttcattagttattatcaaatttgcaatataatgtttaacatccaagatttgttttacataatcgttacggttactaaagtttaatttatgatgttttaaaacaaattgagactaaatttctaaaagaaacatatacgtacatgtgtgtagctgcgtatatatatagaatggtggggctaaaagctaatgatgtgtacattaattggacatttgatgtggctggattggacccaacttgctctttgatagagacctaactaagacaattttgctcttcattcatttctcccgtatacataattgaattaactgtacataatgtttcacaacaagcgatctagctatatatttcaaaataacagagactgatattttaatctggtcttctaagctctaacgtcaaattaaaaaaaaaatccgatcttctaattaattagaagaaatcaattatagaacctctctctttaatttcatttatttaaaactgcttggaaatttaattattcactaaagactcactattctccttaatttatgataatttgtagatcatatgttcagtttttatttatttgccattcgaatgttgagttttaattaaaccaatatgttaatattcgaattaaaaaaacttacctataattcacttatttaaaaacataaaataataataattgcatcaccgtgatacaaagcaacctcacaagtcacaactctcgtgactacaaagatcactcattaaacaaaccttcctgccttctttttttctacttgggcacctcgaccgatcgaagactattcttgggatctgcttcaaaaacgactatatgttctaaatccacttcgtatgatgacgaacatttggtttactactgaagatagagattacgtccttctaattagaagtaattaattattttagtatttggaagctaatggtggagatgtaaccgtatcttagtggatcgagatattgtatataaaatatgtatgctacatcgaataataaactgaaagagagtaaaaagggatatttaatgggaagaaaagaagggtggagatgtaacaaaggcgaagataatggatattcttgggatgttgtcttcaaggccacgagcttagattcttttagttttgctcaatttgttaagtttctacttttccttttgttgcttactacttttgctcatgatctccatatacatatcatacatatatatagtatactatctttagactgatttctctatacactatcttttaacttatgtatcgtttcaaaactcaggacgtacatgtttaaatttggttatataaccacgaccatttcaagtatatatgtcataccataccagatttaatataacttctatgaagaaaatacataaagttggattaaaatgcaagtgacatctttttagcataggttcatttggcatagaagaaatatataactaaaaatgaactttaacttaaatagattttactatattacaattttttctttttacatggtctaatttatttttctaaaattagtataattgttgttttgatgaaacaataataccgtaagcaatagttgctaaaagatgtccaaatatttataaattacaaagtaaatcaaataaggaagaagacacgtggaaaacaccaaataagagaagaaatggaaaaaacagaaagaaattttttaacaagaaaaatcaattagtcctcaaacctgagatatttaaagtaatcaactaaaacaggaacacttgactaacaaagaaatttgaaacgtggtccaactttcacttaattatattgttttctctaaggcttatgcaatatatgccttaagcaaatgccgaatctgttttttttttttttgttattggatattgactgaaaataaggggttttttcacacttgaagatctcaaaagagaaaactattacaacggaaattcattgtaaaagaagtgattaagcaaattgagcaaaggtttttatgtggtttatttcattatatgattgacatcaaattgtatatatatggttgttttatttaacaatatatatggatataacgtacaaactaaatatgtttgattgacgaaaaaaaatatatgtatgtttgattaacaacatagcacatattcaactgatttttgtcctgatcatctacaacttaataagaacacacaacattgaacaaatctttgacaaaatactatttttgggtttgaaattttgaatacttacaattattcttctcgatcttcctctctttccttaaatcctgcgtacaaatccgtcgacgcaatacattacacagttgtcaattggttctcagctctaccaaaaacatctattgccaaaagaaaggtctatttgtacttcactgttacagctgagaacattaaatataataagcaaatttgataaaacaaagggttctcaccttattccaaaagaatagtgtaaaatagggtaatagagaaatgttaataaaaggaaattaaaaatagatattttggttggttcagattttgtttcgtagatctacagggaaatctccgccgtcaatgcaaagcgaaggtgacacttggggaaggaccagtggtccgtacaatgttacttacccatttctcttcacgagacgtcgataatcaaattgtttattttcatatttttaagtccgcagttttattaaaaaatcatggacccgacattagtacgagatataccaatgagaagtcgacacgcaaatcctaaagaaaccactgtggtttttgcaaacaagagaaaccagctttagcttttccctaaaaccactcttacccaaatctctccataaataaagatcccgagactcaaacacaagtctttttataaaggaaagaaagaaaaactttcctaattggttcataccaaagtctgagctcttctttatatctctcttgtagtttcttattgggggtctttgt

SEQ ID NO: 5099 - DNA, 1839 bp, Artificial Sequence
  P5486 HEMAGGLUTININ (HA) EPITOPE C-TERMINAL TAG, 35S
atggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaagaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaggttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagcgcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagctgctgctgctgaggatcctgaagctcgaaaaacaaagaaaaaaatcaaagggattcagcaagccactgcaggagtctcacaagacacttcggaaaatcctaacaaaacaatagttcctgcagcattaccacagctcacccctaccttggtgtcactgctggaggtgattgaacccgaggtgttgtatgcaggatatgatagctctgttccagattcagcatggagaattatgaccacactcaacatgttaggtgggcgtcaagtgattgcagcagtgaaatgggcaaaggcgataccaggcttcagaaacttacacctggatgaccaaatgaccctgctacagtactcatggatgtttctcatggcatttgccctgggttggagatcatacagacaatcaagtggaaacctgctctgctttgctcctgatctgattattaatgagcagagaatgtctctaccctgcatgtatgaccaatgtaaacacatgctgtttgtctcctctgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccatcgtcaaaagggaagggaactccagtcagaactggcaacggttttaccaactgacaaagcttctggactccatgcatgaggtggttgagaatctccttacctactgcttccagacatttttggataagaccatgagtattgaattcccagagatgttagctgaaatcatcactaatcagataccaaaatattcaaatggaaataccaaaaagcttctgtttcatcaaaaatga

SEQ ID NO: 5100 - DNA, 4276 bp, Artificial Sequence
  P6506 CONST. 35S PROM. DRIVER CONSTRUCT
catgcctgcaggtccccagattagccttttcaatttcagaaagaatgctaacccacagatggttagagaggcttacgcagcaggtctcatcaagacgatctacccgagcaataatctccaggaaatcaaataccttcccaagaaggttaaagatgcagtcaaaagattcaggactaactgcatcaagaacacagagaaagatatatttctcaagatcagaagtactattccagtatggacgattcaaggcttgcttcacaaaccaaggcaagtaatagagattggagtctctaaaaaggtagttcccactgaatcaaaggccatggagtcaaagattcaaatagaggacctaacagaactcgccgtaaagactggcgaacagttcatacagagtctcttacgactcaatgacaagaagaaaatcttcgtcaacatggtggagcacgacacacttgtctactccaaaaatatcaaagatacagtctcagaagaccaaagggcaattgagacttttcaacaaagggtaatatccggaaacctcctcggattccattgcccagctatctgtcactttattgtgaagatagtggaaaaggaaggtggctcctacaaatgccatcattgcgataaaggaaaggccatcgttgaagatgcctctgccgacagtggtcccaaagatggacccccacccacgaggagcatcgtggaaaaagaagacgttccaaccacgtcttcaaagcaagtggattgatgtgatatctccactgacgtaagggatgacgcacaatcccactatccttcggcggccgcaagacccttcctctatataaggaagttcatttcatttggagaggacacgctcgagtataagagctcatttttacaacaattaccaacaacaacaaacaacaaacaacattacaattacatttacaattaccatggaagcgttaacggccaggcaacaagaggtgtttgatctcatccgtgatcacatcagccagacaggtatgccgccgacgcgtgcggaaatcgcgcagcgtttggggttccgttccccaaacgcggctgaagaacatctgaaggcgctggcacgcaaaggcgttattgaaattgtttccggcgcatcacgcgggattcgtctgttgcaggaagaggaagaagggttgccgctggtaggtcgtgtggctgccggtgaaccacttctggcgcaacagcatattgaaggtcattatcaggtcgatccttccttattcaagccgaatgctgatttcctgctgcgcgtcagcgggatgtcgatgaaagatatcggcattatggatggtgacttgctggcagtgcataaaactcaggatgtacgtaacggtcaggtcgttgtcgcacgtattgatgacgaagttaccgttaagcgcctgaaaaaacagggcaataaagtcgaactgttgccagaaaatagcgagtttaaaccaattgtcgtagatcttcgtcagcagagcttcaccattgaagggctggcggttggggttattcgcaacggcgactggctggaattccccaattttaatcaaagtgggaatattgctgatagctcattgtccttcactttcactaacagtagcaacggtccgaacctcataacaactcaaacaaattctcaagcgctttcacaaccaattgcctcctctaacgttcatgataacttcatgaataatgaaatcacggctagtaaaattgatgatggtaataattcaaaaccactgtcacctggttggacggaccaaactgcgtataacgcgtttggaatcactacagggatgtttaataccactacaatggatgatgtatataactatctattcgatgatgaagataccccaccaaacccaaaaaaagagtagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatctagaacatatccatatctaatcttacctcgactgctgtatataaaaccagtggttatatgtccagtactgctgtatataaaaccagtggttatatgtacagtacgtcgatcgatcgacgactgctgtatataaaaccagtggttatatgtacagtactgctgtatataaaaccagtggttatatgtacagtacgtcgaggggatgatcaagacccttcctctatataaggaagttcatttcatttggagaggacacgctcgagtataagagctcatttttacaacaattaccaacaacaacaaacaacaaacaacattacaattacatttacaattaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtccggagggatcctctagctagagctttcgttcgtatcatcggtttcgacaacgttcgtcaagttcaatgcatcagtttcattgcgcacacaccagaatcctactgagtttgagtattatggcattgggaaaactgtttttcttgtaccatttgttgtgcttgtaatttactgtgttttttattcggttttcgctatcgaactgtgaaatggaaatggatggagaagagttaatgaatgatatggtccttttgttcattctcaaattaatattatttgttttttctcttatttgttgtgtgttgaatttgaaattataagagatatgcaaacattttgttttgagtaaaaatgtgtcaaatcgtggcctctaatgaccgaagttaatatgaggagtaaaacacttgtagttgtaccattatgcttattcactaggcaacaaatatattttcagacctagaaaagctgcaaatgttactgaatacaagtatgtcctcttgtgttttagacatttatgaactttcctttatgtaattttccagaatccttgtcagattctaatcattgctttataattatagttatactcatggatttgtagttgagtatgaaaatattttttaatgcattttatgacttgccaattgattgacaacatgcatcaatcgacctgca

SEQ ID NO: 5101 - DNA, 1510 bp, Artificial Sequence
  P9002 STRESS INDUCIBLE RD29A PROM. DRIVER CONSTRUCT
ggttgctatggtagggactatggggttttcggattccggtggaagtgagtggggaggcagtggcggaggtaagggagttcaagattctggaactgaagatttggggttttgcttttgaatgtttgcgtttttgtatgatgcctctgtttgtgaactttgatgtattttatctttgtgtgaaaaagagattgggttaataaaatatttgcttttttggataagaaactcttttagcggcccattaataaaggttacaaatgcaaaatcatgttagcgtcagatatttaattattcgaagatgattgtgatagatttaaaattatcctagtcaaaaagaaagagtaggttgagcagaaacagtgacatctgttgtttgtaccatacaaattagtttagattattggttaacatgttaaatggctatgcatgtgacatttagaccttatcggaattaatttgtagaattattaattaagatgttgattagttcaaacaaaaattttatattaaaaaatgtaaacgaatattttgtatgttcagtgaaagtaaaacaaattaaattaacaagaaacttatagaagaaaatttttactatttaagagaaagaaaaaaatctatcatttaatctgagtcctaaaaactgttatacttaacagttaacgcatgatttgatggaggagccatagatgcaattcaatcaaactgaaatttctgcaagaatctcaaacacggagatctcaaagtttgaaagaaaatttatttcttcgactcaaaacaaacttacgaaatttaggtagaacttatatacattatattgtaattttttgtaacaaaatgtttttattattattatagaattttactggttaaattaaaaatgaatagaaaaggtgaattaagaggagagaggaggtaaacattttcttctattttttcatattttcaggataaattattgtaaaagtttacaagatttccatttgactagtgtaaatgaggaatattctctagtaagatcattatttcatctacttcttttatcttctaccagtagaggaataaacaatatttagctcctttgtaaatacaaattaattttccttcttgacatcattcaattttaattttacgtataaaataaaagatcatacctattagaacgattaaggagaaatacaattcgaatgagaaggatgtgccgtttgttataataaacagccacacgacgtaaacgtaaaatgaccacatgatgggccaatagacatggaccgactactaataatagtaagttacattttaggatggaataaatatcataccgacatcagttttgaaagaaaagggaaaaaaagaaaaaataaataaaagatatactaccgacatgagttccaaaaagcaaaaaaaaagatcaagccgacacagacacgcgtagagagcaaaatgactttgacgtcacaccacgaaaacagacgcttcatacgtgtccctttatctctctcagtctctctat

SEQ ID NO: 5102 - DNA, 706 bp, artificial sequence
  P2404.1
cttctttaattagtttgccacctcgcacgtgtgacaaatccttcttcgccacgtgtgaaaacccttctccggcttgctactaatatacgactaatagtatgaatagttcaatggcttctgccggcttaggtagccggagaaaggatccggtgtacagaggaatccggtgccgaagtgggaaatgggtctccgagattcgtgagccgaggaaaaccacgagaatctggcttggaacttaccccatggcagagatggcagcagccgcctatgatgtggctgctatggctcttaaaggaagagaagctgtcttgaacttccctggatccgtcgggtcatacccggttcctgaatcaacatccgcagcagatatacgagccgctgcggcagccgcagcagcaatgaagggatgtgaggaaggggaggaggagaaaaaggcaaaggagaagaagagtagtagttcgaagtcgagagcgcgtgagtgccacgtagataatgatgttggatcttcgtcgtggtgtgggacagagttcatggacgaagaagaagtcttgaatatgcctaatctgctggctaatatggcagaagggatgatggttgcgccgccgtcgtggatgggttctcggccgtcggatgactctccggagaattcaaatgatgaggacttgtggggctattgatcggtttgtgttgtccacgtacgtatatg

SEQ ID NO: 5103 - DNA, 697 bp, artificial sequence; identical to SEQ ID NO: 369
  P9081

SEQ ID NO: 5104 - DNA, 882 bp, artificial sequence
  Artificial sequence
  P4709
cttgtggtccaataaaaccctaattttcttttctttcttttatccattgtattagatcctatatctttcttccttatagaccatctctcatgtcttcttatatatattaagatattcacaagaactacaaaagaaagaaaggagatggagtggtcaacaacgagcaacgtagaaaacgtgagagtagctttcatgccaccgccatggccggagtctagttcctttaactcgctccacagcttcaactttgatccttacgcaggaaattcatatacgcctggcgatacacaaaccggaccggttatctctgtaccggaatcagaaaagatcatgaatgcgtaccgatttccgaacaacaacaatgagatgataaaaaagaagagactaacgagtggacaattagcttcacttgagcgaagttttcaagaagagatcaaattagattcagacaggaaggtgaagctgtcgagagagctcggtctgcagccacgtcagatagcagtttggttccaaaaccgccgtgcacggtggaaggcgaagcagcttgagcagttgtacgactcgcttagacaagagtacgacgtcgtttctagggagaaacaaatgttacacgatgaggtgaagaagctgagagctttactaagagaccagggtttgatcaagaagcaaatctctgccgggaccatcaaagtttccggtgaggaagacacggtggagatttcatcggtggtggtagctcatccaagaacggagaatatgaacgcaaatcaaatcaccggagggaatcaagtttacggtcaatacaacaatccgatgctggttgcttcctctggctggccgtcatacccctgatagatgttgctgatctcagagagagggaaa

SEQ ID NO: 5105 - DNA, 1353 bp, artificial sequence
  P4762
cagattcttgaggagcgagcgatgaacagtatcttctccattgacgatttctccgatcctttctgggaaactcctccgattcctctcaatcccgactcttctaagcctgttacggcggatgaagttagccagagtcaaccggaatggactttcgagatgtttctcgaagagatttcttcgtcggcggtgagctctgagccacttggtaacaacaacaacgcgatcgtcggtgtttcttcggcgcaatctcttccttctgtttccggacagaatgatttcgaggatgatagtcgatttcgtgatcgcgattcgggaaatttggattgtgctgctcccatgacgacgaagacggtgaatgttgattccgatgattatcgtcgtgttcttaagaacaagcttgaggctgagtgcgcgactggtgtttctcttcgggttgggtctgtgaagcctgaagattcgactagttctccagaaactcaacttcaaccagttcaatccagtcctcttactcaaggagaacttggtgttacttcttccttaccagctgaggtgaaaaaaactggtgtatcaatgaagcaggttactagtggatcgtcgagagaatattctgatgacgaggaccttgatgaagagaatgaaaccaccggttccttgaagccagaggacgttaaaaaatctagaaggatgctgtcaaatcgtgagtcagctaggcgatctagaaggagaaagcaggagcaaacaagtgacctcgaaacacaggttaatgatctaaaaggtgagcattcatcacttcttaaacaactgagcaacatgaatcacaagtatgacgaggctgctgttggcaatagaatactaaaggctgacattgagacattaagagctaaggtgaaaatggcggaagaaaccgtgaagagagtaacaggaatgaatccgatgcttctcggaagatcaagtggacataacaacaacaacagaatgccaataactggtaacaacaggatggattcttctagcattattccagcttatcaaccacactcaaacctaaaccatatgtcaaaccaaaacatcgggatcccaaccattctacctccaagactcggaaacaatttcgctgctcctccatcccaaaccagctctcccttgcagagaattagaaatgggcaaaatcaccatgttactccaagcgccaacccgtatggctggaataccgaacctcagaacgattcagcatggccgaaaaaatgcgtggactgatcaaacaagaagcgggtttcgcactatattaatgtctatgcatctgtaatttgtaagtgttattaagttacgaatcatgagaaaacatcttgtggt

SEQ ID NO: 5106 - DNA, 1494 bp, artificial sequence; identical to SEQ ID NO: 4258
  P4546

SEQ ID NO: 5107 - protein, 8 aa, Arabidopsis thaliana
  misc_feature (7)..(7): Xaa can be any naturally occurring amino acid
  G1073 clade AT-hook consensus sequence
RPRGRPXG

SEQ ID NO: 5108 - protein, 10 aa, Arabidopsis thaliana
  misc_feature (2)..(6): Xaa can be any naturally occurring amino acid
  misc_feature (8)..(9): Xaa can be any naturally occurring amino acid
  G1073 clade consensus sequence
PXXXXXLXXY

SEQ ID NO: 5109 - protein, 10 aa, Arabidopsis thaliana
  misc_feature (2)..(6): Xaa can be any naturally occurring amino acid
  misc_feature (8)..(9): Xaa can be any naturally occurring amino acid
  G1073 clade consensus sequence
PXXXXXLXXF

SEQ ID NO: 5110 - protein, 9 aa, Homo sapiens
  AT-hook domain-Reeves
KRPRGRPKK

SEQ ID NO: 5111 - protein, 22 aa, Arabidopsis thaliana
  misc_feature (1)..(1): Xaa can be any naturally occurring amino acid
  misc_feature (4)..(6): Xaa can be any naturally occurring amino acid
  misc_feature (12)..(12): Xaa can be any naturally occurring amino acid
  misc_feature (16)..(17): Xaa can be any naturally occurring amino acid
  misc_feature (19)..(22): Xaa can be any naturally occurring amino acid
  DML Motif
XSKXXXVDMLRXHTYXXEXXXX

SEQ ID NO: 5112 - DNA, 534 bp, Oryza sativa
  G3836
atggccgaccaccatggcggccaccacgccgacgggcatcgccggcagcagcagctgcagggggaggcggcggatcaggcggcggcggagatcatcaaggagcaggacaggttgctgccaatcgcgaacgtggggcgaatcatgaagcagatcctcccccccaacgccaagatctccaaggaggccaaggagacgatgcaggagtgcgtctcggagttcatcagcttcgtcaccggcgaggcctccgacaagtgccacaaggagaagcgcaagacggtcaacggcgacgacgtctgctgggccttcggcgccctcggcttcgacgactacgtcgaccccatgcgcaggtacctcaacaagtaccgcgagctcgagggcgaccgcgccgccgccgccgccacctcccgctccggcgccggcgccgccgcgggccccgaccacccttcctcctcctcctccgccgccgccgccaccgccggtcatttcatgttcaacgccatggacaggtcgacggatagctccaggcagttctag

SEQ ID NO: 5113 - protein, 177 aa, Oryza sativa
  G3836 polypeptide
MADHHGGHHADGHRRQQQLQGEAADQAAAEIIKEQDRLLPIANVGRIMKQILPPNAKISKEAKETMQECVSEFISFVTGEASDKCHKEKRKTVNGDDVCWAFGALGFDDYVDPMRRYLNKYRELEGDRAAAAATSRSGAGAAAGPDHPSSSSSAAAATAGHFMFNAMDRSTDSSRQF

SEQ ID NO: 5114 - protein, 90 aa, Oryza sativa
  G3836 CCAAT-binding domain
KEQDRLLPIANVGRIMKQILPPNAKISKEAKETMQECVSEFISFVTGEASDKCHKEKRKTVNGDDVCWAFGALGFDDYVDPMRRYLNKYR

SEQ ID NO: 5115 - DNA, 1405 bp, Zea mays
  G3922
tgggaccctcgaggccggccgggatacgattccgaagaaggtagcgacccacgcgcgcgggccagaggccggaagagggagatacaggttaatttttaggtaccagatcatctgatttctcagaagcaaaatgttgtttggagctcagtgacaccatcttgtaatgcctgtgattttacgggaaatggaggatcattctgtccatcccatgtctaagtctaaccatggctccttgtcaggaaatggttatgagatgaaacattcaggccataaagtttgcgatagggattcatcatcggagtctgatcggtctcaccaagaagcatcagcagcaagtgaaagcagtccaaatgaacacacatcaactcaatcagacaatgatgaagatcatgggaaagataatcaggacacaatgaagccagtattgtccttggggaaggaaggctctgcctttttggccccaaaattacattacagcccatcttttgcttgtattccttatactgctgatgcttattatagtggggttggggtctcgacaggatatgctccacatgccattgtatgttcactcttaatctttcagtttctgtcttcctggccacattctgtccatccccagcaaaatgatacaacgaacactccgggtatgttacctgtggaacctgcagaagaaccaatatatgttaatgcaaaacaataccatgcaatccttaggaggaggcaaacacgtgctaaattggaggcccagaacaagatggtgaaaaatcggaagccatatcttcatgagtcccgacatcgtcatgccatgaaacgggctcgtggatcaggaggacggttcctcaacacaaagcagctccaggagcagaaccagcagtatcaggcatcgagtggttcattgtgctcaaagatcattgccaacagcataatctcccaaagtggccccacctgcacgccctcttctgacactgcaggtcttcagcagccagccaggaccgcggctgcttgccctcggtgggcttccgccccacagccaacttcagtgagcaaggtggaggcggctcgaagctggtcgtgaacggcatgcagcagcgtgtttccaccataaggtgaagagaagtgggcacgacaccattcccaggcgcgcactgcctgtggcaactcatccttggcttttgaaactatggatatgcaatggacatgtagcttcgagttcctcagaataaccaaacgtgaagaatatgcaaagtccttttgagatttgctgtagctgaaagaactgtggttaggttgagtttcttcctggagactgatccatacatgacatgctacctcgtgctgagtttctgaggtgaagccatcgaaacatgaccgtgtggttcagtaaaaaaaaaaaaaaaaaaaa

SEQ ID NO: 5116 - protein, 304 aa, Zea mays
  G3922 polypeptide
MPVILREMEDHSVHPMSKSNHGSLSGNGYEMKHSGHKVCDRDSSSESDRSHQEASAASESSPNEHTSTQSDNDEDHGKDNQDTMKPVLSLGKEGSAFLAPKLHYSPSFACIPYTADAYYSGVGVSTGYAPHAIVCSLLIFQFLSSWPHSVHPQQNDTTNTPGMLPVEPAEEPIYVNAKQYHAILRRRQTRAKLEAQNKMVKNRKPYLHESRHRHAMKRARGSGGRFLNTKQLQEQNQQYQASSGSLCSKIIANSIISQSGPTCTPSSDTAGLQQPARTAAACPRWASAPQPTSVSKVEAARSWS

SEQ ID NO: 5117 - protein, 60 aa, Zea mays; identical to SEQ ID NO: 3750
  G3922 CCAAT-binding domain

SEQ ID NO: 5118 - DNA, 755 bp, Sorghum bicolor
  G3910
aatccgatcactgtctccggaacaccctagcaatggagcccaaatccaccacccctcccccgcctccggtcatgggcgcgcccgtcgcgtaccctccgccccccggcgccgcgtaccccgccgggccgtacgcgcacgcgccggcagccgcgctgtaccctcctcccccgccgccgccggctcccccaacctcgcagcagggcgccgcggcggcgcagcagctgcagctcttctgggcggagcagtaccgcgagatcgaggccaccaccgacttcaagaaccacaacctgccgctggcccgcatcaagaagatcatgaaggccgacgaggacgtgcgcatgatcgccgccgaggcgcccgtcgtcttcgcccgcgcctgcgagatgttcatcctcgagctcacccaccgcggctgggcgcacgccgaggagaacaagcgccgcaccctgcagaagtccgacatcgccgccgccgtcgcgcgcaccgaggtcttcgacttcctcgtcgacatcgtgccgcgggacgaggccaaggaagccgactccgccgccgccatgggaccagccgggatcccgcaccccgccgccggcctgcccgccaccgaccccatgggctactactacgtccagccgcagtaacgaatttggcttcgcttccatggagcctctgcggtttttatttagtaaattaatttaattactactgagactgccctgttgttacccatgttctcctgttgccacccaataactcta

SEQ ID NO: 5119 - protein, 201 aa, Sorghum bicolor
  G3910 polypeptide
MEPKSTTPPPPPVMGAPVAYPPPPGAAYPAGPYAHAPAAALYPPPPPPPAPPTSQQGAAAAQQLQLFWAEQYREIEATTDFKNHNLPLARIKKIMKADEDVRMIAAEAPVVFARACEMFILELTHRGWAHAEENKRRTLQKSDIAAAVARTEVFDFLVDIVPRDEAKEADSAAAMGPAGIPHPAAGLPATDPMGYYYVQPQ

SEQ ID NO: 5120 - protein, 98 aa, Sorghum bicolor
  G3910 CCAAT-binding domain
REIEATTDFKNHNLPLARIKKIMKADEDVRMIAAEAPVVFARACEMFILELTHRGWAHAEENKRRTLQKSDIAAAVARTEVFDFLVDIVPRDEAKEAD

SEQ ID NO: 5121 - DNA, 1176 bp, Physcomitrella patens
  G3867
cagcatcctcacatcccgccttcctctgcaccccagatgtcgcatcctggcgccgtcatgcctttacagatgcactacccgcaagcccagcaacagatgatgccgcagcttggtgatcagcagatgcagccgcagcttcattatcagcaaattcagaaacagcagctgtcccagttctggcagcagcaaatgcaggaaatggagcaagtcaatgattttaagacccatcagctaccactggcacgcatcaaaaaaatcatgaagtcggatgaagatgttaagatgatcgcagccgaagctccagtgctgttttcaaaagcttgtgagatgtttattttagaattgacactgcgctcttggattcatacggaggaaaataagcgaaggacactacaaagaaatgatattgcaggggctatcactaggggagacatcttcgactttcttgttgacatcgttccacgtgacgagttgaaggaagaagatttgggtgtgccatggactggtgttccaggggatggttctgtaccttacggaggaatattctatccacccatggctggacagcaaatgcatcattctatgggggctcctgagatgatggttgggcagccaccaaacccacaaatgatgtatcagcctccacagactgcctttgtccccgagcagcagcaacagtgaatgcattaccacctagagaacgctgagcatcgaagacgggacaactcaaggaaagggctatcgcatcgagattctttcgtcacgtgggaatggtatttatcatactgttgctaccatctgtcattcttatggcaaaaggggtcacaggatcaggattttacctttcactacagcgcttttgtgttggctttcaactatattttaaggaaatcgtagctgtaggcggtgatgcgacagttctgagcactgctaattctagcagagtttatgtttggtttagcaagtcatgaagggcacaaagggacccgacccctccatggatctggtagaaatttgtgaatagtgatactagtgcaggcataattattagcatgtgcaggagttgctcttaatgttaggttcgaggatcgggtatccattttcttagtaccattgtttcttttatgtctccctggttttatctttcagactgaaaaaaaaaaaaaaaaaaaaaaa

SEQ ID NO: 5122 - protein, 214 aa, Physcomitrella patens
  G3867 polypeptide
MSHPGAVMPLQMHYPQAQQQMMPQLGDQQMQPQLHYQQIQKQQLSQFWQQQMQEMEQVNDFKTHQLPLARIKKIMKSDEDVKMIAAEAPVLFSKACEMFILELTLRSWIHTEENKRRTLQRNDIAGAITRGDIFDFLVDIVPRDELKEEDLGVPWTGVPGDGSVPYGGIFYPPMAGQQMHHSMGAPEMMVGQPPNPQMMYQPPQTAFVPEQQQQ

SEQ ID NO: 5123 - protein, 97 aa, Physcomitrella patens
  G3867 CCAAT-binding domain
QEMEQVNDFKTHQLPLARIKKIMKSDEDVKMIAAEAPVLFSKACEMFILELTLRSWIHTEENKRRTLQRNDIAGAITRGDIFDFLVDIVPRDELKEE

SEQ ID NO: 5124 - DNA, 1348 bp, Oryza sativa
  G3390
cttcagaggcttcacctttcatcagcttagctagctagctgctcgatccggcggcgtgatcgatcgatctctctgattctatcaggtgttcgaccagattccatcgatggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctagctagcacgctgatgcagctagcgttttttttgctcattcgcttgcttgcttaattat

SEQ ID NO: 5125 - protein, 394 aa, Oryza sativa
  G3390 polypeptide
MDSTSCLLDDASSGASTGKKAAAAAASKALQRVGSGASAVMDAAEPGAEADSGGERRGGGGGKLPSSKYKGVVPQPNGRWGAQIYERHQRVWLGTFTGEAEAARAYDVAAQRFRGRDAVTNFRPLAESDPEAAVELRFLASRSKAEVVDMLRKHTYLEELTQNKRAFAAISPPPPKHPASSPTSSSAAREHLFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAVGFYRAAGKNAQLFIDCKVRAKPTTAAAAAAFLSAVAAAAAPPPAVKAIRLFGVDLLTAAAPELQDAGGAAMTKSKRAMDAMAESQAHVVFKKQCIELALT

SEQ ID NO: 5126 - protein, 66 aa, Oryza sativa
  G3390 AP2 domain
SSKYKGVVPQPNGRWGAQIYERHQRVWLGTFTGEAEAARAYDVAAQRFRGRDAVTNFRPLAESDPE

SEQ ID NO: 5127 - protein, 103 aa, Oryza sativa
  G3390 B3 domain
LFDKTVTPSDVGKLNRLVIPKQHAEKHFPLQLPPPTTTSSVAAAADAAAGGGDCKGVLLNFEDAAGKVWKFRYSYWNSSQSYVLTKGWSRFVKEKGLHAGDAV

SEQ ID NO: 5128 - protein, 16 aa, Arabidopsis thaliana
  G1792 EDLL domain, amino acids 117-132
VFEFEYLDDKVLEELL

SEQ ID NO: 5129 - protein, 16 aa, Arabidopsis thaliana
  G1795 EDLL domain, amino acids 104-119
VFEFEYLDDSVLEELL

SEQ ID NO: 5130 - protein, 16 aa, Arabidopsis thaliana
  G30 EDLL domain, amino acids 100-115
VFEFEYLDDSVLDELL

SEQ ID NO: 5131 - protein, 16 aa, Oryza sativa
  G3383 EDLL domain, amino acids 101-116
KIEFEYLDDKVLDDLL

SEQ ID NO: 5132 - protein, 16 aa, Arabidopsis thaliana
  G1791 EDLL domain, amino acids 108-123
VIEFEYLDDSLLEELL

SEQ ID NO: 5133 - protein, 16 aa, Glycine max
  G3519 EDLL domain, amino acids 128-143
TFELEYLDNKLLEELL

SEQ ID NO: 5134 - protein, 16 aa, Oryza sativa
  G3381 EDLL domain, amino acids 109-124
PIEFEYLDDHVLQEML

SEQ ID NO: 5135 - protein, 16 aa, Oryza sativa
  G3737 EDLL domain, amino acids 101-116
KVELVYLDDKVLDELL

SEQ ID NO: 5136 - protein, 16 aa, Oryza sativa
  G3515 EDLL domain, amino acids 116-131
KVELECLDDKVLEDLL

SEQ ID NO: 5137 - protein, 16 aa, Zea mays
  G3516 EDLL domain, amino acids 107-122
KVELECLDDRVLEELL

SEQ ID NO: 5138 - protein, 16 aa, Glycine max
  G3520 EDLL domain, amino acids 109-124
VIEFECLDDKLLEDLL

SEQ ID NO: 5139 - protein, 16 aa, Zea mays
  G3517 EDLL domain, amino acids 103-118
VIEFEYLDDEVLQEML

SEQ ID NO: 5140 - protein, 16 aa, Glycine max
  G3518 EDLL domain, amino acids 135-150
TFELEYFDNKLLEELL

SEQ ID NO: 5141 - protein, 16 aa, Zea mays
  G3739 EDLL domain, amino acids 107-122
VIELEYLDDEVLQEML

SEQ ID NO: 5142 - protein, 16 aa, Oryza sativa
  G3380 EDLL domain, amino acids 103-118
VIELECLDDQVLQEML

SEQ ID NO: 5143 - protein, 16 aa, Zea mays
  G3794 EDLL domain, amino acids 102-117
VIELECLDDQVLQEML

SEQ ID NO: 5144 - DNA, 918 bp, Oryza sativa
  G3406
atggcaggtctcgacctcggcaccgccgcgacgcgctacgtccaccagctccaccacctccaccccgacctccagctgcagcacagctacgccaagcagcacgagccgtccgacgacgaccccaacggcagcggcggcggcggcaacagcaacggcgggccgtacggggaccatgacggcgggtcctcgtcgtcaggtcctgccaccgacggcgcggtcggcgggcccggcgacgtggtggcgcgccggccgcgggggcgcccgcctggctccaagaacaagccgaagccgccggtgatcatcacgcgggagagcgccaacacgctgcgcgcccacatcctggaggtcgggagcggctgcgacgtgttcgagtgcgtctccacgtacgcgcgccggcggcagcgcggcgtgtgcgtgctgagcggcagcggcgtggtcaccaacgtgacgctgcgtcagccgtcggcgcccgcgggcgccgtcgtgtcgctgcacgggaggttcgagatcctgtcgctctcgggctccttcctcccgccgccggctccccccggcgccaccagcctcaccatcttcctcgccgggggccagggacaggtcgtcggcggcaacgtcgtcggcgcgctctacgccgcgggcccggtcatcgtcatcgcggcgtccttcgccaacgtcgcctacgagcgcctcccactggaggaggaggaggcgccgccgccgcaggccggcctgcagatgcagcagcccggcggcggcgccgatgctggtggcatgggtggcgcgttcccgccggacccgtctgccgccggcctcccgttcttcaacctgccgctcaacaacatgcccggtggcggcggctcacagctccctcccggcgccgacggccatggctgggccggcgcacggccaccgttctga

SEQ ID NO: 5145 - protein, 305 aa, Oryza sativa
  G3406,At-hook amino acids 82-90,2nd cons. domain 90-232,DUF296 109-227
MAGLDLGTAATRYVHQLHHLHPDLQLQHSYAKQHEPSDDDPNGSGGGGNSNGGPYGDHDGGSSSSGPATDGAVGGPGDVVARRPRGRPPGSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPLEEEEAPPPQAGLQMQQPGGGADAGGMGGAFPPDPSAAGLPFFNLPLNNMPGGGGSQLPPGADGHGWAGARPPF

SEQ ID NO: 5146 - protein, 9 aa, Oryza sativa
  G3406 At-hook domain amino acids 82-90
RRPRGRPPG

SEQ ID NO: 5147 - protein, 143 aa, Oryza sativa
  G3406 2nd conserved domain
GSKNKPKPPVIITRESANTLRAHILEVGSGCDVFECVSTYARRRQRGVCVLSGSGVVTNVTLRQPSAPAGAVVSLHGRFEILSLSGSFLPPPAPPGATSLTIFLAGGQGQVVGGNVVGALYAAGPVIVIAASFANVAYERLPL

SEQ ID NO: 5148 - protein, 144 aa, Arabidopsis thaliana
  G1667 second conserved domain
GSKNKPKPPIIVTHDSPNSLRANAVEISSGCDICETLSDFARRKQRGLCILSANGCVTNVTLRQPASSGAIVTLHGRYEILSLLGSILPPPAPLGITGLTIYLAGPQGQVVGGGVVGGLIASGPVVLMAASFMNAVFDRLPMDD

SEQ ID NO: 5149 - protein, 144 aa, Arabidopsis thaliana
  G1069 second conserved domain
GSKNKPKAPIFVTRDSPNALRSHVLEISDGSDVADTIAHFSRRRQRGVCVLSGTGSVANVTLRQAAAPGGVVSLQGRFEILSLTGAFLPGPSPPGSTGLTVYLAGVQGQVVGGSVVGPLLAIGSVMVIAATFSNATYERLPMEE

SEQ ID NO: 5150 - DNA, 862 bp, Arabidopsis thaliana
  G3001
gaactcattttctctcttcttcttcatcatcatcatcaatggatgagataaaaccaaagaaagaagagaattccaaacgacgtcgtaacgtcaaacccatttgccgtgaaactggagaccacgtccattatcttccaacatgcaaaaccaagcccaaacccacgcgtactcatcacgcgccaccaccgatcctcgactcaatcttcaaagtcactcacaagccacactactacgaatgcaggaagaatcacgccgctgatatcggaaccaccgcttacgacggctgcggcgagtttgttagctccaccggtgaagaagattctttaaactgcgccgcatgtggctgtcaccgtaacttccaccgtgaagagttaatcccggagaacggcggcgttactgagacggttcttgaagttctcaagatttcatcgtgtcagtttcgtcggatcttttgctcaccttacggcggtggaaaaagcgaaggaaagaagaagaagaaggagaaggagagttatggaggggatccgataattaaagatcgattcggcggtgcggaggaggaggaggggatagtgaagaggttgaaaacgaagttcacggcggagcaaacggagaaaatgagggattatgcggagaagcttcggtggaaggtgagacctgagaggcaggaggaggttgaagagttttgtgtagagattggagtgaatcggaagaattttaggatttggatgaataatcacaaggataaaattataattgatgaatgattatttaccaaacttaattgtgttacttttcttttcattctactttgttttaatttgtgtttgatttagtgtaatgtataaataacaagctcatt

SEQ ID NO: 5151 - protein, 242 aa, Arabidopsis thaliana
  G3001 polypeptide
MDEIKPKKEENSKRRRNVKPICRETGDHVHYLPTCKTKPKPTRTHHAPPPILDSIFKVTHKPHYYECRKNHAADIGTTAYDGCGEFVSSTGEEDSLNCAACGCHRNFHREELIPENGGVTETVLEVLKISSCQFRRIFCSPYGGGKSEGKKKKKEKESYGGDPIIKDRFGGAEEEEGIVKRLKTKFTAEQTEKMRDYAEKLRWKVRPERQEEVEEFCVEIGVNRKNFRIWMNNHKDKIIIDE

SEQ ID NO: 5152 - protein, 52 aa, Arabidopsis thaliana
  G3001 ZF domain
PHYYECRKNHAADIGTTAYDGCGEFVSSTGEEDSLNCAACGCHRNFHREELI

SEQ ID NO: 5153 - protein, 64 aa, Arabidopsis thaliana
  G3001 HB domain
VKRLKTKFTAEQTEKMRDYAEKLRWKVRPERQEEVEEFCVEIGVNRKNFRIWMNNHKDKIIIDE

SEQ ID NO: 5154 - DNA, 782 bp, Arabidopsis thaliana
  G2995
cagagtataaacgcactagtgagtgaaataagaatcagacatgagctcgttatcaaaaccaaacagacaatttttgtcaccaacaacaaacaaccaagacaccggcagagaacaaacaatcgcctgcgcccgagatatggttgtcttgtacaacgagtgccttaaaaaccacgcggtcagtctcggaggccacgctcttgacggctgcggtgagttcacaccaaagtcaaccaccatcctcacggaccctccgtcccttaggtgcgatgcttgtggctgccatcgcaacttccaccgtcgtagtccttctgacggcttcagtcagcaccggtcaccaccgtctccgttacagctgcagccactcgcccctgttccgaacttgcttctctctcttagctccggtttctttggaccctcggatcaagaagtcaagaacaaatttacggtggaaagggatgttaggaagactgcgatgattaagaaacataagaggacgaaattcacggcggagcagaaggtgaagatgagaggtttcgcggagagagcggggtggaagattaacggctgggatgagaagtgggtgagagagttttgtagtgaagttggaatagagagaaaagttcttaaggtttggatccacaacaataagtactttaacaacgggaggagcagagacacgacgtcctctatgtctttgaatttgaagttgtagatctctttacagtgatgggtcttcatcttcttgagataaggaaaaaccgaaacaaaaagaggttacggta

SEQ ID NO: 5155 - protein, 191 aa, Arabidopsis thaliana
  G2995 polypeptide
MVVLYNECLKNHAVSLGGHALDGCGEFTPKSTTILTDPPSLRCDACGCHRNFHRRSPSDGFSQHRSPPSPLQLQPLAPVPNLLLSLSSGFFGPSDQEVKNKFTVERDVRKTAMIKKHKRTKFTAEQKVKMRGFAERAGWKINGWDEKWVREFCSEVGIERKVLKVWIHNNKYFNNGRSRDTTSSMSLNLKL

SEQ ID NO: 5156 - protein, 56 aa, Arabidopsis thaliana
  G2995 ZF domain
VLYNECLKNHAVSLGGHALDGCGEFTPKSTTILTDPPSLRCDACGCHRNFHRRSPS

SEQ ID NO: 5157 - protein, 64 aa, Arabidopsis thaliana
  G2995 HB domain
KKHKRTKFTAEQKVKMRGFAERAGWKINGWDEKWVREFCSEVGIERKVLKVWIHNNKYFNNGRS

SEQ ID NO: 5158 - DNA, 1353 bp, Arabidopsis thaliana
  G2149
aatcttttatttttcttttagaaaccaaacttttcagatttctctctctccatttggcgatagaagaagtcatgtaccaatcatcatcctccacgtcatcatcatcgcagagatcatcgcttcccggcggcggaggactgatccgttacggctcagctccgggatcgtttctaaactctgtggttgacgaagtcatcggaggaggctcatcaaacgctcgtgacttcaccggctatcaaccgtcgtcggataacttcatcggtaactttttcaccggagctgctgactcatcctcgctgagatccgattcgacgacttgtggagtcaacaactcatccgacggacagaaacagctaggcaataacaataataataatagtaataaagatatcttcctcgacagatcctacggtggattcaacgagatctcgcaacaacacaagagcaacgacatcggaggaggaaacagctcaggatcttactctctcgctagacaacgtagctctcccgccgatttcttcacctacctcgcctcagataaaaacaatttctcgttgaaccaaccaaccagtgattatagtccgcaaggagggtctaatgggggacgaggacattccagattgaagtctcagctaagcttcacgaatcacgactctctggctcggatcaacgaggtcaatgagaccccagtccacgacggttcaggccattcgttttctgcggctagctttggtgcagccactactgattcttgggatgacggttccggttcgatagggtttaccgtgactaggcccagtaaacgatccaaggacatggactctggtctcttttcgcagtatagtcttccttcagacacttcaatgaactacatggataacttcatgcagcttccagaagattctgtaccctgcaaaatccgggccaaacgcggctgcgccacccatcctagaagcatcgctgagcgggagaggagaacgagaataagtgggaagctaaagaagctacaagatcttgtccccaacatggataagcaaacaagctattcagacatgctggatttagctgtacaacacatcaaaggccttcagcatcaacttcagaatttgaaaaaagatcaagagaattgcacgtgtgggtgcagtgagaaaccaagctagctcaaacccaaaggtagggtcatcctaattttatttgcattgttccgattttatcatatgagagaattagagaagatgtaaataaaatagattatattaaatgtctaatcctcttataattaagctcctcattcgttatcattataagatagaacagtgacaattgtccattatgtttttgtttcaagtttat

SEQ ID NO: 5159 - protein, 362 aa, Arabidopsis thaliana
  G2149 polypeptide
MYQSSSSTSSSSQRSSLPGGGGLIRYGSAPGSFLNSVVDEVIGGGSSNARDFTGYQPSSDNFIGNFFTGAADSSSLRSDSTTCGVNNSSDGQKQLGNNNNNNSNKDIFLDRSYGGFNEISQQHKSNDIGGGNSSGSYSLARQRSSPADFFTYLASDKNNFSLNQPTSDYSPQGGSNGGRGHSRLKSQLSFTNHDSLARINEVNETPVHDGSGHSFSAASFGAATTDSWDDGSGSIGFTVTRPSKRSKDMDSGLFSQYSLPSDTSMNYMDNFMQLPEDSVPCKIRAKRGCATHPRSIAERERRTRISGKLKKLQDLVPNMDKQTSYSDMLDLAVQHIKGLQHQLQNLKKDQENCTCGCSEKPS

SEQ ID NO: 5160 - protein, 59 aa, Arabidopsis thaliana
  G2149 bHLH domain
KRGCATHPRSIAERERRTRISGKLKKLQDLVPNMDKQTSYSDMLDLAVQHIKGLQHQLQ

SEQ ID NO: 5161 - DNA, 936 bp, Antirrhinum majus
  G3982
atttcatttgaagagatgggaagggggaagattgtgatccaaagaatcgacaaatcgacgagtaggcaagtgactttttcgaaaaggaggagtggacttttgaagaaggccaaagagcttgctattctttgtgatgcagaagttggagttgttatattttccagcactgggaagctctacgaattttcaagcaccagcatgaaatcaattattgaacgacacactaaaaccaaagaggaccatcatcagctgcttaatcatggctcggaggtcaagttttggcaaagggaggctgcgactttaaggcaacaattacaggatttgcaagaaaaccatcggaagttgatgggagaagagctacaagggttgaatgttgaagatctacacagattggagaaccaactagagatgagtttgcgaggcgtgcgcatgaaaaaggtacagatgttaaccgatgaggttcatgaacttaggagaaagggacatctcatccatcaagagaacaatgagctctatgagaaggtaaaactccttcaacaagaaaacaaggaattgtgtaaaaaggcttacggcacaagggatgtaagtgcagcaaatggaactgccttggttccatttggtttcgcaattggtagggaacaattcgagccaatccagcttcatttaagccagcctgaaccagaaaatattgaaacatcaagagcctcaggatcaaagtaaattatttttggactaccttacaaaactacatgtgcttgtgtatgtatcatccagcactaggcaattaagtaacttgtattttgaatgcacgcctagacattaatatttccaaattgtcacaatattcgacagagctttcatttggcgatacctgcaagaaaattcactgtactcaatttaagagttcatataatgctatgtgtaattgtttttagc

SEQ ID NO: 5162 - protein, 234 aa, Antirrhinum majus
  G3982 polypeptide
MGRGKIVIQRIDKSTSRQVTFSKRRSGLLKKAKELAILCDAEVGVVIFSSTGKLYEFSSTSMKSIIERHTKTKEDHHQLLNHGSEVKFWQREAATLRQQLQDLQENHRKLMGEELQGLNVEDLHRLENQLEMSLRGVRMKKVQMLTDEVHELRRKGHLIHQENNELYEKVKLLQQENKELCKKAYGTRDVSAANGTALVPFGFAIGREQFEPIQLHLSQPEPENIETSRASGSK

SEQ ID NO: 5163 - protein, 56 aa, Antirrhinum majus
  G3982 MADS domain
GRGKIVIQRIDKSTSRQVTFSKRRSGLLKKAKELAILCDAEVGVVIFSSTGKLYEF

SEQ ID NO: 5164 - protein, 7 aa, Arabidopsis thaliana
  misc_feature (2)..(2): Xaa can be any naturally occurring amino acid
  misc_feature (4)..(4): Xaa can be any naturally occurring amino acid
  misc_feature (6)..(6): Xaa can be any naturally occurring amino acid
  G1274 potential zinc ligands
CXCXHXH

SEQ ID NO: 5165 - protein, 6 aa, Arabidopsis thaliana
  misc_feature (3)..(3): Xaa can be any naturally occurring amino acid
  misc_feature (5)..(6): Xaa can be any naturally occurring amino acid
  homeodomain signature sequence
WFXNXX

SEQ ID NO: 5166 - DNA, 1302 bp, Oryza sativa
  Predicted polypeptide sequence is orthologous to G28, G22, G1006
gacaattccgctagtccgagtcaaaacaaaatcaaattcaaattcacgggataattcaaagatgctgcttaatcaggcgtcgagagaggtggccgcgctggacagcatccggcaccacctcctggaggaggaggaggagacgccggcgacggcgccggcgccgacgcggcggccggtgtactgccggagctcaagcttcggcagcctcgtggccgaccagtggagcgagtcgctgccgttccggcccaacgacgccgaggacatggtcgtgtacggcgccctccgcgacgccttctcctccggctggctccccgacggctcattcgccgccgtcaagccggagtcgcaggactcctacgacgggtcctccatcggcagcttcctcgcgtcgtcgtcgtccgaggcggggacgcccggggaggtgacgtcgacggaggcgacggtgacgccggggatcagggagggcgagggcgaggccgtggcggtggcgtcgagggggaagcactaccgcggggtgaggcagcggccgtggggcaagttcgcggcggagatcagggacccggccaagaacggcgcgcgcgtgtggctcggcacgttcgactccgccgaggaggccgccgtggcgtacgaccgcgccgcctaccgcatgcgcggctcacgcgcgctcctcaacttcccgctccgcatcggctccgagatcgccgccgcggccgccgccgccgccgcgggcaacaagcggccatatcccgacccggcgagctccggctcttcttccccttcatcctcttcctcctcgtcgtcgtcttcctcctccgggtcaccgaagcggaggaagagaggcgaggccgcggccgcgtccatggccatggcactggttccaccaccgccaccaccggcgcaggcaccggtgcagctcgccctcccggcccagccatggttcgccgccggtccgatccagcagctggtgagctaagtggcgatgtggtagtggtagtggtgatttagccatcttgtgcgactgtgcgtgatcgattgctgcttgatgggtcgagcaagttcagaacagagcatcactctctgcagaatagaagaagttcatgaacagagcaatgcactgctccaagaaatgtgacgagttccaggcaatcacgccattgttcttggatgattgcgcagcaccagaaaaaagggaaaaaaaagattgtttgtgaaatgtggtgaggttttgtaagacttgcacaaaatttgagaaaaagaaaaagatcaatacatataaaatcttactagaaaaaagactttccc

SEQ ID NO: 5167 - DNA, 957 bp, Oryza sativa; identical to SEQ ID NO: 2167
  Predicted polypeptide sequence is orthologous to G28, G22, G1006

SEQ ID NO: 5168 - DNA, 810 bp, Oryza sativa
  Predicted polypeptide sequence is orthologous to G28, G22, G1006
cggccgaatcctttgtgaccacgcgtcgcacactgcaaactactctctcggtctctccatccatccacctctctcgatcgtctcatgagctagcgcgccccgcgcgtacagccccgcatgtctctctccttggggtttagcgccggcgccggcgtcggtgccgatcgcctcgccgccgcgcccgcgctccaggccgccggtgctctgccgccacgcgtggacgtgtctctgtcgctggcgcgcgcggccaacgggcagccgtcgtcgtacctcccgctcaacgagaacgactcgctggacatggtcctcttcgacgtcctccgcgaggcctccgcggtggcggcgctgtcgtcgtcgtcgtcgtcgtcgccggagctgggcgcgcggacgacggcgccggtggtcgccggccaccccgccgggcgcaagggtggcggcggcggaggcggaggcaggggagcggcggcgaggggcggcgccgctggcgggcggcactaccgcggtgtgaggcggcggccgtgggggaagtacgccgcggagatccgtgacccgacgcggcacggcgcgcggctgtggctcggcaccttcggcacggccgaggaggccgccgcggcgtacgaccgcgccgcgttccgcatgcggggcgccaaggcgctgctcaactttcccgacggattgtgccggtgaacgggcccggttcgaggccagcggggcccggaagcaggtcggatgaacgaaggtaaatgcgtaaataacttgagaaccattggactgtacaggcgtagaaaggggtcaaaccaggttattgga

SEQ ID NO: 5169 - DNA, 452 bp, Oryza sativa
  Predicted polypeptide sequence is orthologous to G28
cttcaaccacattgattatgctaacaagattggccatgagatagatatggaaatggcatgggacgatgatgtcctccaagacgatgaatcagctggatcatcaccattggagacaccggcaggtctagcacaaatcaataccgtgcatgtgaaggaggagatggatctaattgagatggtcacacgcacacaatcttgtggctagtggatgagaaaataagcagtgatgtaactatgtgtgctactaaatacacattacacgacctttcggagtgcaacctggggaacctatatggtgaagaaatattagaaaaataagaaaaacaaacatgtatgggttcgaacgaagcacttgattatatattatattgtaactaatattctaagtttttctcttcgtacttttggcatgcactctctctttaataagtactttatttttaccttttctc

SEQ ID NO: 5170 - DNA, 837 bp, Oryza sativa; identical to SEQ ID NO: 1863
  Predicted polypeptide sequence is orthologous to G481, G482, G485, G1364, G2345

SEQ ID NO: 5171 - DNA, 1082 bp, Oryza sativa
  Predicted polypeptide sequence is orthologous to G481, G482, G485, G1364, G2345
aaccgccgtctcctcctccccccactctcgccttcccccctctctctcctctcctctccgcgactccctccacccccgcgcgcgcgcgttttttttttttcgtaagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaccggcaagatcgccaaggacgccaaggagaccctgcaggagtgcgtctcggagttcatctccttcgtcaccagcgaggcgagcgacaaatgtcagaaggagaagcgcaagaccatcaacggggaagatctcctctttgcgatgggtacgcttggctttgaggagtacgttgatccgttgaagatctatttacacaagtacagagagatggagggtgatagtaagctgtcctcaaaggctggtgatggttcagtaaagaaggatacaattggtccgcacagtggcgctagtagctcaagtgcgcaagggatggttggggcttacacccaagggatgggttatatgcaacctcagtatcataatggggacacctaaagatgaggacagtgaaaattttcagtaactggtgtcctctgtgagttattatccatctgttaaggaagaacccacattagggccatatttattagtagaagactaaagcacttgaagggtgttggtttagaaagggtgttaacagttggctgtggcgattgcttcacagatgtaaattgcttcataagtggtttaatgcttgtttttgcctgtatattcagagcaattttcacatattggtagttctgcaatcttttgcattcccatacatgtatcaggtggcacaaatctattgcaagtaccctagcattgaataatgctggttaacatataattctgtaacgtccgtattgtttcgactgtgatgcttgccgtatgggcaatggcatgtgttctagagggggcattcaatatttaggtatctcaagaatgtaccaaatactcccttcgttcaattc

SEQ ID NO: 5172 - DNA, 1225 bp, Oryza sativa
  Predicted polypeptide sequence is orthologous to G481, G482, G485, G1364, G2345
gaccccgaccccttcaatcgcgcccgcctcagccgccttctcttctccagcgtccgatctccccctctcgcctctccgcctcacctccgctccgcttcccacccccgcttcctctctctctcctctccccctctctctctctctctctcctcctcgcttcaccacctcgcgcccaacccccctctctctcctctccacgtcgcgccctctccgcgcgcgcccgcgcttctatataaggaggggggaggtgggatggcggatgggccggggagcccggggggagggggggggagccacgagagcgggagcccgagggggggagggggaggagggggaggtgggggtgggggtgggggggtgagggagcaggacaggttcctccccatcgccaacatcagccgcatcatgaagaaggccatcccggccaacgggaagatcgccaaggacgccaaggagaccgtgcaggagtgcgtctccgagttcatctccttcatcaccagcgaggcgagcgataaatgccagagggagaagcgcaagaccatcaacggcgacgacttgctgtgggcgatggccacgctgggcttcgaggactacatcgagcccctcaaggtctacctgcagaagtacagagagatggagggtgatagtaaattaactgcaaaggctggtgatggctctgtgaaaaaggatgtacttggttctcatggaggaagcagttcaagtgcccaagggatgggccaacaagcagcatacaatcaaggaatgggttatatgcaacctcagtaccataatggggatgtctcaaactgaagataggaccttttcatgcaactgttgctagcgcaggtggattttatttggtgctgcagtcgttagctaatatatatacctacacctcatggtgagcagtgaaggaagtaacttgctaccacctctaggtcccatgtttgtcaaccaggaactgatgctgcttggaagcgtcgagccaaggctgcttctcagatgtaaattactccccgtgaggatagtttcggttcgtggtctagctctgttgttgtatgtatattcaggataatttaacaattggtctttggctgtcattcggttccatataatctgtattgggaggcataaatattcatgttgtatttcgtcctgaactagcgtgttgtactattgagaaatagatgctctctgtaatggtagcaattttactctgattccc

SEQ ID NO: 5173 - DNA, 558 bp, Oryza sativa
  Predicted polypeptide sequence is orthologous to G481, G482, G485, G1364, G2345
atgcaagggcttcctagggcgtcgtcgtcgtcaacctcggcgtcgagagatcgagacggcggcgatggcgatggcggcggcggcggcgtgacgatgacgaacgggcaggacaacctgctgccgatcgccaacgtgggccggatcatgaaggacgggctgccgccgcaggcgaagatatcgaagcgggccaaggagacgatccaggagtgcgcgacggagttcatcagcttcgtcaccggcgaggcgtcggagcggtgccggcgggagcggcggaagacggtgaacggcgacgacgtctgccacgccatgaggagcctcggcctcgaccactacgccgacgccatgcacaggtacctgcagaggtaccgcgagggcgaggagctcgccgcgtcgctcaacagcagcagcagcgccgccgccgccgccgccgccgccggcagcaggggcggtggcgccatacagatcgacgtgagagctgagctctccatcttcagatcaggcaacaaccaaggtaaaaagggtgttaactctcttttcgtggaggtgaaacttaactga

SEQ ID NO: 5174 - DNA, 932 bp, Oryza sativa
  Predicted polypeptide sequence is orthologous to G481, G482, G485, G1364, G2345
cccgcgccctcctctcctcttcgtcttcctcctcgcttcgcttcgactgcttcgatcgaggagatcgaggttgcgatgccggattcggacaacgagtcaggggggccgagcaacgcgggggagtacgcgtcggcgagggagcaggacaggttcctgccgatcgcgaacgtgagcaggatcatgaagagggcgctcccggcgaacgccaagatcagcaaggacgccaaggagacggtgcaggagtgcgtctcggagttcatctccttcatcaccggcgaggcctccgacaagtgccagcgggagaagcgcaagaccatcaacggcgacgacctcctctgggcgatgaccacgctcggcttcgaggactacatcgacccgctcaagctctacctccacaagttccgcgagctcgagggcgagaaggccatcggcgccgccggcagcggcggcggtggcgccgcctcctccggcggctccggctccggctccggctcgcaccaccaccaggatgcttcccggaacaatggcggatacggcatgtacggcggcggcggcggcatgatcatgatgatgggacagcctatgtacggctcgccgccggcgtcgtcagctgggtacgcgcagccgccgccgccccaccaccaccaccaccagatggtgatgggagggaaaggtgcgtatggccatggcggcggcggcggcggcgggccctccccgtcgtcgggatacggccggcaagacaggctatgagcttgctttcttggttggtgttttggtaattaattaatcagaggacatgtcgggttaattaatcttaatctctgttttttcactctttttttttacctttctttctctctcttttatctttccttttctcaatgtgctaaaatgagtcaattatatggctaaattctctactaattcgcttc

SEQ ID NO: 5175 - DNA, 1717 bp, Oryza sativa
  Predicted polypeptide sequence is orthologous to G481, G482, G485, G1364, G2345
tctcattctcataaaataatcatcccctgcctaactccataacaaagaaatgcatactcctcggtcattagtatatgttagtataaattaaataattaacaccttaaacaatatctcttcgtcgtagtttgatcatcacctaagattttttagtcttttcaaaaatgatcatcaagctaacaagtgtatctttatttatttgtgcaagaagtaaatgagcatcattgaatgcgctgcacacatgtaatgcaaacaaccaagttaatttttattggtgcaacgggcgcgcactatttaaaacgtgacgcaatgcagcgatagagcaccttgatagataagaattaatttcagcatgatgtagattttgttatccttaatctctactcactttgcataggtgataaattaaaccgctgaactattactacatggtttacatgaaaggtgatcgggtagggacgagaatgtcgcgacacacatgatatatatagtagcgtccttatgtttgctttgtgtccgcatcgataccgtcttcccactcgcatctcctcacctcctttccttctttaaaaggagagcatcaccactccatcctcaactcccataacacctcccccttctctctctctctaactacacactctctctctagctagctagctagctatagctagtgttgttagcttcacatgaagagtaggaagagctatgggctcttgctgagcccggtgggcagcccgccgtcggacaacgagtccggcgcggcggcggcggcggctgcggcgggcggcggcggctgcgggagcagcgccgggtatgttgtctacggcggcggcggcggtggggactcgccggcgaaggagcaggacaggttcctgccgatcgcgaacgtgagccgcatcatgaagcggtcgctgccggcgaacgccaagatctccaaggaggcgaaggagacggtgcaggagtgcgtgtcggagttcatcagcttcgttaccggcgaggcctccgacaagtgccagcgcgagaagcggaagaccatcaacggcgacgacctcctctgggccatgaccacgctggggttcgaggcctacgtcggcccgctcaagtcctacctcaaccgctaccgcgaggccgagggcgagaaggccgccgtgctcggcggcgccggcggcgccgccgcggcgcgccacggcgagggcggttgctgcggcggcggcggcggcgccgatggcgtcgtcatcgacgggcattccccgctcgccggcggcctgtcacactcacaccatggtcatcagcagcaggacggcggcggcgacgtcgggctcatgatgggcggcggcgccgccggcgtcgggtacaacgccggggccgggtcgacgacgacggcgttctacgcgccggcggcgacggcggcgtcagggaacaaggcgtactgcggcggcgacgggtcgagggtgatggagttcgagggcatcggcggcgaggaggagagcggaggcggaggcggcggcggcggcggcgagagggggttcgccggccacctccatggcgtgcaatggtgaagactaaagaggagtactaattagctagctaggcacacgcgtagttttattattacttaattaccgcgttaattaattgttgatgctgatgctgtttaaaattgattctccttttgcatgaaaatgtttgatggtatggtttaaaaattgaagaa

SEQ ID NO: 5176 - DNA, 1800 bp, Oryza sativa
  Predicted polypeptide sequence is orthologous to G481, G482, G485, G1364, G2345
aacttcaaatcctacttagcagaagagaagtgctatacgaacgaccaatgcattcgactagcgtacgtctcatctcatcggattggcctgtttggtagagttttagcttctaaatttagcttcaagctccagaagttttaagtggagttgtggagctgtctaaactcatctctacctctctaaattattttgtgagagttttactcagcttcgctcctattttaagtagagctgaaactgtttggctaagttttagctataggagaggtggagctggagctgtgattacttttgtgggtccagtttttttatagctaatcatggtcatataggagttggatgtgcaagtcgtatgcatggtcattctgtgctcggcttattaaaaaaattgtgtaaatataaaaaacgaaaagttatgcttaaagtactttaggtaataaagcaagtaaaaaaaataaataataatttaaaattttttgaatcagacgagtgattaaaagtgcaaacaaaaacttaaaattttttgtattatgggacggagggaataggactgcaagtttaactaaagtatcctataaattcaagtattcaaaatattatgctttgcctgctgctggctggtgcagcaaattggtcctggccccggtgcacggtcctacgtggcgagccgggcactcgcgcatgtcaggggggccaaggcgccgtcccacgtggcctcggcccacccagacggcggggatccgtccgacgtggcgatgatggacagacggttgagcgccaagtggcacacgcttatcagcaaacgaacggctggggtcggtccacgtagacgcctcgatacgttcttatccgcgcgatccaacggaccgatccccccacgccattccccaccccaccatctctctctctctctctcttctcttcttcttcctcctagactagtcagtctctcccaagaacacccactcctctagtctctctctctcgagagagaaaattgatgattcttgggatgattttgaggcgtctgatttgctgaagaggaggaggaggatgccggactcggacaacgactccggcgggccgagcaactacgcgggaggggagctgtcgtcgccgcgggagcaggacaggttcctgccgatcgcgaacgtgagcaggatcatgaagaaggcgctgccggcgaacgccaagatcagcaaggacgccaaggagacggtgcaggagtgcgtctccgaattcatctccttcatcaccggcgaggcctccgacaagtgccagcgcgagaagcgcaagaccatcaacggcgacgacctgctctgggccatgaccaccctcggcttcgaggactacgtcgaccccctcaagcactacctccacaagttccgcgagatcgagggcgagcgcgccgccgcctccaccaccggcgccggcaccagcgccgcctccaccacgccgccgcagcagcagcacaccgccaatgccgccggcggctacgccgggtacgccgccccgggagccggccccggcggcatgatgatgatgatggggcagcccatgtacggctcgccgccaccgccgccacagcagcagcagcagcaacaccaccacatggcaatgggaggaagaggcggcttcggtcatcatcccggcggcggcggcggcgggtcgtcgtcgtcgtcggggcacggtcggcaagacaggggcgcttgacatcgctccgagacgagtagcatgcaccatggtacatatatacagtaatcagcagctgttcatttttctatgattactagttgactt

SEQ ID NO: 5177 - DNA, 693 bp, Oryza sativa
  Predicted polypeptide sequence is orthologous to G481, G482, G485, G1364, G2345
taattttttttttttgaatttgaaacccaactttgcataaacttgtgtcagcatcacacctgcttgcgtaatagagtttagaaaagtttctcttagatctctttacccctctgaatttagcatatgcaggacagccggaaacggccaaatatggttagacacaaccacacaacacacgactgaactagaacctacaacaaatttggacatcctggctaacacaagaacatttcaaaaagaacgacgactaacattcgtggtaacaaggtattggaactttggaagcatcctgcttacaacataacaggatgctggagcgttctttccctaaaaacgatggttctccttcctagatgccattagcgtgccaatcagtatcacactcctcgtcctacatgccttcaaacgatgatccaggatctccattaagtacaacatctttctttactggcagttcagaagctcttgaaccctttgtgtcaccctccgtctcccggtagagcctgaggtagagcttgagaggctcgacatagtcctcgaatccgagcgtgcccattgaccagatcaggtcgtccccattgatggtcttgcgcttctccttgaggcacttgtcgcttgcttcgctggtgatgaagctgatgaactcggagacgcactcctggacggactccttggagtccttggcgatcttgc

SEQ ID NO: 5178 - DNA, 661 bp, Oryza sativa
  misc_feature (147)..(147): n is a, c, g, or t
  Predicted polypeptide sequence is orthologous to G867, G9, G993, G1930
ccgtcgtgggcgcgggagccactgttcgagaagccgtgacgcccagcgacgtcggcaagctcaaccgcctgctggtgcccaagcagcacgcggagaagcacttcccgctgcgcggacgagctccgacgcctccgccaccgccgccancgccacctgcaactctgcaagggcgtgctcctcaacttcgaggacggcgaggggaaggtgtggaggttccggtactcagtgctggaacaagcagccagagttacagtgctgacacaagggatggagccagattcagtgagggagaagggcctccagcagcacggcgacaccatagtcttctccggctcaggcagtatggccccgacaagctgctcttcatcgactgcaagaagaacaaacacggcggcaggccaccggcgacgagaagccaaattacaagcaggcgaagcaacacagcgtcagtgaggctgttcaggcatggacatcaccggcggcggcggcagattgccaggaagcgggagaggcaggtggaaatggggcaagaggcagttcttgatgaagaggcaatgcagtggttcatcagcagtactcctgcccttggtgcccctgctgttataacatcaaatcaattcatatatacatcataaatcttccatctaaaaaaaaaaaaaaa

SEQ ID NO: 5179 - DNA, 801 bp, Oryza sativa
  Predicted polypeptide sequence is orthologous to G867, G9, G993, G1930
gttcttctctcccccttttctcttccccgttcgaacgcctcggcggcagcggcggccgggggccggagtggcgacggcggccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 5180 - DNA, 1512 bp, Oryza sativa
  Predicted polypeptide sequence is orthologous to G867, G9, G993, G1930
gatcatcttctttggcttctccctcttcactgccctaattacaacccatttgcttatctctctcctctctctctctctctcgctgcagccatagcttagctagagctagagctttcttggtgccgagatgggggtggtcagcttctcctcgacttcctccggcgcgtccacggccaccaccgagtccggcggcgccgtgcggatgtcgccggagccggtggtggcggtggcggcggcggctcaacagctaccggtggtgaagggagttgactcggcggatgaggtggtgacgtcgaggccggcggcggcggcggcgcagcagtcgtcgcggtacaagggggtggtgccgcagccgaacgggaggtggggggcgcagatctacgagcggcacgcgcgggtgtggctcgggacgttccccgacgaggaggcggcggcgcgggcctacgacgtggcggcgctccggtaccgggggcgcgacgcggccaccaacttccccggggccgcggcgtcggccgccgagctcgcgttcctcgccgcgcactccaaggccgagatcgtcgacatgctccggaagcacacctacgccgacgagctccgccaggggctccgccgcggccgcggcatgggcgcccgcgcccagcccacgccgtcgtgggcgcgcgagccgctgttcgagaaggccgtgacgcccagcgacgtcggcaagctcaaccgcctcgtggtgcccaagcagcacgccgagaagcacttcccgctccgccgcgcggcgagctccgactccgcctccgccgccgccaccggcaagggcgtgctcctcaacttcgaggacggcgaggggaaggtgtggcgattccggtactcgtactggaacagcagccagagctacgtgctgaccaaggggtggagccgattcgtgagggagaagggcctccgcgccggcgacaccatagtcttctcccgctcggcgtacggccccgacaagctgctcttcatcgactgcaagaagaacaacgcggcggcggcgaccaccacctgcgccggcgacgagaggccaaccacaagcggcgccgaaccacgcgtcgtgaggctcttcggcgtcgacatcgccggcggcgattgccggaagcgggagagggcggtggagatggggcaagaggtcttcctactgaagaggcaatgcgtggttcatcagcgtactcctgccctaggtgccctgctgttatagcatcaaatcaaattcatatatagatcaaatcaaatcttcttctcttccatcttttttgttgttcatcgtctgttgtttcatcttcgatttagagctgttctatcttcgactttctttttttgttttttgtctttattttgcatagaagtttgtcaggtcagagattgcaaatgatcgatcaagatcgagctgtatatgtacagccttattaggaaattaagtctagagatcattcaagtatgtacaattatctaatagtacatagtaataagttctgtttctttccg

SEQ ID NO: 5181 - DNA, 1182 bp, Oryza sativa
  Predicted polypeptide sequence is orthologous to G867, G9, G993, G1930
atggacagctccagctgcctggtggatgataccaacagcggcggctcgtccacggacaagctgagggcgttggccgccgcggcggcggagacggcgccgctggagcgcatggggagcggggcgagcgcggtggtggacgcggccgagcctggcgcggaggcggactccgggtccgggggacgtgtgtgcggcggcggcggcggcggtgccggcggtgcgggagggaagctgccgtcgtccaagttcaagggcgtcgtgccgcagcccaacgggaggtggggcgcgcagatctacgagcggcaccagcgggtgtggctcggcacgttcgccggggaggacgacgccgcgcgcgcctacgacgtcgccgcgcagcgcttccgcggccgcgacgccgtcaccaacttccgcccgctcgccgaggccgacccggacgccgccgccgagcttcgcttcctcgccacgcgctccaaggccgaggtcgtcgacatgctccgcaagcacacctacttcgacgagctcgcgcagagcaagcgcaccttcgccgcctccacgccgtcggccgcgaccaccaccgcctccctctccaacggccacctctcgtcgccccgctcccccttcgcgcccgccgcggcgcgcgaccacctgttcgacaagacggtcaccccgagcgacgtgggcaagctgaacaggctcgtcataccgaagcagcacgccgagaagcacttcccgctacagctcccgtccgccggcggcgagagcaagggtgtcctcctcaacttcgaggacgccgccggcaaggtgtggcggttccggtactcgtactggaacagcagccagagctacgtgctaaccaagggctggagccgcttcgtcaaggagaagggtctccacgccggcgacgtcgtcggcttctaccgctccgccgccagtgccggcgacgacggcaagctcttcatcgactgcaagttagtacggtcgaccggcgccgccctcgcgtcgcccgctgatcagccagcgccgtcgccggtgaaggccgtcaggctcttcggcgtggacctgctcacggcgccggcgccggtcgaacagatggccgggtgcaagagagccagggacttggcggcgacgacgcctccacaagcggcggcgttcaagaagcaatgcatagagctggcactagtatag

SEQ ID NO: 5182 - DNA, 954 bp, Oryza sativa
  Predicted polypeptide sequence is orthologous to G867, G9, G993, G1930
atggagcaagaagctgccatggtcgtcttctcctgcaactccggctccggtgggtcgtcgtcgacgaccgattcaaagcaagaggaggaggaggaggaggagttggccgcaatggaggaagacgagttgatccacgtcgtccaggcggcggagctgcggctgccgtcgtcgacgacggcgacgcggccgtcgtcgcggtacaagggggtggtgccgcagccgaacgggcggtggggggcgcagatctacgagcggcacgcgcgggtgtggctcgggacgttccccgacgaggaggcggcggcgcgcgcctacgacgtggcggcgctccgcttccgggggcgcgacgccgtcaccaaccgcgccccggcggcggagggcgcgtccgccggcgagctcgcgttcctggccgcgcactccaaggcggaggtcgtggacatgctgcggaagcacacctacgacgacgagctccagcagggcctccgccgcggctcgcgcgcgcagccgacgccgcggtgggcgcgcgagccgctgttcgagaaggccgtgacgccgagcgacgtcggcaagctcaaccgcctcgtggtgcccaagcagcaggccgagaggcatttcccgttcccgctccgccgccacagctccgacgccgccggcaagggcgtgctcctcaacttcgaggacggcgacggcaaggtgtggcgattccggtactcgtactggaacagcagccagagttacgtgctcaccaaggggtggagccgattcgtgagggagaagggcctccgaccaggcgacaccgtggccttctcccggtcggcggcggcgtgggggacggagaagcacctcctcatcgactgcaagaagatggagaggaacaacctggcaaccgtcgacgacgatgcccgtgtcgtcgtcaagctgttcggcgttgacatcgccggagacaagacgaggtaa

SEQ ID NO: 5183 - DNA, 1185 bp, Oryza sativa
  Predicted polypeptide sequence is orthologous to G867, G9, G993, G1930
atggacagcacgagctgtctcttggacgacgcgagcagcggcgcgtccacgggcaagaaggcggcggcggcggcggcgtcgaaggcgctgcagcgcgtgggcagcggcgccagcgcggtgatggacgcggccgagcctggcgccgaggcggactcgggcggcgagcggcgcggcggcggcggcgggaagctgccgtcgtccaagtacaagggcgtggtgccgcaaccgaacgggcggtggggcgcgcagatatacgagcggcaccagcgggtgtggctcggcacgttcaccggcgaggcggaggcggcgcgcgcctacgacgtggcggcgcagcggttccgcggccgcgacgccgtcaccaacttccgcccgctcgccgagtccgacccggaggccgccgtcgagctccgcttcctcgcgtcccgctccaaggccgaggtcgtcgacatgctccgcaagcacacctacctcgaggagctcacgcagaacaagcgcgccttcgccgccatctccccgccgccccccaagcaccccgcctcctctccgacgtcctcctccgccgcgcgcgagcacctgttcgacaagacggtgacgcccagcgacgtcgggaagctgaaccggctggtgatccccaagcagcacgccgagaagcacttcccgctccagctccctccccctaccacaacctcctccgtcgccgccgccgccgacgccgccgccggcggcggcgattgcaagggcgtcctcctcaacttcgaggacgccgccgggaaggtgtggaaattccggtactcctactggaacagcagccagagctacgtgctcaccaaggggtggagccgcttcgtcaaggagaaggggctccacgccggcgacgccgtcggcttctaccgcgccgccggtaagaacgcgcagctcttcatcgactgcaaggtccgggcaaaacccaccaccgccgccgccgccgccgccttcctcagcgcggtggccgccgccgccgcgccgccacccgccgtgaaggctatcaggctgttcggtgtcgacctgctcacggcggcggcgccggagctgcaggacgccggcggcgccgccatgaccaagagcaagagagccatggacgccatggctgagtcacaagcacacgtggtttttaagaagcaatgcatagagcttgcgctaacctag

SEQ ID NO: 5184 - DNA, 802 bp, Oryza sativa
  Predicted polypeptide sequence is orthologous to G867, G9, G993, G1930
ctctcttctctcccccttttctcttccccgttcgaacgcctcggcggcagcggcggccgggggccggagtggcgacggcgaccgcgccaccgcctgccctgtctccaagctggcctaccatcgcgcaagctccgccaggggctccgccgggggcgcggcatgggcgcccgcgcgcagcccacgccgtcgtgggcgcgggagccactgttcgagaaggccgtgacgcccagcgacgtcggcaagctcaaccgcctgctggtgcccaagcagcacgcggagaagcacttcccgctgcggcggacgagctccgacgcctccgccaccgccgccgcggccacctgcaactctgcaagggcgtgctcctcaacttcgaggacggcgaggggaaggtgtggaggttccggtactcgtgctggaacagcagccagagttacgtgctgaccaagggatggagccgattcgtgagggagaagggcctccgcgccggcgacaccatagtcttctccggctcggcgtatggccccgacaagctgctcttcatcgactgcaagaagaacaacacggcggcggccaccggcgacgagaagccaattacaagcggcgaagcaacacgcgtcgtgaggctgttcggcatggacatcaccggcggcggcggcgattgccggaagcgggagagggcggtggaaatggggcaagaggcgttcttgatgaagaggcaatgcgtggttcatcagcgtactcctgcccttggtgccctgctgttataacatcaaatcaattcatatatacatcataaatcttc

SEQ ID NO: 5185 - DNA, 1368 bp, Oryza sativa
  Predicted polypeptide sequence is orthologous to G1073, G1067, G2156
ataccagtagcagctaattaagtgggtgggttcgcttgcttgctttgcttttgcttggagacgggagcgacgctggcttcagcgattggcgtggagaagctagattgttggtgcgactttccgaccgcgaaaatagtagggctggcaaaccggtggccggccggcgatccggccgaggggatggggagcatcgacggccactcgctgcagcagcatcaggggtactcccacggcggcggcgcgggagggagcaacgaggaggaggaggcgtcgccgccgcccggcggtggctcggctacggggtcggcgggccgccggccgagggggaggccgccgggctccaagaacaagccgaagccgcccgtcgtggtgacgcgggagagccccaacgcgatgcgttcccacgtgctggagatcgccagcggcgccgacatcgtcgaggccatcgcgggcttctcccgccgcaggcagcgcggcgtctccgtgctcagcgggagcggcgccgtcaccaacgtcacgctccggcagcccgcggggactggggccgccgccgtcgcgctgcgggggaggttcgagatattgtccatgtctggcgccttcctcccggcgccggcgccgccaggggccacggggctcgccgtgtacctcgccggcgggcaggggcaggtggtgggtgggagcgtcatgggggagctgatcgcgtcgggccccgtcatggtgatcgcggccacgttcggcaacgccacgtacgagaggctgccgctggaccaggaaggcgaggagggcgccgtgctgtccgggtcggagggcgccgccgcgcagatggagcagcagagcagcggaggcgccgtcgtgcccccgccgatgtacgccgccgtccagcagacgccgccgcacgacatgttcgggcagtgggggcatgcagcggtggctcggccgccgccgacatcgttctagcactggcaccggttaatcaatgtctctctacctagctagttagccttccacttctttccctagttgtttgagtaggttaattaatcatttaccatgttaattaatgtgctatgtaatgcataagtactcgtgtgatcttatcgttccattttcttcagagtttgaagaatgtaaaattactgtgcgtatcaagatcggcagtggttgctcacttgctccttcactagctatctgctcgatcataagctcttgcatcttgttcttcgcaagcaccaattcacgcttgtgtcaattgcttggtcattttgcatactttggactactcgatcactacaaaatatttcttgagttttactccctgcatgcactgctcaatgcgtgattatgcctgaatacactaattgttttgtt

SEQ ID NO: 5186 - DNA, 1011 bp, Oryza sativa
  Predicted polypeptide sequence is orthologous to G1073, G1067, G2156
atggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctgagcggcggcggcgccgtcgtcaacgtggcgctgcggcagccgggcgcgtcgccgccgggcagcatggtggccacgctgcggggccggttcgagatcctatctctcacgggcacggtcctgccgcctcccgcgccacccggcgcgagcggcctcaccgtgttcctctccggcggccagggccaggtgatcggcggcagcgtggtgggcccgctggtcgccgcggggcccgtcgtcctgatggcggcctcattcgcgaacgccgtgtacgagcggctgccgctggagggcgaggaagaggaggtcgccgcgcccgccgccggaggcgaagcacaagatcaagtggcacaatcagctggacccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctga

SEQ ID NO: 5187 - DNA, 652 bp, Oryza sativa
  Predicted polypeptide sequence is orthologous to G1073
accgcagcagcagcccacagcctcgcagtcctctgaggtgaccgccggtgacggcggcggcggcggcggtctcggcatgtatcttggaggccatgtgggatcctaccagcagcagcagcagcaacttcccggaccaggagacaacttcggtagctggagcggcagcatcaggccgccgccattctgatccaaacacctcaaatcaagctctcccccaacaacgccatgcatgtctaaatcctcacaagattcactccaagaagacgaagctgagtgagagtgatggatttcatttcatctcatcatttgtgacaatgcattcatttttttttgttgttgaaggctatacatcttgcaagattacaagttaatcgaggcgcatgcattcttgattggagatgtggaagaatctcttgcattgcagaagtactaatagaatcaacattggaaggcagaattttttttggctggagatggagggaggtcagtcaattagtgccaaggaactgaacaagatcccggtaaggcaggttagtaggaccccggtgtttagtggttcatcctgtagacttttgatcaagaatgatgcttgtcatgaccttttacttaaaaactttcccttggaatgatgcttgttattgcttttcactac

SEQ ID NO: 5188 - DNA, 1193 bp, Oryza sativa
  Predicted polypeptide sequence is orthologous to G1274, G1275
aagagagtcggccaacccacatgcacgtgtaccgatgtacatggcggcggcggctgcgggagcaagcacacccttcaatttttgccgccacggctcgcacgccgagtacgacgccgtcttcagcggcagctggatggcgcgccgcccctccgcggcgccgcacggtggcggcgcctccggctccggctccggcagcggctacggcgccgcctcgtacgttgctcccaccttcggcgcggcgtttaggcagcagcatctcgacctcctcgactacctgtccgacgatcagggcgttccggcgccaccaccagcggctgtgcccagcgcgtcgtacgtgacgccggcgccggcgatggcccccgctgaaccggtcgtgccggatgctgttgccgccgccggcggctatccgaggagcgtggctgcggcggcggcggccgtggccggcgagggaagagatcggacgacgacggacaagatcgcattccggacgaggtcggacgatgagatactcgacgacgggtataagtggaggaagtacgggaaaaagtccgttaagaacagccctaatccgaggaactactaccggtgctcgacggaggggtgcaacgtgaagaagagggtggagagagacaagaacgacccgcggtacgtggtgacgatgtacgaggggatccacaaccacgtgtgccccggcactgtctactacgccgcgcaggacgccgcctccggccgctttttcgtcgccgggatcagtcacccagaccttaattaagctaggatatgctttgccggcccagctgtggcttagcttgatgtgcagctctagttattgtatgggctgtacggttcagttatttgaagcgggttatacttatatgttgttaatgtttgcctactgattttaattaatttcttagagttagactcaatttggcggagggattcccttcaaaaaaagaaatcccttcaaaaaatttggcggagggacgactgatatatatggtgacattagctaggtttgctcacttttggcaaaaataacaagtttcctttcgtgccactctccgtccctaggtcagtgtttggcaaaacgcccaaaaaaatgtccgtgttgccaattaatttgtcgattgtgtacttcaatttcaagccaaatttcggcaaagctagtactttgtgtgttttagatgttg

SEQ ID NO: 5189 - DNA, 1091 bp, Oryza sativa; identical to SEQ ID NO: 2099
  Predicted polypeptide sequence is orthologous to G1274, G1275

SEQ ID NO: 5190 - DNA, 839 bp, Oryza sativa
  Predicted polypeptide sequence is orthologous to G1274, G1275
ctgtcaaacactcaatcagcagcagcagcagctagcttagcttagctaacgcacagtgacgcgagcatggcggcttcgctgggactctgccacgagacgtcgtacgcctactcgtacccggcgtcgaacacctcctcctccttgtgcttccctcctctcatggcggaccacatcgtcgacggcggcggcggcggcggctgttcctttggtgaattcctggagctcggccattccgtgtactcgctgccgcttccgccgccgccgtcgcagccggtggtggtcgccggcgggaacaatgatcagtatggcgtgtcgtcgtcgtcgtcggcggcggcgacgacgagcaggatcgggttcaggacgaggtcggaggtggaggtgctggacgacgggttcaagtggcgaaagtacgggaagaaggcggtgaagagcagcccgaacccgcggaactactaccggtgctcggcggcggggtgcggcgtcaagaagcgggtggagcgcgacggcgacgacccgcgctacgtcgtcaccacctacgacggcgtccacaaccacgcgacccccggctgcgtcggcggcggcggccacctcccgtaccctacttccgctgcgccgccgtggagcgttccggcggcggcggcctcgccgcctcccgcgcacgcgcaggcgtggggggcgccgctgcacgccgccgcggcggcgcactcgtcggaatcgtcgttctgaacgctgaatttacttctgtttttgtttttcttggttgcttgttagttgtaccgccgttcgtgatcgatcgatcggttcttgtatgcactagacttactacttaaaaaaaaaaa

SEQ ID NO: 5191 - DNA, 666 bp, Oryza sativa
  Predicted polypeptide sequence is orthologous to G1274, G1275
atggcggcagtcggcgcgcacgcagcggtctaccaccacccggtctcgggcctctcggcgccggcgggcgacgccgcctactcgatgtcatcgtacttctcccacgggggaagctcgacctccagctccgcgtccagcttctccgccgccctcgccgccgcaacgacgccgccgcttcccgacccgtcggggtcgcagttcgacatctccgagttcttcttcgacgacgcgcctccggccgccgtgttcaatggcgcgcccaccgccgcgctgccggatggcgccgccgcaaacgcaacaaggagcgcggcggaggcggtgccggcgccggcgccggcggccgtggagaggccgcggacggagcggatcgcgttccggacgaagtcagagatcgagattcttgacgacggctacaagtggcgcaagtacggcaagaagtccgtcaagaacagccccaacccaaggaactactaccggtgctcgacggaagggtgcaacgtgaagaagagggtggagcgggacaaggacgacccgagctacgtggtgacgacgtacgaggggacgcacaaccacgtgagccccagcacggtgtactacgccagccaggacgccgcctccggccgcttcttcgtcgccggcacgcagccgccaggttctctcaattaa

SEQ ID NO: 5192 - DNA, 1042 bp, Oryza sativa
  misc_feature (845)..(845): n is a, c, g, or t
  misc_feature (892)..(892): n is a, c, g, or t
  misc_feature (894)..(895): n is a, c, g, or t
  Predicted polypeptide sequence is orthologous to G1274, G1275
agtcgccgaggtcggcggaatccgggtgaccacgcgtcgcccacgcgtcgagaaaatcacggtgaaaaggttcagcactgtgcaatggcggcttccgtaggactgaaccctgaagctttcttcttcaacaactcctactcctactcctcatcccctttcatggccagctacacgccggagttctcggccgccgctatcgacgccaacttattctccggcgagctcgatttcgactgctctctcccagctccggcccaggagtacccggaaaatgaaaacactatgatgaggtacgagagcgaggagaagatgagggcgagggtgaacgggaggatcgggttcaggacgaggtcggaggtggagattcttgatgatggcttcaagtggaggaagtacggcaagaaagctgtcaagaacagcccaaatccaaggtacacgaatattgacgtcactgccactatgcccatttggctatcaatcttaattaattagtaccacaagtttaatcactagcttaattactggcgttctgcccaatcaaagttttataatcaccttttctgaaatatcatctgttcagggttaaaaattttagaatgcaaaaaaattgcggagatcttgaactgaattttcagacaaattttgtaatttgaacaggttttcactttacttgaaccgaatttgagaaaatccctcacatccgagggttgggcggattacttccaccgggaccctgttacccaatgattctttgaactgtacttgagggtcggaattgtccatatggtgggggaaatcaccctcatttgaacaacggggcgaggggcgcacgggtgaggggaganttccagggacaccgccggttcgtacaccccccgcgtggcaatacacntnngcgaacgtgcgtaaacaccgaggagacagctcgagaagagcaggacactggagacatatgaggaagaagcgacaaacatagaacattcgaacacaagcatgcggacgaacggtgagagaaagcaaaacagccagcacgaagcgaacg

SEQ ID NO: 5193 - DNA, 803 bp, Oryza sativa
  Predicted polypeptide sequence is orthologous to G1760, G152, G153, G860
atggggagggggaagattgtgatccgccggatcgacaactcgacgagccggcaggtgacgttctcgaagcggaggaacgggatcttcaagaaggccaaggagctggccatcctctgcgacgccgaggtcggcctcatgatcttctccagcaccggccgcctctacgagtactccagcaccagcatgaagtcagttatagatcggtatggcaagtccaaggatgagcagcaagccgtcgcaaatcccaactcggagcttaagttttggcaaagggaggcagcaagcttgagacaacaactgcacaacttgcaagaaaatcatcggcagttgatgggcgaagatctatctgggctgaatgttaaggaattgcaatctctagagaatcagctggaaataagtctacgtagtgtccgtacaaagaaggaccacgtcttgattgatgaaattcatgaactgaatcggaagggaagtctagttcaccaagaaaacatggaattatacaagaagatcagtttaattcgtcaagaaaatgctgagttatataagaagatctacgagactgaaggaccaagtgaagtcaatcgggattcaccaactccttacaattttgcagtaattgaaaaaacaaatgttcctgtgcaacttggactcagcacactaccacaacatagtgacgccgaacaatcaactgctcctaagctagggttacagttgaatccatgaccagaaaaacattgttttgctacacccttgtatgctgaagggatactatttgctgtcaagagttgatactcagatcaaga

SEQ ID NO: 5194 - DNA, 1845 bp, Oryza sativa
  Predicted polypeptide sequence is orthologous to G1760, G152, G153, G860
atcgctcgcggtcgcagtcgcagtcgcccacacccttgccgcaccatggctggaacccgcggcggattcgagaatcattagatgattacttgtggctttcttgcaagttgtgcagttgctgcctcaagcttgctgcctccctctgccaaatctatcagcaaaaaaagaaaatcatgtcagtttccttgaactatatacatatgattaatctagaaacgcagtatgttgccaaaaatcacacacaactcaatcacatatgcatttgagatgaggtaaaatgctatctgattcacatagttccaatatctcaagatgtgggatatgcgtagcacaagtgcatcagagtgttatagttgttcagtcttcagtacttattattctagattaatttggaccaacttgtcaattcagctgacacttgtttttgtctagtgctccagtagcttggttgtttcatcatcattagacttttaaacctttggtcctaaactcctagctgaaaaatttgcacactgaacttccctgtgttctaaggaaaaaaaaaatctagacataaccttgctgatctgtattatggaccggccattggagtgcataatgcataactgctgatcactttgttggcacaaaacttacgcatagacataggaggtacttatgtataattgtatctttaatcaggactttgttttcaaccattttgttgatataacagttatactgtagtaatgatgagtacagtctccaatgtaaactcagggcaaatcagatttatccctttttggtgcttggtatctttttgtatttttcatgagcgatggcatttttgaacccaaaatagagggaaagagaaggatctctgtgggggcatgctatgtactacagttctttgagaccatgtaggtgtggatgcttgttttgaccttttccttaacatatagaaagaataaacattaaataaatgatgacatggaaatgaaattcataaaggagtacataagctagtactcctgaaaatatcacttcatattcccccatgattcagtaacatgaatatcataccatcagcagcagtgaaatttttatgcgtagacggtttgtttcttaaggtatatattttttatgtttacaattgtctgtcgagtttactggtcaattgagcaacaacggtacttttaactgttaatatcacttggtttgctatgtatccttgttgttctggctttgttgctttacagccattctgcttacgctattggcatctgttatttagaaaaccattttctaacagtttttagatttcctttcgagtctccaactgtttttaacctccaagttgccacataatgcataaatataccgagtaagtttgcccccctctgaaatatggatgttagatactcagacaggttcagtatgtgttgggtgttgttttctgagtttgtggttgtcataagatgcagcgaaattactgcgctgtatcttggaccaatgcaatcagcgaagtccttatcgtgccaaaaggatgtgcatggattttccatcatttgcaaacttgaggatggcctgccctgatgccctcagatgctgatgaagtgtgtggttcatgaaaacgtgagaagctaagtagtggagtaacgggagtgagtaccagtgtggccactatgaagaaagttaattactgagaaattaagacttgagcatgttattttcaagcaacttgtacagcattatattgcactaccatcaaatgcttctcctgcctatacaatactctgcaagctcttgtattgtacactgttttatcttgtttaaagtatgcttgtttttgcttatgttgagatt

SEQ ID NO: 5195 - DNA, 1104 bp, Oryza sativa
  Predicted polypeptide sequence is orthologous to G1760, G152, G153, G860
gtgctatacgcatcttccctagcttgctaagctagctagtcttctccttcctttctcctcttcctcctcctcctcttcttctcaatcttgctcagcaaatcttgtcggggagagagagagagagatcagcaaggagaagagggaattaagctagatcgaggtagtcgtcgatcgatcgattgaagatggggagagggaagattgccatcaagaggatcgacaacacgatgaaccggcaggtgaccttctcgaagcggcgcggcgggctgatgaagaaggcccgggagctggccatcctctgcgacgccgacgtcggcctcattgtcttctcctgcaccggccgcctctacgacttctccagctcaagcatgaaatcaataatagagcggtaccaggaggcaggagaggagcattgtcggttgctgaacccaatgtcagaggctaagttttggcagcgggaggttacaactttgaggcagcaagtgcaaaacttacaccacaacaacaggcaacttttgggagaggaaatctccaacttcacagttagagatctgcagcttctccagaaccaagttgagatgagcctacattccataagaaataaaaaggatcaacttttggcagaggagattctaaaactcaatgaaaaggggtctcttgttcaaaaggagaacagtgaacttcgcaagaagttcaacattgctcatcaacgcaacatagaattacacaagaagcttaactctggagaaagcacgtcaagtgagcaagttaccagaagctcaaaggatcccggagaatcgagtacaccccgtgattcacgtgtgtgtattgaccttgaattgagtcaaaaagaagttgaagatgaataacacatgatcaagtgttaaaaacaacatgatggccagtaacttttgcagcatcacgcctactacaagcgcaagaaaagctagctactactggaacaagggatcttaatcatgttttgaaacttaattagtaatattttaaaaaatcgtactatactaatcatgatgtgtagcgtattgcaccactgaatttattactgtaattaacatggtgagtgttaaaatattttgtgatatc

SEQ ID NO: 5196 - DNA, 3149 bp, Oryza sativa
  Predicted polypeptide sequence is orthologous to G1760, G152, G153, G860
gttgtgtgcctacaaggctagagtaaagaccttatcgctcttgctaaacatacatacgtgcaagcacagtgcctagctaatccatcagcagaatagaagggtggagggggtgggaagaggccaggcccctccgccccctggcgtcgctcttgctgatacttttcttgttctggtacatctgcacagataaattataatgccttttcatctcttctgtctgcttatggctttttaagataaaacagagcattgatcttgcatgctctacacttcgcgcactgtttgtttttgccaataagtttgcacacatgtagctgtcatttgggtaaacaaacttgcagatagtgccaaatagtcataagaaaataattttcatgggctcttcagataatacatttttattcgaatagattttacagtatcagatattaatcatccaagcatgcaaactgtgtcttgttatgtgttagcttctttatgaccaatacattttaagagctctgaactgtagcccttaagaatagtgaaaatataggcaacacttccacaccataaattgtcatggatgcaattggagcctgcaataatttcattaagttataattgatgtttcactaaagaactgagaatggatagatggatcatgtgcagaaaatctgagttaccctagtttaggaggtgtggtttgctcagcatcattttgttggcttgggggattgagttcaagacgagcaggagtgttggcttcctcgataaccgcaaagttgtatggagttgttgaatctcgattcgcttcattttctgcccctgtctcatagagctgaggagagagattagctgtcatcatataatgaagcgtatatcctgtgaaatcatctatctgcatttatcaagtaccttcttgtacagctcagcattttcttggcgaatcaggttgacctttctgtacagttccatgttttcttggtggatgagacttccctgcaaataagccagcaatagagttagcttactagctgattcaaagatttagcaattgtacatgatgttgtagaacctttcgattcagttcgtggatttcatcaatcatgagctggtcctgaaaacaacaatattgatcttaagttaatccattatataatcaatcaggtgcccaacaaaaaaatatggttagtaggttgaccttttttgtccggatgcagcgtatgctcatttctagctgattttctagagtttgcagttccttgacacccaatccagaaagatcttgccccatcaactgcctgccatcaaccaatggatgttatagtgttgttctgatgatatacagagtgaatattgacacttaattttagctgatcaacagacagctgttaattgataataaaaataatttgtacctttctagtttaggtattgtaaattaggcctgaaggacaaaatggagtgtttgaacaataatttaccaggcagaaagcacaggtgaagaaaatgtgatattcactctcctttgtaaatttggtctgtccgcctttgatgggtgctcagttctgtttttcttttagagataaccggaaatgcataaaaatcgaatggctgaaggtatatatttcttacttttaaatgatatagaaaattcacgtgccttcttcatttcttttgtttgtgaaggttaaacaatgcattatctataggaaatttggaatcagcatatatcactttcatactctgttttttcttcttttttctaagtatcatatacccaagcactaggtgcttgtttttatgatctggtactagtttatatttactatacaatcaggtgctggaagtattattgtcgctagcagttgctggattcatgagcaagtccccacaaaaaaaaaagttcgtcatcaagggttcatgatgcatgtatttcatagtagtagatatatgatggtttatgtttttctatcttgaggaattttctgatggaacattgaaaaacttgcagggttttatggccataccgatgattttcttgcaagctgtgcagttgttgtctcaagcttgctgcctccctttgccagaactattggatatgaaaacagagtcaagaaatgcagaatccaggtttgccaaaagcagcaatataaatatgttgtgtatacccatagaaacatgctgggttatcaactcactagtttttttttaaaaaaaaggaaactcaattacattagacaagaagactatttgaactgaggaagttattgtgtatggtaaaagaagtaacaagaggcaaacaaagaaatttgttgtaaacaaataagggaagtagtattatctttccagtttgaagacagtttttttttccagataagacgatgagctaccaactctattgaatttggtactccattatcagtcctcgttttgcggggtgttaccccctattgtaaaaagcttgtttgtctaagcaaaatgcttccaagtcccaccaaagctagattaactacaaagtatctgcagagtgcacaagtcaggtaaaaaacttgtttgtctaagcaaaatgcttccaagtcccaccaagctagattaactacaaagtatctgcagagtgcacaagtcagataaaaaacttgtttgtctaaacaaaatgctcccaagtcccaccaagctagattaactacaaagtatctgcagagtgcacaagtcaggtaagtgatgattatatcatcctggtacaagctttattgcggtgaaagataagcagttagtctgaaatctgtacagatctgtcagctgttaccgaagcaaaaggttcaatgtgaacttaaagatgcagtactgatccttttaagaggatttaacacagatttaacaggtacgtgccccttgtgattctttgttagttttcttgttataatgatgtttttatcctctgaattcaagcagggtgttctgtatgcgagctgtgatgggatggttctcttcagaagcattttattttaactaaattcagaagcatttcgatggcatgaggactgttcgattgacaatttgtatgtacatttccaccgtttacgcagcttaggaattggaccataattagttgtgtacctgcaagttttgtatacgaattatcctgaagggtgttcggtggattg

SEQ ID NO: 5197 - DNA, 3308 bp, Oryza sativa
  Predicted polypeptide sequence is orthologous to G1760, G153, G860
acaatattttgtattaatttatgttttacaggcatacaacagatccaactttcaatgacatgtttattgtttagtttagctacaataattgttgggtagttgtagagcagcacatggtacttatgccacaagcccgcaaataaaataattcgcatttgctcatcctaattcatgctagcatctctattgcagaacaattttgatactattttttttttaaaattagccttgaaaatgccacttcccctaaggaatgacaaatgcatttttttttacaaatgcaaaaacttgcaggtagacacatatttggcaggtgaattcgtgtcatatggacatatctttcattggaagatatgtccatatgttggagctatttcaccagttctttcattggaataatgttagcatttaatcagtgatataggagatgattcaccttcaacaagctctcatttatcatcatgacgagtcagaagaatccgattgtcaagttacgccttctaccatatactccccaccaaaaacagctaccactggtaaataaattgctttctgttctaattggtgcctgaatttctgtatgctagatctgattgtttgttgctttcctggtattgtgtagtttttagttatgatgtacataatcctaagttaatccagaaattaatttttgagttctttctggagtttattcagtagtttataggttgtgaccaccagtgtccttttatggctgaatacaactcaaagaatcttcatgttggagttggattcactttggcagttcatacagtggatgctgatagatgcgctcgattattcctgtcgatagcatcctagtattgtgtctttatatagctatatctagcattttcatgtaaaagctatctgttctgtggatgggtgctcttattggttgcagcaatcaggataatcagctaaaataatgatatattgcagccttgtcagcctttattatatactgggttccctaaattgtcatctagtcattagtgccaaagtgcatgtagtcttctctgatcgttatttataactttatatgccaatggatgttacagacaacgtagtgtatgtcaatctatctggcgttttatttatcagaatactagaagagaatttgcaccagtggttcaagtaaatccctgaacattgaaactagatagtttgggctttttggcccctaatcttgtttgattgatacaaacaagtcaacgggtcacaagtgcttttgactgacagactacatccgtttctctcctctcatcttcactcttccccatcgaattctcctctcatcttcttcactcttccccatctttgaccaaattagccgcatcctatgcctggtggaatattctgacacaacatagcagtgtggcttgtttcagcagaaaattatttgacaggcgttgattgcaaagctgtcacagctgcacccatctgatcagatataggtaaactgagatgtggttctcagccagtgggaatgatgtacaaccacgttgtcattcaggggaactaaaaaccatctactcctgtttttagcaactcacatacagtacagatacctagaatcaacagatatccctactttaaccactttaaacaagtctgaggacatatattcctagtatcaatgttcatacacttgaaccagtaatgcaaggttcaggacatacaatgcaatttactcttgttttcttttatagttcatttgtcctcattttggtccctgatttaagttggacattcttatctcactagacggttgggtaagtaatgttaggggtcaaaatatagtggagttatgctatccaatcttgaaagcaatgtagagctttgatctgttactatccagtactacagtgaacagctagacttggagctagtgatttactcccttattggatacggatattgaagtagatatgggctggatgcctatactatgtaaattcacccattgacggttcattggctcagtcagatagagaacatgcctgcttaactgaattagtgaaagcaagtcaaataactaagtggcaactcttatcagcaaaactaatttgtgattatgatctgtggcttgtttatttcaaccatttcttttatatgaattgcgtgtaactcagaatttcatgtgaatactgagtaactagcacatctattttgatttgggcccaatttttcaactggcaagaaagaattggagtacaagatcaaagggtgggagtaactcttagtcttaggcatcgggattgggcaggatttgttgtgcacctaattttctttcatttctcgtacttgaacttgtttgtgcatataagtatgtgatcatccaactatttctaagaggaaattagccacaagcaacaaataggaagtttttatattcatacctttgcctcagaacttgcgttcatggtttgatggggatcttctttcgtctcattgtatctctcaattatggatttcatgctggttgaaaaaaaaaatcaagatcccattagaacacatgtcaacacatgccacagtagtgttgaatgctatcatatagctcctgcaagcttattttgtagtacatgggcatcagtatgtaagatgacaaatgcaaacttttaatgaaggcctagttctttgacaagtaatccacgtggatagataactgtaaggtcaacacaaagaattaagtgtggagtgttttgagttaattggttcttactgcttaatttcctgttatcttaaaacttcctgttatcttaaaactagacactgttctcctaatttgtcatccttttcctatttagtttgttgttttctacgaatcttgagctatttgtatggagaaaaagcagtgacaatggtaaaagatggttttgaaggcactacaagacatgcctcaagttataaccgtgctgttacgaggatccaagcatccaaaacacttggaagattaagcttcaggcgttgtcgacataatgcataattagttgcatacttcagtggatgattgaacgggatgtttggatatgcaaatatttctatgcatccggactgaatactttctgaacacaaagcaagccaacctgccatggccatgacacgatggttctatccatattttcctatttgtcatgtacggctgggctgggcctagcaccaaaactattcgttgttgtttattattattaggtaattaggttattcgtagatcatggttgtttattttattatgaacattttgataacattttttttaaaaaattaaagcctttatttttccgatc

SEQ ID NO: 5198 - DNA, 437 bp, Oryza sativa
  Predicted polypeptide sequence is orthologous to G1760, G152, G153, G860
aaacaaaagacccctccatttccattcctcctcttcctctcttctccccccccctccaataattcaaccccctcttctgggaaacctgggagctttctccttcaagagctccctgctagctagatctcctcctctctttctctctctctctctctctctttctgtccatttctatctgtgctctcgcctgagcggcgacaatccagctgagatcgatcgatcgatcgatggggaggggcaagatagtgatccggcggatcgacaactcgactagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccaccatgaagtcagtgattgatcgatatggg

SEQ ID NO: 5199 - DNA, 695 bp, Oryza sativa
  Predicted polypeptide sequence is orthologous to G1760, G152, G153, G860
ggaaaaggaggaggagatcgaaggggaagatggggagagggaagatagagataaagaggatcgacaacgcgacgagccgacaggtgacattctcgaagcggcggagcgggctgttcaagaaggcgagggagctctccatcctctgcgatgccgaggtcggcctcctcgtcttctccagcaccagccgtctctatgactttgccagctccagcatgaaatccataattgagagatacaatgagacgaaagaagatccccatcaaaccatgaacgcaagttctgaggcaaagctttggcaacaggaggcagcaagcttgaggcagcaactgcataacttgcaagaatatcatcgacagttgttgggacaacagctttctggtctggatgtagaagacttgcaaaatttggaaagtaagctggagatgagcttaaaaaatatccgtctgaggaaggacaatgtcatgatggatcaaattcaagaattaagcaggaaggttgttaccacttagcacattcactcaacattacttatgtacactagtctacttggtccaaatcttattggagtgagataatttgcttgacactgcacaaacttctcactgaattgtagggaagcctcatacatcaggaaaacatggaactacacaagaaagtcagccttgtccatcaagaaaacatcaatttacagaaaa

SEQ ID NO: 5200 - DNA, 708 bp, Oryza sativa
  Predicted polypeptide sequence is orthologous to G1760, G152, G153, G860
atggggaggggcaagatagtgatccggcggatcgacaactcgacgagccggcaggtgacgttctcgaagcggcgcaacgggatcttcaagaaggccaaggagctggccatcctgtgcgacgccgaggtcggcctcgtcatcttctccagcaccggccgcctctacgagtatgccagcaccagcatgaagtcagtgattgatcgatatgggcgagctaaggaggagcagcagcacgtcgcaaaccccaactcggagctgaagttctggcaaagggaggcagcaagcttgagacaacaactgcacagcttgcaagaaaatcatcggcagttgatggggcaagatctttctggattgggtgtcaaggaactgcaaactctagaaaatcagctagaaatgagcatacgctgcatccggacaaaaaaggaccagctcatgattgatgaaatccacgaactgaatcgaaagggaagtctcatccaccaagaaaacatggaactgtacagaaaggtcaacctgattcgccaagaaaatgctgagctgtacaagaagctctatgagacaggggcagaaaatgaagcgaatcgagattcaacaactccatacaactttgcggttatcgaggaagccaacactcctgctcgtcttgaactcaatcccccaagccaacaaaatgatgctgagcaaaccacacctcctaaactagggtaa

SEQ ID NO: 5201 - DNA, 992 bp, Oryza sativa
  misc_feature (876)..(876): n is a, c, g, or t
  Predicted polypeptide sequence is orthologous to G1760, G152, G153, G860
cagcggagggacggtcggagattccgggtgaccacgcgtcgctctctgtctctctctctcggggtattgcaagatagtagctaattaaccagcctttggccttcagtttccccatcggttcatcagagcacgccttcaatttcctaatcaatctcccatataattccccttagcttgtatgcctatcattagtacttcttgtgttgtgttgtcttcttgccttctttgagctagagctagctaggtttgtgacctgctgtacgtgcgtgtgttaattagatagatgtcttagatctgggagagagcgaggagatggggagggggaagatagtgataaggaggatagacaactcgacgagcaggcaggtgacgttctcgaagcgtcggaacgggcttctgaagaaggcgaaggagctatccatcctctgcgatgcggaggtcggccttgtcgtcttctccagcaccggcaggctctatgagttctccagcaccaacatgaaaactgtgatagaccggtataccaacgcaaaggaggagctacttggcgggaatgcacttcagaaatcaagatttggcagagggatgccgccagcttgaggcagcaactgcacacttgcaagaaagccaaaggcactgatgggtgaggagcttctggcctagtgttagagacttacaggcttccggatcgggtgaaatcagctacgtatatccaatggaacggccccctttgcacaggaacccgggctcctgtgaggggacctattccaggaaaatgaatcttaagctagtcgttgacaaaggggggttacgctggcggaacaagggcggttgtagatgacccaggtgggatcaggctgtctctcttagacacagagngaggatatcactaagacaccgcgccattcgtgcgcagtgatagtacctcagctcaggcgactaggcgtgctggcgtctaatcagagaggtagcagcagatgactggtgagtagagg

SEQ ID NO: 5202 - DNA, 882 bp, Oryza sativa; identical to SEQ ID NO: 2103
  Predicted polypeptide sequence is orthologous to G1792, G1795, G30, G1791

SEQ ID NO: 5203 - DNA, 660 bp, Oryza sativa
  Predicted polypeptide sequence is orthologous to G1792, G1795, G30, G1791
ccaatcggcgtcgtcaggcctctcgcgtgtgcgagcggttgcgtccgcatggaggacgacaagagtaaggaggggaaatcgtcgtcgtcgtaccgcggcgtgcggaagcggccgtggggcaagttcgcggcggagatccgcgacccggagcgcgggggagcccgcgtgtggctcggcacgttcgacaccgcggaggaggccgcgcgggcgtacgaccgcgccgcattcgccatgaagggcgccacggccatgctcaacttcccgggagatcatcatcacggcgccgcaagcaggatgaccagcaccggctcttcttcgtcctccttcaccacgcctcctccggcgaactcctccgcggcggcgggccgcggcggctccgatcggacgacggacaaggtggagctggagtgcctcgacgacaaggtcctggaggacctcctcgcggagaccaactatcgtgataagaactactagtgataagaactactagctagctagctactatggctacttagctagtacataccgatccgtcggtattagcaagacggacatggagcagtcgtgatctcgtctgtatgcgctccttgaaacgatcgagaccatgagcttgctagctagctacgcatagtagtagcaataacagaggaaaaaaaaaaa

SEQ ID NO: 5204 - DNA, 375 bp, Oryza sativa; identical to SEQ ID NO: 1849
  Predicted polypeptide sequence is orthologous to G1792, G1795, G30, G1791

SEQ ID NO: 5205 - DNA, 993 bp, Oryza sativa
  misc_feature (1)..(1): n is a, c, g, or t
  misc_feature (519)..(695): n is a, c, g, or t
  Predicted polypeptide sequence is orthologous to G1945
nacctgactgtgtacgaggcggacgacatgtacaaatcttctcaatttttctcccatttttcggagtaatcggtgtagaacatgtatatgtatacgaaaaagagccatatatttatgtataatccacaacgtacacgcacgtagtacaagtagtactccatgtacatgcagaagtacatatgcatatggtacaaaaactgatctctagctctcaggtacgtatagtcgatcgacgaatattttaaggaaacagatagcgtagtgaccggccgggcgatcaaccatgtatgcatggcgatggatcgacctagctagctagctctcatttaattcagcataaacacagataacacaagatacaaagcgtgagacgacagctgcatctcggccggcgctgcatgtcatcctccggtagcgatcgatcggattagttcacgctggagcagtcgatggaggggctgatggtctgcttagagcactctaatttcttcaaagtaacggagccggaggcacgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattagcataatattcaagagataacggtaatcttccgggatctgcattacctacaatttcgtatgcaaccgtgaggaactagaccgagtacaacgaccaaatcgggacggccacgtccggaagaccgcaacacaaccgacagaaggagaacgaacctgccgcgcaacccacaacacggtacgcaaatccccacacacagaagaacaaacaacaacaaaccgacacacctcaccacacaaggaaccacagtccccaccagccacaacactctatcacgacacaactccacctagcgc

SEQ ID NO: 5206 - DNA, 2649 bp, Oryza sativa
  Predicted polypeptide sequence is orthologous to G2
gactacgttctctccattccatctccccccaatcgctcgggcgcaatgcgcagcagcagcagcaaggccacacccacaacctcccctgcttttcgcgtcctctgctctcctcctaggttagcagcggctttgccaacgagatagataggcaaaagagaaagtacttgcatagcccaacaaggcaacagctgctgctaccctctctttcttttctctgcttctccttgctctctcttctcttcctttctttctttctatctcctgctcgttctttccattttcgagagctcaacggaggaagaaggagagagagagaggcaaaggggagcaaaagaagagcagcatggacgggtttggtattggattcgtcttgttttgggcatttcttgcttctgctccttttacctttcatagcaacatcttatcaagttattcttgccatactctctcctctctctctctctctctctctctctcttctcttctctcatcactcaccatcttcttgtcttctctctctcctctcatccttttgtgcaatgcagggattgtggcaagcaggtctatttgggtaagtttcattcatgtccatcttgtccataccccccatacttgggaactgctacaagcggcctccacgattggctcgccaattggagccgttttttctctatgggcgcggtttcgattcctcacaatggctgcctttgtgacgactgaatttgcaggcggatttgacactgctcatgcggcggctcggtaagttggactcaattcctcgtcttccaatcgctgacttctattccctgctcgcccaatcgaatccggcgctgtcaaaattctaatcttttttgttatgttcatttcccaatcgcagggcgtacgatcgggcggcgatcaagttccgcggcgtggaggccgacatcaatttcagcttggaggattacgaggatgacctgaagcaggtgagagcgcgatcgattattattacctgaactttcctttcttttcatgagtcgccacggtttcgttagatcatactactattactgtagctgcaagattaacgggatcattgcagatgagcaacctgaccaaggaggagttcgtccacgtgctccggcggcagagcacggggttcccccggggaagctccaagtacaggggcgtgacactccacaagtgcgggagatgggaggctcggatgggccaattcctcggcaagaagtatgtcctaatcgatcaccgtttcttcctctttcgttcgatcgttcgttcttgggcaatctcccgtaaatcatcttgtgggtttttggtgcactgcaggtacgtctacttggggctgttcgacaccgaggaggaagctgccaggtaaaattattgggccgcactgtgcgcgcgcgcggccattgttgttgaatgtcgagtgtggctgctgcgccgtttgcgagtttacgcttctgggttagatgggcgagcggtgatggtgattgatgtttcttgtctcttggccacagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaaggtaaaaaaagaatggggactttgctttccgcatcagccgattgtcttctcatcacgtaataaaaaggcttaaaaattcctcgttttcttgtctagttcgaccagaactcgaaccatccccagatgcctccggtcctgcaggtcacccacctgccattcagtcccaggcatcatcaccaagtgggtagctcactatacaactccactccacttcgctccatttgctgctgaatttctcgcgtttggtttcaccggtatccgtgagctgatgaattcttgatgtctgtgctgctagttcttgagcaatggtgatccggggacagcgggaggcctgtcactgacgatcggcgcaggcatggccgggcactggcctccccagcagcagcaagggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctct

SEQ ID NO: 5207 - DNA, 1671 bp, Oryza sativa
  Predicted polypeptide sequence is orthologous to G2
gtatgtcctaatcgatcaccgtttcttcctctttcgttcgatcgttcgttcttgggcaatctcccaatcatcttgtgggtttttggtgcactgcaggtacgtctacttggggctgttcgacaccgaggaggaagctgccagggcgtacgaccgcgctgccatcaagtgcaatggcaaggatgcggtgacgaacttcgatccaagcatttacgccggggagttcgagccgccgggtgggtgtgtcatgtgtgcgcttactgctcatggctaggctgttcgtttgtgagttgtgactgctcatccggacaaaatctgtcactgttttgcagcagcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaagatgatcaaagatttaaaattcaagatcgctgcattcatcgtctcctcgtcgatcgatcatggcaaagatcgatggagagagagaggtgtgtgtcactgacgcagggaaaaactcaatgcagatttaccagcaagaacaagagctggatgctattcttttgctctaccttttttcttctctctttcttcttctctgtttcttgattgggcgagcgagatggagatggatctgatcatgaatgggacacaagtgggcatgtaaatgaggagctccctagaaggcgagagagattggccaagcgtcgcctcaagcagtgtaggagtatctatcttttgccgtttcgctcgctttctttccttcttttctttcaccatggccaacaacgatgactctgggtgtcaacatcacagctcattttgttcggtctcatgttgcatcattcactgcatgatgaccatgattcgggaaaatttgctccatgcacctccgcttggccgacaacacttgccctctagtaagcatccttaaacacccacggtttctactactattcatcgctttataaatcctacggagtgctagctttacgctactactactgtcatgtaatctatcatcatcaaaagagacgatcagattaacatatatgtcaactatttaagctttggctctttgctttccaagaaacgtaactgccgagatgtggagcatatagaagtattcgtccttctagatgttggtactaaagtaatgttctttcttttctccctct

SEQ ID NO: 5208 - DNA, 2001 bp, Oryza sativa
  Predicted polypeptide sequence is orthologous to G2
gacgtcccatccatccctccccccccttttccctcctcctccacctccactgccatggccgcctccgccgctcctctctcccgcgtggtagccgccgccggttgccgccgctaggggagcgcgacgggggaacggtaggggcgacccagctcgctctgtcgccccgcggctggtgggggtgcgcgcgggggagagcggttggttagtatggtgctggatctcaatgtggagtcgccgggtgggtcggcggcgacgtcgagctcgtccacgccgccgccgccgcccgacggtggcggcggggggtacttccggttcgacctgctcggcgggagccccgacgaggacgggtgctcctcgcctgtcatgacgcgccagctcttcccttcgccgtctgcggtggtggcgctggcgggggacgggtcgtcgacgccaccgctgacgatgccgatgccggcggcggctggggaggggccgtggccgcaccgcgcggcggatctcggggtggcgcagagccagaggtcccccgccggcgggaagaagagccgccgcggcccgaggtctcggagctcccagtacaggggcgtcaccttctacaggaggaccgggcgatgggagtcgcacatctgggactgcgggaagcaggtgtacctgggtggtttcgatacagctcataccgcagcgagggcctatgatcgcgcggcgatcaagttcagaggcctcgacgcggatatcaactttaatctgaatgactatgaggacgacttgaagcagatgcgcaattggaccaaggaggagtttgtgcacatacttcggcgccaaagcacaggatttgcaagggggagctcaaagtaccggggtgtgacactgcacaagtgtggccggtgggaagctcggatgggccagctgctcggcaagaagtacatctatctaggattgtttgacagtgaaattgaggctgcaagagcatatgaccgggcagctatccgcttcaatggaagggaagctgttactaattttgatcctagttcttatgatggagatgttctacctgaaaccgacaatgaagtggttgatggagacatcattgacttaaatctgagaatttcacagcctaacgttcatgagctgaaaagtgatggtaccctaactgggttccagttgaattgtgattctcctgaagcttcaagttctgttgttactcagccaataagtcctcagtggcctgtgcttcctcagggcacatcgatgtcccagcatccacatttatatgcatctccttgtccgggcttctttgtgaacctcagggaagtacctatggagaaaagacctgagttgggtccccagtcgttccctacttcgtggtcatggcaaatgcagggctcccctttgccattactccctactgcagcatcatcaggattctctacgggcaccgtcgccgacgccgcccgctcgccttcctcccgcccccatccatttcccggccaccaccagttctacttccccccgaccgcctgactgccacctattctggtggaggcgacacctcaccgtgcatccaccgccgcttgctgataacattcgtcgtttgtccagagagggaccttctccatatgatatccctctctatgttccacctggttatgatcagaattctcacgctcatgattcttttatcttcatttttgagtgcgaaaccacgaatcgtgaccatgctaccaggtaaacacccttgtacctctttgactctacaataaaattaatgtaagatattctggctaaaagtgattggccctccctactgtatttttacagagttgtaatttgaacagtgggcactaaagctggggcccactcgcaccagtgtctagtggagcgaagctttgcccttttcttgctatccagcaactattcctccgcctgcctccattgctgacagtggagatagcttcccagtggtcactgttccactgtactctgtcatagtttctgatcacccct

SEQ ID NO: 5209 - DNA, 1380 bp, Oryza sativa
  Predicted polypeptide sequence is orthologous to G2
atgtgggacctcaatgactcgccggcggccgaggccgcgccgccgccgctgtcgccgtccgccgacgactccggcgcctcctcgtcctcggccgccgccgtcgtcgagatacccgacgacgccgacgacgactcggccgctgtggttgtcgtcacgcgccagttcttccctccggccgtcccgggcggcggcggcgaccccgcccccgggaacgcgcgcgccgggtggctccgcctggccggagccgccccgccggtcgctgcaacggggccggcggcgtcggcggcggtgtccaagaagagccggcgcgggccgcggtcgcgcagctcgcagtaccgcggcgtcacgttctaccgccgcaccgggcgatgggaatcgcacatatgggattgtggcaagcaggtctatttgggcggatttgacactgctcatgcggcggctcgggcgtacgatcgggcggcgatcaagttccgcggcgtggaggccgacatcaatttcagcttggaggattacgaggatgacctgaagcagatgagcaacctgaccaaggaggagttcgtccacgtgctccggcggcagagcacggggttcccccggggaagctccaagtacaggggcgtgacgctccacaagtgcgggagatgggaggctcggatgggccaattcctcggcaagaagtacgtctacttggggctgttcgacaccgaggaggaagctgccagggcgtacgaccgcgctgccatcaagtgcaatggcaaggatgcggtgacgaacttcgatccaagcatttacgccggggagttcgagccgccggcggccacgggtgatgccgccgagcacaacctggacctctcgcttgggagctcggcgggctccaagaggggcaacgttgacggtggcggggacgacgagatcaccggcggcggtggcggtggcgcgggctccgaccagcgcgtccctatggcgttcgaccttgactggcaaacggcggcggcgaggagcaccaaagctaagttcgaccagaactcgaaccatccccagatgcctccggtcctgcaggtcacccacctgccattcagtcccaggcatcatcaccaattcttgagcaatggtgatccggggacagcgggaggcctgtcactgacgatcggcgcaggcatggccgggcactggcctccccagcagcagcaggggtggggcaacgccggcggcatgagctggccgcacccgccgcacccgccgccgccgccgaccaacgccgcggccgccgcaaccgctacagcagctgcagcatcatcacgattccctccctacattgcgacgcaagcctcaacctggctgcagaagaacgggttccattccctgacccggcccacctaa

SEQ ID NO: 5210 - DNA, 1342 bp, Oryza sativa
  Predicted polypeptide sequence is orthologous to G2
gtgtttggttgggttgccggtgtggtgaggattggagatgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 5211 - DNA, 759 bp, Oryza sativa
  Predicted polypeptide sequence is orthologous to G2
ggattgtgggaagcaggtgtacttgggtggattcgatacggcacaggctgctgcaagggcttatgaccaggctgcaatcaagttccgtggagtggaggcagacatcaacttcaccctggatgactacaaggaggacataaagaagatgaacaacttcagcaaggaggagttcgttcaggttctccggcgacagggcgccggcttcgtcagggggagctcgcggttcagaggtgtcaccctgcacaagtgcggcaaatgggaggccaggatcggccagctcatgggcaagaagtacgtgtaccttggcctgtatgacacggagatggaggctgccaaggcttatgacaaagcggcgatcaagtgctgtggcaaggaggctgtgaccaactttgacacccaagcgtacgaggacgagctcaacctgcaatcttgggatagcgagcttgatcttgagctcagcctcgggtgctccggtggcgaacgggccgccggcgaggtcctccactctgcaccaagcaaccagaggacgagcctgacgttcatgctgccggaggaggaggagatgaccgcctgccaccgtcagaggagcatctgggctaggccttccttggctccggcgatgccggacggcggcgcggtcatccgccctgatcagcatcagcatcaccccagtagccggaacatgctcctgatggtatgtatgcttactgacagtggtgttcctacattgatcttcctgagatcacgggccctgagtag

SEQ ID NO: 5212 - DNA, 1305 bp, Oryza sativa
  Predicted polypeptide sequence is orthologous to G2
atgttgttggatctcaatgtggagtcgccggaacggtccggcacgtcgagctcctcggtgctaaactccggggacgccggaggcggcggtggcggtggcggtggcggaggattattccggttcgacctcctcgcgagcagccccgacgacgacgagtgctccggggagcagcatcagttgccggccgcctcggggatcgtgacgcgtcagctcctcccgcctccgcctcccgcggcgccgtcgccggcgccggcgtggcagccgccgcgccgcgcggcggaggatgccgccctcgcgcagcggccggtggtcgcgaagaagacgcggcgcgggccgaggtcgcggagctcgcagtacaggggcgtcaccttctacaggaggaccggccgctgggagtcgcacatatgggattgcgggaagcaagtctacctaggtggtttcgacacggcgcacgcggcagcaagggcttacgatcgcgctgcgatcaagttccggggactggaggctgacatcaacttcaacctgagcgactacgaggacgatctgaagcagatgaggaactggaccaaggaggagttcgtgcacatactccggcgacagagcacgggattcgcgagggggagctccaagttccgcggcgtcacgctgcacaagtgcggccgctgggaggcacgcatgggccaacttcttggcaagaagtacatataccttgggctctttgacaccgaagttgaagctgcaagagcatatgacagggcagctattcgcttcaatgggagggaagctgttaccaacttcgagcctgcatcctacaatgtggatgctttaccagacgccggaaatgaggcaattgttgatggcgatcttgatttggatttgcggatttcgcaacctaatgcgcgtgactccaaaagcgatgtcgccacaactggcctccagttaacttgtgattcccctgaatcttcaaatattacagtccaccagccaatgggctcgtctccccaatggactgtgcatcaccaaagcacaccactgccccctcagcatcaacgtttgtacccatctcattgtcttggcttcctcccgaacctacaggagaggccaatggacagaaggcctgagctgggtcccatgccgttcccaacacaggcttggcaaatgcaggccccttctcacttgccattgctccacgctgcagcatcatcaggattctctgccggcgccggcgccggcgtcgccgccgccacccgccggcagccgccgttcccggcggatcaccccttctacttcccgccaaccgcctga

SEQ ID NO: 5213 - DNA, 1005 bp, Oryza sativa
  Predicted polypeptide sequence is orthologous to G3
attccgcgaggatggataggtgggaggccaccgtcttcttgcccccgccgccgccaccgcagccgacgcagccgcagcagcagcctgcggcggcggcggtgagggctccggtaggcgggaggggtgggggaggagggaggcagtatcgcggggtgcggatgcggaagtgggggaagtgggtggcggagatccgcgagccgaacaagcggtcgcggatctggctcggctcctactccaccgccgtcgccgccgcgcgggcctacgacaccgccgtgttctacctccgcggccgctccgcgcgcctcaacttccccgaccagctcgacggcgcgggtggtggtggcgcgggcgccggcggcgccgaggaccacagggagctcaccgccgccgtcatccgcaagaaggccgccgaggtcggcgcccgcgtcgacgcgcagcactccgtcgtcggcgccgcggcgcccgtgccgctccagccgccgcagcccccgccgccccagcgccgccggaccaagaaccccgacctcaaccgggagcccaccccggacacctccgacgacgagtagtaatccgtgctaattttgcctcccttcttccatccatctagttcgtagtccttagccaccccaagacacagagagagagagagagtagcagctagtagctatagctagtcagcgaagcagatagcgccaaggaggcggtcgtggacggggcgcatgcaaggtgttcggcgaaatgcgattgaggtcggaggagcccacaagtatatccaataatggagccgcgacgtcgccgtcaagccggggaagtggtggttagcaagtaggaatctagagctcagctcgtcgtctgttccggcgacggcgactgtactaggagcgtgcgtgtcagcgtgagcatgtagctaaaagcaagacggctatgtacctcacccttttcgcttaagcgtttgtttgtaaagagaagatacccagcaagcaagacaaaaaaaacagcttcaag

SEQ ID NO: 5214 - DNA, 427 bp, Oryza sativa
  Predicted polypeptide sequence is orthologous to G4
ccgacttcgaggagttcgaggtggactccggggactcggatttggagctcggggaggaggacgacgatgacgtcgtcgagatcaagccggccgccttcaagagggccctctccagagataacttgatctccattaccactgccggatttgatggtcctgctgcaaagtctgccaaaagaaagagaaagaaccatttcaggggcatccgccaccgcccttggggtaagtgggctgctgaaatcaaaatcctcgcaagggtgttcgtgtctggcttggcactttcaacagtgctgaagaagctgcaagagcttatgatgctgaaccacctcggattccgtggcaaagaaggcccaaggtgaatttttccagaaggctcccaacaacttgcctcaaaaagcgttctgttgctgggctcccccccacttgc

SEQ ID NO: 5215 - DNA, 1260 bp, Oryza sativa
  Predicted polypeptide sequence is orthologous to G4
gtctcaaacccaatcaaactccaaccaaactcacctacctacccccaacccatccagagctagagctatgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatgagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctgatgctgtcaaatcacatcgccattggcggccattgcaagccatggcatggcacctgatgatgctgatccagcgaactggtcactcgttcttgatgcgttttcagtttcttgtacagtgtttttccccagcaacagtgaagtagtattcagttattcactgttcagtcatgagttcatcgcaaaatatgatgtaagtatgtgtcttgagattgttttagcagtggcttttgtttgtataatgtatttctctgtaattaattaatagctgttttcagtgatgaactaaattttctg

SEQ ID NO: 5216 - DNA, 1433 bp, Oryza sativa
  Predicted polypeptide sequence is orthologous to G4
agactacaagccattaaacagagacgaccaacgacttaaccacacttcttctttgtgctgtccaacctccattgttgggtgtgaaagctttggctcatctgccatgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttattgagcatttgattctatttaggagggagtgaattatttgggaggaagaatcgatgttgtaacttgtaaaatctctgatgatgatctctgcatcatatgatcaatttgagtgcagttttgtttttgtaaatacgaattctttattatgatgttaggttcttaatttgcccttcttcatcagggatttgttcaggcttttgttgtgatgactgattggacgagggaaagattgcgttttttgttgtcatgttgggtactctactcttctgttcctaaagttgataagtgccaaaatttgtgagagg

SEQ ID NO: 5217 - DNA, 1107 bp, Oryza sativa
  Predicted polypeptide sequence is orthologous to G4
agatattcagacacacaccttcaataacttgcaaggataactcaaactacttgaatcagatcagacaaaaacatcataagaatatcacgatgtgtggaggagcactgatcccgaacgactatggcgacaagccgccgccgccgccgtcggagtcgtcggagtgggacgccacaacgaagatgaagaagaagaagaagcgtggtggcggcggcgacgacgactgggaggccgccttccgggagttcatcgctggcgacgacgacgacgacgacggcggcgtttccatgttcccttctggtgcagggacgatggagacgaccacagaggtggcgccggcggcggcggtggtggagaggccgcggcggcggcgaagggtgaggcggagctacccgtaccgcggcgtccggcagcggccgtgggggcggtgggcgtcggagatccgcgaccccgtcaagggcgcccgcgtctggctcggcaccttcgacaccgccgtcgaggccgcgcgcgcctacgacgccgaggcgcgccgcatccacggccacaaggcaaggaccaacttcccgcccgacgagcctccgctgccggcgccatcgcaggcgccgttctgcttcctgctcgacgacgacgacgacgacgacggcgtggcccgtggaaacagcccggcgtcgtcgtcggcgccggacagagcctccgcttgcacgacgtcgtcgacggtggcgtccggcgagcgaggcgatgagctcatactgctggagtgctgctccgacgacgtgatggacagcctcctcgccggcttcgacgtgtccagcgaaccacgcagtgttttgggaatggttaattagcagcgcgcacgcctgattagatcggtacatgtgaagtacaagagaagtagttactactagctaggagcaaattaacttggagtgcaagaataaaatatgcatgtctctgcactactactgtagtgttagcaagtttgctcattgttctgttgtatcctttcatgtccatttcagacttcccaatgctacataaggatgtacatatgtatgatgttgtgtgccttgttaatcaatgaatgtaaatatctttatattgcttttgtac

SEQ ID NO: 5218 - DNA, 1689 bp, Oryza sativa
  Predicted polypeptide sequence is orthologous to G4
gtctctccaatattttgtcgaaccgattgagggaaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgacc

SEQ ID NO: 5219 - DNA, 1575 bp, Oryza sativa
  Predicted polypeptide sequence is orthologous to G4
gaaaggcattcgcaacacacacttgaagaaaaaaaacacgacgaacacgttaaaaaaaggtcgaagagaagtgggagacccaaaccgcgaacaatgtgtggaggcgccatcctcgccgagttcatcccggcgccgtcgcgcgccgcggcggcgaccaagcgggtgaccgccagccacctgtggccggccggctccaagaacgccgcccgcggcaagagcaagagcaagaggcagcagaggagcttcgccgacgtcgacgacttcgaggccgccttcgagcagttcgacgatgactccgacttcgacgacgcggaggaagaagacgaaggacacttcgtgttcgcgtccaaatctcgtgtcgtcgccgggcacgacgggcgcgcggcggcgagggcggcgagcaagaagaagcgggggcggcacttccgaggcatccggcagcggccatgggggaagtgggcggcggagatccgcgacccgcacaagggcacgcgcgtctggctcggcacgttcaacaccccggaggaggccgcacgcgcctacgacgtcgaggcgcgccgcctccgcggcagcaaggccaaggtcaacttccccgccacgcccgccgccgcgcgccctcgccgtggcaacacgagagccaccgccgtgccaccgccggcgacagcacccgccgccgccccgccgcgcggactgaagcgagaattctcgccgcctgctgagaccgcgctacctttcttcaccaacggcttcgtcgacctgacgaccgccgcggcgccgccaccggccatgatgatgacgagctccttcaccgacagcgtcgccacgtcggagtccggcgggagccccgccaagaaggcgaggtccgacgacgtcgactcgtccgagggcagcgtcggcggcggcagcgacacgctgggtttcaccgacgagctggagttcgacccgttcatgctgttccagctcccctactccgacggctacgagtccatcgacagcctcttcgccgccggcgacgccaacagcgcgaacaccgacatgaacgccggcgtcaacctgtggagcttcgacgacttcccaatcgacggcgcccttttctgatgtactcctccattgatgcagtttgtgcactcaattgttaatcacgtcgtcgttgatgaatgtttaaccggaggatgatggggtgcagctgatatcatggcttgcttgattaccgaattatattgcggtgtttgtgtttgtcaattagattctgaatctgtactactgccgatcttatgatcaaaactatatattaagtttatgtactcttaatttgtgggctacttttacggggtcttcgtactgctggtcaaatagtcctatgaaatcgatcatgtcggcaatatcgtcgtcaattatcgtggtcgtggttgttaatgatgtcaaataagtctatgaaaacctggtcctcttggtgtttatgtaccactgatcgatccatcatttgatctctgtcatgttgagatggatcgtgtaagaatatcataatttgctggattcagtccagtcgtaatgtattttggtttgtacaactgc

SEQ ID NO: 5220 - DNA, 1516 bp, Oryza sativa
  Predicted polypeptide sequence is orthologous to G4
gacccacaacccccaagcatcagcatcacaacccaccaatcgaatcgatcgaacaagacacgacaccatgcgccgccgcgtctcctcctcctcctcctcctcctcgtcctcgtcgccggcgaggcatcacaaggcgcggcgcagcaggaggaagctcgccgtcgacgaggactgggaggccgccttccgcgagttcctctcccgcgaccacgacgacgacgacgacgaccacgacggtcagcatgtcgttgttgcgccgttgatccgtggtagtgacaagtgcgtccacggccacgaggtggtggcgtcgacggtcggcggtggcgcaagcggcggacgacgacgagccgacgacgacgacggcgagcggcggcggcggcggcggagggagaagcggagctacccgtaccgcggcatccggcagcggccgtgggggaggtgggcgtcggagatccgcgaccccgtcaagggcatccgcgtctggctcggcaccttcgacaccgccgagggcgccgcgcgcgcctacgacgacgaggttcgccgcatctacggcggcaacgccaagaccaacttccccccatcgccgcccacgccgccgccgccggagaagccagcggcggagaggagcccctcgacgacgccgacgacgaccacggaggactccggcgactcgcgcatactcatcgagtgctgctccgacgacctgatggacagcctcctcgccgccttcgacatgaccaccggcgacatgcgcttctggagctaacgaacaacagagcagattcaggtaattaaatccacacccaagcaggtctaaaagtttttaacaatttcatgaaacaaaattaacaacaaatccagtaagataaataggatttaacaaggattgcaatggtaattattgcacaattttaccatttcggtgctttcaactgttcaatcaccgaaagaaattcagcaacttttgaagggcactgctacgcgtacttaatttctttttttcttctacaaaacactttctaaacaagttctcgaatgttccatttaattagatgggagtaaaaaagaaatccagaattagttatagcatgtggcattagccatgaaagttttagtaaaaaaaatttgcacttttgaatgatctagatcatagaggatcagtcgaattctgtgtgttcatgccatttctagcatttacgtgcagtattaaataaagttactactatttttttcttgttttctctatgttactcatcatgattttacatttttctttcccttttgacaggacaacataaacggcacgtctttgcaaccttgacatgcgactcgcctaataatcttgtcaaacaagggccgccagcttaattagctttttccaaaggtggggaacaattttgggggatgcaattaggacgcacagagatgaccccaacttgtcaatgggaattgaactctgatgacctttgtaatgataatcaaggcaccacattgtggggttaagcaaagttttggc

SEQ ID NO: 5221 - DNA, 1430 bp, Oryza sativa
  Predicted polypeptide sequence is orthologous to G4
cccgcgtcgcgccatagcgacgtctctcccggagaaagaagagcgcgccgcgccatgtgcggcggtgcaatcctcgccgatttcaccccggcgagggtgccccggcggctgaccgccgccgagctcctgccggtgaccccgactccccccgccgccgagaggagaaccacccggaagcgcaagtccgacgtcgacttcgaggcggagttcgagcttttcgaggacgacgacgacgacgatgagttcgagctttccgacgatggcgacgagagtttggccgtgtcatgtgtgtcgtcccccaagtcgaaggcagtaccttcgttttctttttcgtcggatgtctcctcgagctccaggccgcggcggcgcgtggcggcggcggcggccggtcgtcggaaggcgagcaagaagagcaagtacaggggcgtccggcgccggccgtcggggaggttcgcggcggagatcagggaccccaagaaggggcggcgcgtgtggctcggcacgtacggcagcgccgaggaggccgccatggcctacgaccgcgaggcccgccgcatccgcggcaagggcgcgaggctcaacttcccccgcgacggcgatggctcccctcgccggagtaacgaccggccctgctggaccatcgacctcaacctccccgcggcggccgtctccggtgacgacgacgacgccatggccgtcgacgccgcagacgcagacgcaggcagtgctggccgtgcagcagcctatgcagatcaagaagcactgagcgcggcaaagtgcaagatcaagcagtgtcctcgcgacgaacagatggcgagcgccacacctgagctcatggaggaggacgcgagcagcagcagaaacatggtgcccctgtccatggcgctgcagctgcagtatgcggcgatgatcgccgaatgcgaccgcgagatggaggagatcgccgccgtggagagggacctcgagaggcgcaggaggcaggtgttcgagcgcagaggccacctggtcaggcaggcctctcttctgctcgactgacgatcttgctgaactgaactctgaatgtttgagcttgtctgaagtctgaactctgcactatgccatatggtgtttcaccttcactgtgaggctgacatgtgggccagacgtccgtttgccttgcttgcttttgagctgcaactgggcgttgtgctgcaagcctgcaaagtgcctgtgtaaagtttgtgggattgtgtgtgtggatcttgtatccttgtgactttgcaagctttaattttgtgaggaacaatagtattttagattggtgtgtaaaatatagaaataaataatagtagcaactaaattttggttttcagctcttcatcagatggtttgtcatgggaacaaaatttcaaacatgagcaaattaaggtcatgttattatcaattgtgat

SEQ ID NO: 5222 - DNA, 927 bp, Oryza sativa
  Predicted polypeptide sequence is orthologous to G4
atgtgcggcggcgcgatcctcgccgacctcataccgtcgccgcgctccggcggccacaccaaaaagaacaagcggcggcggatcagcgacgacgaggacttcgaggccgccttcgaggagttcgacgccggcgacgacgactccgactccgactccgagtccgaggaggtagacgagtacgacgtcgtcgtcgacgacgacgacagcgaggacggcgtggtggttcttccgccgccgccgccgccgccgccggtgattccacatggtgaggcgatcgatcgatcaagaattgagcgccatggcgcgaggcggttccgcggcgtgaggaagcggccgtgggggaagtgggcggcggagatccgcgaccccgtgcgcggcgtgcgcgtctggctcggtaccttccccaccgccgagtccgccgcgcgcgcctacgacgccgccgcccgccgcctccgcggcgccaaggccaagcccaacttcccctccgcgccgccgccctcggctgctgctcaccgccgcaagaagcgccgcgcccacgccgccacgcgctcgccgtcgtctccgcccgccaccagcgaggtcacggcggcgtccgcgtccgcgtccagcgatgtccccgcgccggcgttcgcttccttcgtcggcgagcccgggcacggcggcgccaagtcgatgccgacgacgagccacacctcgcagccagccccgccggcgacggtggcgtccgagaacgtcgacgacccggaggtgttcgacccgtacgacgtccacggcggcctcgcctcctacttcgccggcggcgcgtacgagtccctggagagcctgttcgcgcacggcggcgacagcgccgccgtcgaccaagcggcgagcgaccactggccggcggcgctatggagcttcgcagacgacggctcgttctgcttctga

SEQ ID NO: 5223 - DNA, 1687 bp, Oryza sativa
  Predicted polypeptide sequence is orthologous to G4
ttctctccaatattttgtcgaaccgattgagggaaaaaaaaagagaaaaagaaaagaaaaaaaagaagaagaagagagaactcgaactctcgcctaccatttcgcccccctccgcaagcaatccaccactgcatcggcggcgagggctcaccggcggcgagccatgtgcggcggcgccatcatccaccacctgaaggggcacccggaggggtcgcgccgggcgacggaggggctcctgtggcccgagaagaagaagcccaggtggggcggcggcgggaggcgccacttcggggggttcgtggaggaggacgacgaggacttcgaggccgacttcgaggagttcgaggtggactccggggactcggatttggagctcggggaggaggacgacgatgacgtcgtcgagatcaagccggccgccttcaagagggccctctccagagataacttgagcaccattaccactgccggatttgatggtcctgctgcaaagtctgccaaaagaaagagaaagaaccaattcaggggcatccgccagcgcccttggggtaagtgggctgctgaaatcagagatcctcgcaagggtgttcgtgtctggcttggcactttcaacagtgctgaagaagctgcaagagcttatgatgctgaagcacgcaggattcgtggcaagaaggccaaggtgaattttccagaggctccaacaactgctcagaagcgtcgtgctggctccaccactgctaaagcacccaagtcaagtgtggaacagaagcctactgtcaaaccagcattcaacaatcttgccaatgcaaatgcgtttgtctacccatctgctaacttcacttcaaacaagccgtttgttcagcctgataacatgccatttgttcctgcaatgaactctgctgctcctattgaggaccctatcatcaactctgaccagggaagcaactcatttggctgctctgactttggctgggagaatgataccaagacaccagatattacatcaattgctcccatttcaaccatagctgaagtcgatgaatctgcattcattaagagcagtaccaacccaatggtccctcctgttatggagaacagtgctgttgatctgcctgatttagaaccctacatgaggttccttctggatgatggtgctggtgactcaattgatagccttctcaacctggatggatcacaggatgttgtcagcaacatggacctctggagctttgatgacatgcccgttagcgatttctattgaggaattcgaagtcttctagtcggagcatgtacacagggaaaaaaaaggaataaatactattggagattgggaggcacctgcatggcaccttgggggtagcatatcgttatgtttagcttagatgcaaaaggctgcatcctgaaactctttggtgattggacctgttccctatccgctgtctatgtatggcagccatctatgagactcaagaactgcttttttttttccgttctagttttctgtcgttgctacctgtatatggctatgaacatcgtgaatccatggccattatgttttaatctatgttgttgactgctctttctttcggtctttgctgtgctgcgctatgttggtgataactagctaccatattgattttctgtacataattcatttgttgaatccgaaattaaatagtgcattgac

SEQ ID NO: 5224 - DNA, 1447 bp, Oryza sativa
  Predicted polypeptide sequence is orthologous to G4
gcctccttcagactacaagccattaaacagagacgaccaacgacttaaccacacttcttctttgtgctgtccaacctccattgttgggtgtgaaagctttggctcatctgccatgtgtggaggatccattctcggcgaccttcacttgccggtgcggcggacagtgaacgccggtgacctgtggggagacgccggcaagggtagagatggtggcgacggcttgaagaagaggaaggggagttcttgggatttcgatgttgattgcgatgatgatgatgatgatgactttgaggctgattttgaggagtttgaggatgactatggcgatgatgatgatgtgggtttcggggacgacgaccaagaatccgacatgaacggtctcaagctcgccggattcagcaccacgaagctcggcctcggcggcagcaggaagaggaagacgcgataccgagggatccggcagcggccatgggggaaatgggcggcggagatcagggacccccgcaagggcgtccgcgtctggctcggcacgttcggcaccgccgaggaggccgccatggcgtacgacgtcgaggcacgccgcatccgcggcaagaaagccaaggtcaacttccccgacgccgccgccgccgccccgaagcggccacggcgttcttcggcgaagcattcgccgcagcagcagaaggccaggtcgtcgtcgtcgtcgccggcgagcctgaacgccagcgacgccgtgtccaagtccaacaacaaccgcgtcagctcggctgggagcagcaccgacgccaccgccgccgccatcgccatcgacgacggcgtcaagctcgagctgctctcggagacggatccttctccgcccatggccgccgccgccgccgcgtggctcgacgcgttcgagctgaacgatcttgacggatcaagatgcaaggacaacgcattcgatcaccagattcacaaggtagaagcggctgtcgctgatgaattcgcgttctacgacgatccgagctacatgcagctgggttaccagctcgatcagggcaactcgtacgagaacatcgacgcgctcttcggcggcgaggccgtcaacattggtggactctggagcttcgacgacatgccaatggagttcagagcttattgagcatttgattctatttaggagggagtgaattatttgggaggaagaatcgatgttgtaacttgtaaaatctctgatgatgatctctgcatcatatgatcaatttgagtgcagttttgtttttgtaaatacgaattctttattatgatgttaggttcttaatttgcccttcttcatcagggatttgttcaggcttttgttgtgatgactgattggacgagggaaagattgcgttttttgttgtcatgttgggtactctactcttctgttcctaaagttgataagtgccaaaatttgtgagaggaaaaa

SEQ ID NO: 5225 - DNA, 1214 bp, Oryza sativa
  Predicted polypeptide sequence is orthologous to G4
atcacaagctcacaagttcacaacccaacacccaaaagcaaaagaaaagcagcaaccaaagatgtgcggcggagcgatccttgcggagctcataccgagcgcgccggcggcgaggcgcgtcacggcgggccacgtctggccgggcgacgccaacaaggccaagaagaagggcgcgcgcgccgacgacttcgaggccgcgttccgcgacttcgacaacgactccgatgacgaggagatgatggtggaggaggcggaggaggaggaggcgacctccgagcacaagccgttcgtcttccgcgccaagaaggcggcggcggcggcgtcgagcaggcgcaggaagccggcgcagtacaggggcgtgcggcgccggccgtgggggaagtgggcggcggagatccgcgaccccgtcaagggcatccgcgtctggctcggcaccttcaccaacgccgaggccgccgcgctcgcctacgacgacgccgcgcgcgccatccgcggggacagggccaagctcaacttcccttccgctaccacccctgacacccgcaagcgcggccgcgccaccgccgccgccgccccggccgtcaaggcgaccccggtcatcaacctcgtcgaggaggaggacgaggaggaggtcgccgccgccatggcgtccatcaagtacgagcccgagaccagcgagagctccgagtcgaacgccctcccggacttctcctggcagggcatgtcggcctccgacgagttcgccgtcgccgcggcggcgctgtcgctcgacagcgacgacgacctcgccaagaagcgtccgaggaccgagccggaggacaccaccgactccggctccggcgacgacaccgacgcgctgttcgacgcgctgctgttcgccgaccagtacaaccacttcaacggcggcgcctacgagtccctggacagcctgttcagcgccgacgccgtgcagaccaccgccgccgccgccgccgccgaccagggcatggggctctggagcttcgacgacggctgctgcctcgtcgacgtcgaggccagcttgtccttctaggctctagccgtcgtctccggcgaccctgtgactcgatcttgtaccatgtcatgtacatagaagagtggttttgccaagcaagcatgtgttcgtcctggttcctttcggtaatgaaaaattatgtgaggcttctcgttctcgtaaaaaaaaaaaaaaaaaaaaa

SEQ ID NO: 5226 - DNA, 1613 bp, Oryza sativa
  Predicted polypeptide sequence is orthologous to G4
ctgtagcttattagcggccatgtgcggcggagcaatcatctccgggttcatcccgccgtcggccgctgcggcggcggcggcggcggcggcggcggccaagaagcagcagggcaggagggtcacggccgacgtgctgtggccggggatgctgcggaaggggaaggcgggggcggcggaggaggactttgaggccgacttccgcgagttcgagcgtggcatgagcgacgacgaggcggaggggggcggcggcgaggaggaggaggaggaggaggacgacgtggtcgtggaggtccccccgccggcgacggcgaggttcgtcgtccgtgccgcggccaaggcggcgcccccaactgcagatgggatgttgactacaaagcttgtccaacatgatggacctactgctagatcggcaaagcgcaagaggaagaatcagtacagggggatccgccagcgtccctggggcaaatgggcagctgaaatccgagaccccagcaagggtgtccgtgtttggcttggaacatataacactgctgaggaggcagctagggcatatgacgctgaagcccgcaagatccgtggcaagaaagccaaggtcaactttcctgatgaaccagctgttgctcagaagctctccctgaagcaaaacgctgccaagcaagagaaactagctccacctctgaagtcctgtggcgatgatgctttctttcagctaaacagttcagacaatgatttgtttgcaatgcttgcaaaggtgcctgcaaagccggcagagcctgttgatctcatgcctccagtcaaacctcttgcttccactgagacattcgagatgaacatgctctctgatacgagcagcaactcatttggctcttcagactttggttgggaggatgacaccctgaccccagactacacttcagtctttgttcctaatgctgccatgccagcatatggtgaacctgcttacctgacaggtggagcgccaaagagaatgaggaacaactatggtatcgccgtgccccagggaaatggcatgcctaatctcgcacaaaacatgcccaccttcgatcccgagatgaagtatttgccattaccttatgttgagagcagctcagatgaatcaatggacaaccttctgcaaaatgatgctacacaagacggggcaagcaacgagggcatctggagccttgatgagctgctcatggcagctggtgcctactgaggagacgaaatgttctggtcagtgtggtctgtcactagcaaaccatgtaaggcactccacactacctactattttgatttcttgtagatacattttcatgtttgaatgtgtatggccaagatgaagagctggtgatgtctgctatgttttgtagagggatgctaccaaagtaatgctagaatattacaagctgctatcagctgtactctctatgacaatgtttatactatgtttgctgtatggtgtggtctatgatttgaagtatgtcggagactaattcaaataatgcccttgggccatggtgctgtgccttggtaaatggtgctttatttaagggttatattaggttggtgcctcagtaattgccgttttctaccaaaaaaaaaaaaaaaaa

SEQ ID NO: 5227 - DNA, 420 bp, Oryza sativa
  misc_feature (24)..(24): n is a, c, g, or t
  misc_feature (29)..(29): n is a, c, g, or t
  misc_feature (41)..(41): n is a, c, g, or t
  misc_feature (63)..(63): n is a, c, g, or t
  misc_feature (70)..(70): n is a, c, g, or t
  misc_feature (73)..(74): n is a, c, g, or t
  misc_feature (92)..(92): n is a, c, g, or t
  misc_feature (119)..(119): n is a, c, g, or t
  misc_feature (163)..(163): n is a, c, g, or t
  misc_feature (177)..(178): n is a, c, g, or t
  misc_feature (185)..(185): n is a, c, g, or t
  misc_feature (210)..(210): n is a, c, g, or t
  misc_feature (224)..(225): n is a, c, g, or t
  misc_feature (228)..(228): n is a, c, g, or t
  misc_feature (236)..(236): n is a, c, g, or t
  misc_feature (261)..(261): n is a, c, g, or t
  misc_feature (278)..(278): n is a, c, g, or t
  misc_feature (300)..(300): n is a, c, g, or t
  misc_feature (303)..(303): n is a, c, g, or t
  misc_feature (337)..(338): n is a, c, g, or t
  misc_feature (340)..(340): n is a, c, g, or t
  misc_feature (359)..(359): n is a, c, g, or t
  misc_feature (361)..(362): n is a, c, g, or t
  Predicted polypeptide sequence is orthologous to G5, G974
tggcccaagacggaggggttcgcnctcancaagtacccgtngtacgagatcgactgggactcnctgctcnacnncaataactagctcttctnttccatagcccgccattgccggccggngcagattaggttttaggcattctgcgcggcggcgaggcgatggnttatatgttcgttnntgtgtanatccttttctttttgtgttggtttnttaggttccggagnntgntcgccggngtcgtttttgtgtccggcgtctccnatgtctagtaagcagtnactcgttagtgtagtagttgtncanctctacaaatgtacaaatacttgtgcatgtaggnngntgtaatcaattgttggtancnncccgtaatagaactactgtgaattaactgtattaatgtgcaaaaaaaaaaaaaaaaaa

SEQ ID NO: 5228 - DNA, 802 bp, Oryza sativa
  Predicted polypeptide sequence is orthologous to G5, G974
ggcacgttcgacaccgccgaggacgcggcgctcgcctacgacaaggcggcgttccgcctccgcggcgacgccgcgcgcctcaacttccccacgctccgccgcggcggcgcccacctcgccggcccgctccacgcctccatcgacgccaagctcaccgccatctgccacagcctcgccgccgcgccgcccgcctcctccaagaaagccgccgccgccgccgctcacccggactcgcccaaaggctccgcgtcgacgacgaccacgacgtcggagggagacgagtcggcgatctccgcctgttcgcctcctctcccgccgccgccaccgccgccgccggcggcgctccccgagatggcaaaccttgacttcacggaggcgccatgggacgaatccgacgccttccacctctacaagtgtccgtcatgggagatcgactgggactccatcctctcgtgatcaaatcaactttaattaattaaaattaaattaaattaaattaatgtaatcagtagcttccatgatccgatggaatattagacatcggccatggctgctgcaattagggtttaaggaggtcgtcgtcgtcatcgtagtaggattaagtcattaagaagggtttaagataagtgttcttagcttattattgctgtattaattttctgtacttagtagttattatgatctcctggttacttcgccggttgtttttttttcactcggcaaggccagttgagggtgtaatgtaatgtaacttttggttactgctgttgcaattcactctttaaaatttttgtaatgtaaa

SEQ ID NO: 5229 - DNA, 757 bp, Oryza sativa
  Predicted polypeptide sequence is orthologous to G5, G974
caacagcttagaatccttctcagtaaatctgttgattgctcgtttcaaatcatcatcggtgtttcgtttcttgatttcttgatccatccatggcgacgacagtggattggtgtggccgtggcagcaatcttcctgctgcgatgtatgacatggtggtggatagcaaggagctaatgggcgcgcttgctccgtccatggtgtccttctcctacccgtgttccgagcagagcgcgagctcgcttcttgctggcgccaactacctgactcccgcgcaggtgctccatgtccaggcgcagctacagcgcctgcgccgcccgggcgcggcgagcggctgcctcgccgcggcgccgccgctgccgatgaagcggcatggcgcggtggcggtggcggcggcggcggcggcgcgggcgccggtcaagctgtaccgcggcgtcaggcagcggcattggggcaagtgggtggcggagatccgcctgccgcgcaaccgcacccgcctctggctgggcaccttcgacaccgccgaggaggccgcgctggcgtacgacagcgccgcgttccgcctccgcggcgagtccgcgaggctcaacttccccgagctccgccgcggcggcgcccacctcggcccgccgctccacgccgcggtcgacgccaagctccacgccatctgccacgggatggacctgccccaaccccaaccccaaacccagagcaatgcgacgacgacgacgatgtcgacgacggcgacgaacaccccaag

SEQ ID NO: 5230 - DNA, 1403 bp, Oryza sativa
  Predicted polypeptide sequence is orthologous to G5, G974
cttggttaggttgcttgcagagagcgagagacccagggccttttagatccagggctcccagatctgctgtttttctttcatcttctttgtgttctagtgttaggttggtagccaagaggggttctttttccacacctcacttgctagatctaccaccaaaaagccatctgtttttttactgtggctgtcgatttctccctccttcctgcctgttcttgattttggattcggaaccaggcaaatctttgttactactgttttagtatcagaaaaaaaaatcccaaaaaaaagagtgagtagatggctgcagctatagatctgtcaggggaggagctgatgagagcactcgagccttttatccgagatgcctccggctcgcctccggtttgttcccagtttagtcccacctcgccattctccttcccgcacgcgttagcgtacggtggcgggctggcccagcagccagagctcagcccggcccagatgcactacatccaggcccgccttcacctccagcggcaggcggcgcaggccggcccgctcggcccgcgcgcgcagccgatgaaggcgtcgtcgtcgtcggcttcggcggcgggggcggcggcgacgccgccgcggccgcagaagctgtaccgcggcgtgcggcagcggcactgggggaagtgggtggcggagatccgcctcccgcggaaccgcacgcggctctggctcggcaccttcgacaccgccgaggaggcggcgcttgcctacgaccaggcggcgtaccgcctccgcggcgacgcggcgcggctcaacttccccgacaacgccgcctcccgcggcccgctccacgcctccgtcgacgccaagctccagacgctctgccagaacatcgccgccgccaagaacgccaagaagtcctctgtctccgcctccgccgccgcaacatcctccgcgcccaccagcaactgctcgtcgccgtcctccgacgacgcgtcgtcctgcctggagtccgccgactcgtcgccctccctgtcgccgtcctccgccgccaccacggcggagacgccggcgaccgtgccggagatgcagcagctcgacttcagcgaggcgccgtgggacgaggccgccgccttcgccctcaccaagtacccgtcctacgagatcgactgggactccctcctcgccgccaattaacaccaccaccacttcttggctagtactcacgccgtcgttagcctaatcgtcgccgccgccgccgccgtgcagatgggattttagacattctgcaccgcacggacgggcatggattagcagttttatagtccctaatccttttggtttggttcgtttgtgtacgtagatcgatctccggacttgtttcctctgtagatgctagggttggttggtgttcttcctcaacc

SEQ ID NO: 5231 - DNA, 1654 bp, Oryza sativa
  Predicted polypeptide sequence is orthologous to G5, G974
tttttctcttctggattcttgccgatttttaggcttcctttgcttttctaaggccagaaagggttgttttgcaatacccttctagttcatcctctcaaatttttcttctttctattcaaaagctctttctttctttgcaccctttgtttctctacttttattgaggaacagggctgatttttcacttcttgcatccaaaaagcaccccttttttctttcctgtttttaagatttccatacccttgccatcttcatcttctacctccatccagtcctcatggccgcagcaatagacatgtacaagtataacactagcacacaccagatcgcatcctcggatcaggagctcatgaaagcgctcgaaccttttattaggagcgcttcttcttcctccgcttcctccccctgccaccactactactcttcttctccttccatgagccaagattcttacatgcccaccccatcttatcccacttcctctatcacaaccgccgccgccaccaccacctcgtctttctcgcagctacctccgctgtactcttcgcagtatcatgctgcttcacctgcggcgtcggcgacgaacgggccgatggggctgacccacctgggcccagcccagatccagcagatccaggcccagttcttggcccagcagcagcagcagagggccctggccggcgccttccttcggccgcgtggccagccgatgaagcagtccgggtcgccgccgcgcgcggggccgttcgcggcggtcgccggggcggcgcagtcgaagctctaccgcggagtgcggcagcgccactgggggaagtgggtggcggagatccgcctcccgaagaaccggacgcggctgtggctcggcaccttcgacaccgccgaggacgccgcgctcgcctacgacaaggccgccttccgcctccgcggcgacctcgcgcggctcaacttccccaccctccgccgcggcggcgcccacctcgccggcccgctccacgcctccgtcgacgccaagctcaccgccatctgccagtccctcgccacgagctcgtccaagaacacccccgccgagtcagcggcctccgcggcggagccggagtcccccaagtgctcggcgtcgacggaaggggaggactcggtgtccgccggctcccctcctccgcccacgccgctgtcgcccccggtgccggagatggagaagctggacttcacggaggcgccatgggacgagtcggagacattccacctgcgcaagtacccgtcctgggagatcgactgggactcaatcctctcataaacaagcagaagcagctactactagtctattactagtactagtagtagtcttcgtcaagctagagtcactcaactcaactagctgtgtaatcttctctgaattccgtggcttccatggctcggtggcattttagacgtcggccatggctgctgcgagtagcagtaactagtcagtactcagtagtagtaaggtcgttggtattacgtcgtcgtgcaagtgtcgttggtgtactcagtgatctgatctcctggttgagctgccggttgtttttttcacggcgcggccggtcgagaattaagctgtaatcccttgttacatgttggaaattcagtagcttatgtaactatatgtacctttctc

SEQ ID NO: 5232 - DNA, 1657 bp, Oryza sativa
  Predicted polypeptide sequence is orthologous to G5, G974
aacccaaacgacggagacccactactccgagccatcaagaacacacacacatccagaaagcctaatccaatccaaaagccctaatcacccagactccatctctgtgaggtttgagagaggtaggtgagccgtagatctgagcgagttcttgggtcttccagcaggtagatcacttcatctgaggatcaatcttttttttttcctttgtttttgagcttctgttggtgtacaggacagagagttccagagccttttagtttctggtgttctgatctgttcttggtgtaagattattggtctgatttggtagccaagagggttaattttttccacacctccttgtgctagttagcttagcttataccccccttgtaaagtgattagtagatctagaacttctcttttcgtctgccagttcttggattttggaaagaacaggtggtttgttattcagatttttaggttagaaaaaatccacaaaaaaaaagatattcgatggcagctgctatagaaggaaatctgatgcgggcgctgggagaggctccgtcgccgcagatgcagaagatcgcgccgccgccgtttcatcccggcttgccgccggcgccggcgaacttctcctcggccggagtccacgggttccactacatgggcccggcccagctcagcccggcccagatccagcgcgtccaggcccaactccacatgcagcggcaggcccagtcggggctcggcccgcgggcccagcccatgaagcccgcttcggcggctgctccggcggcggcggcggcgcgggcgcagaagctgtaccgcggcgtgcggcagcggcactggggcaagtgggtggcggagatccggctgccgcgcaaccgcaccaggctctggctcggcaccttcgacaccgccgaggaggcggcgctcacctacgaccaggccgcgtaccgcctccgcggcgacgcggcgcggctcaacttcccggacaacgccgcgtcgcggggcccgctcgacgccgccgtggacgccaagctccaggccatctgcgacaccatcgccgcgtccaagaacgcctcgtccaggtccaggggcggcgccggcagggccatgcccatcaacgcgcccctggtcgccgcggcgtcgtcgtcctccggctccgaccactccggcggcggcgacgacggcggctcggagacgtcgtcgtcgtctgcggcggcgtcgccgctggcggagatggagcagctggacttcagcgaggtgccgtgggacgaggcggaggggttcgcgctcaccaagtacccgtcgtacgagatcgactgggactcgctgctcaacaacaataactagctcttctcttccatagcccgccattgccggccggcgcagatgaggttttaggcattctgcgcggcggcgaggcgatggattatatgttcgttcttgtgtagatccttttctttttgtgttggttttttaggttccggaggctgctcgccggcgtcgtttttgtgtccggcgtctccgatgtctagtaagcagtgactcgttagtgtagtagttgtacaactctacaaatgtacaaatacttgtgcatgtaggttgttgtaatcaattgttggtaactacctgtaatagaactactgtgaattaactgtattaatgtgcg

SEQ ID NO: 5233 - DNA, 966 bp, Oryza sativa
  Predicted polypeptide sequence is orthologous to G5, G974
atggatcgccaatggcgttgcctcgctgctgcggcttctactagtggtaatagtaagcttcctccgctgccgatggcgctgggcggcgccgtggagtacgggcagctcgtccatggcgcggcggcgcccgtggcgccgttcttcgtggacgccgagcagcagagcctgtcgccggcgacggccatggttcttggcgccgggtggtataactataaccttgtcacgccgtcgcaggcggcgcagctgcaccaccggctgcgacgggcggtgggcgcggcgccgtgctcgatgaagcggtgcggtggcatggcggcggcggcggcggggcggcttgcgctggtggggccggcgccggtgcaggcgaagctgtaccgcggcgtgcggcagcggcactgggggaaatgggtggcggagatccggctgccgcggaaccggacgcggctgtggctgggcacgtacgacaccgccgaggacgccgcgctcgcctacgacggtgccgcgttccggctgcgcggcgacgccgcccgcctcaacttccccgagctccggcgcggagggcggcaccacgcgccggcgctcagcgcgtccgtcgacgccaagatcctccaagccaccaccaccaccacggcggacaccgccgccgccgcagcaccggcgtcgacgaacaccacgccgccgccgtcgccgcgcgtcgtcaagaccgagccgggctgctgctccgtctccgaagcctccacgacgacgacggccgacgccgccgacgtctcgtccacagggtcttccccatccccgacctcatcgaatcaggccgccaccgccacgccgccggcgccgcggccgccgccgccgttgccggagacgattcagcagctggacttcacggaggcgccatgggacgaggccgacggcttcgcgctgcgccggtatccgtcgtgggagatcgactgggacgccatcctctcctga

SEQ ID NO: 5234 - DNA, 1539 bp, Oryza sativa
  Predicted polypeptide sequence is orthologous to G8
atggagttggatctgaacaacgtggcggaaggggtggtggagaagcatgagacggcggcgaggagcgactccggcacgtcggagtcgtcggtgctcaacggggaggcgtctggcgcggccatcgcgccggcggaagaggggtcgagctcgacgccgccgtcgccgccgccgcctcccgcggcggtgctcgagttcagcatcctgaggagctcggcgtcggcgtcgggcgagaacgacgccgacgacgacgaggaggaggaggccaccccctcgccgccgccgcaccaccaacaccagcagctgctcgtcacccgggagctattcccttccgccgctccctcgccgcagcattgggcggagctcggcttcctccgccccgacccaccgcgcccacacccagacatcagaatcctcgcccacgcgcctcccccggcgccaccgccgccgccgccgcagccgcagcctcaggcggccaagaaaagccgccgcgggccgcgctctcgcagctcgcaataccgcggcgtcaccttctaccgccgcaccggccgctgggaatcccacatctgggattgcggcaagcaagtctacctaggtggattcgacactgctcacgcagctgcaagggcgtacgacagggcggcgatcaagttcaggggagtagaggctgacatcaacttcaacctgagcgactacgaggaggacatgaggcagatgaagagcttgtccaaggaggagttcgtgcacgttctccggcgacagagcaccggcttctcccgcggcagctcaaagtacaggggtgtcaccctccacaagtgcggccgctgggaggctcgcatgggccaattccttggcaagaagtacatatatcttgggctattcgacagcgaagtagaggctgcaagggcttatgataaggctgcgatcaaatgcaatggcagagaagccgtcaccaacttcgagcccagcacatatgatggtgagctgcctactgatgctgctgctcaaggagccgatgtggatctgaacctgagaatatctcagcctgcagcctcacagcagagccccaagagggatagcggctcccttggcctgcaaatccaccatggatcatttgaaggttctgaattcaagagagcaaagaatgatgcagctccctctgaacttgctagccgccctcatcggttccctcttctgaccgagcatccgccaatctggactgcccaacctcatcccctattcccaaataatgaggatgcatccagatcatcggatcagaagaggaagccatcagagggggtagctgttccaagctgggcatggaagcaggtgagccatcatcaccctgctcctcctcacacgctgccattgcccttcttctcctcctcctcgtcgtcgccgtcgtcgtcctccgctgcagcatcatcaggattctccaaagccgccacgacagcagctgctgcccaacacactgccaccctccggttcgacccgacggcgccgtcgtcttcgtcgtcaagccgccatcaccaccaccattga

SEQ ID NO: 5235 - DNA, 536 bp, Oryza sativa
  Predicted polypeptide sequence is orthologous to G12, G24, G1277
tcctccgacctcaatcgcatttcgccgaacaccttgcatgcgcccccgtccacgaccgcctccttggcgctatccgcttcgctgactagctatagctactagctgctactctctctctgtgtcttggggtggctaaggactacgaacaagatggatggaagaagggaggcaaaatcagctcggattactactcgtcgtcggaggtgtccggggtgggctcccgttgagtcggggttcttggtccgcggcgctggggcgcggggctgcggcggctggagcggcacgggcagccgcggcgccgacgacggagtgctgcgcgtcgacgcgggcgccgacctcggcggccttcttgcggatggcggcggcggtgagctccctgtggtcctcggcaccaccgccgctgccgccaccaccacccgcgccgtcgagctggtcggggaagttgaggcgcgcggagcgccgctctagaggatccaagcttacgtacgcgtgcatgcgacgtcatagctcttctatagtgtcacctaatcatcatg

SEQ ID NO: 5236 - DNA, 1216 bp, Oryza sativa
  Predicted polypeptide sequence is orthologous to G12, G24, G1277
aagaagaagccgcccaaccaacgccaaaagctactgctgcttgcacaggagagggcagagagagagagagagagagagagagaagagggcggctgcggcggcggcgcgcttcgctcatgcagggcgagtaccaccgctcctccagcgaggactcggctgcttctgctgctgctgctgcggcggcggcggctgcggctatggctcctctcgccgcggctgcggcggcggttgctgccaaggaggagcaggcggcggcggcggcggtgctgccgctgcagcagcagcagccgaggcggcagtaccgtggcgtgcggatgcggaagtggggcaagtgggtggcggagatccgggagccgcacaagcggacgcgcatctggctggggtcgtacgcgacgcccgtggcggcggcgcgcgcctacgacacggcggtgttctacctccgcgggcggtcggcgcggctcaacttccccgaggagatctcctcgctggcgtcgctgtccgagggcggcggcgcgagcgagccccgcgagcccgacggcggcacgctgtccgcggcctcgatccggaagaaggccatcgaggtcggctcccgcgtcgacgcgctccagaccggcatgatggtcgcgccgacgacccaccaccgcgagcggcagaagcaccaccaccaccaccaccaccaccacccgcacctgcagccgcacggcgaggagcaacaccaccaccacgagcagaagcaccagcggacggcgtggagcggccgcgccaagaacccggatctcaaccaggcgccaagcccggagaactccgacgccgagtagaagccaacaaaaccgcctccgcgcggcaagatcgatcaacggcttcgtcaacatgcagccagcgtatgatcacctccaccacgtacgctcgctgcatccatccacctaccacctattcgtccacccctcatctccacctcggcggcggcggcggcggcttcgtggcgagatttttcgatgcggttttggataagaacaagggaagggcagcgtcgggaggagggcggtggagacgggggaggaggacgccacaagtggcggtctttccaaatgtcaaaaaagacagctgtaacagtgataaaacaagtcatcctctctgttttttttttcctctctctcttctccgtgttattatcgactagataagcagcgattaattaatccgtccttcccccttt

SEQ ID NO: 5237 - DNA, 1440 bp, Oryza sativa
  Predicted polypeptide sequence is orthologous to G15
agaaggaaggccagaccaggaaagggaggcaagtttatctcggtgggtatgacatggaggagaaagcggcgagagcgtatgacctggcggcgctcaagtattggggcccttccacacacatcaacttcccgctggaggactaccaggaggagctggaggagatgaagaacatgacaaggcaggagtatgtggctcacttaaggaggaaaagtagcggtttctcacggggagcttccatgtaccgtggtgtcacaaggcatcatcagcacggacggtggcaggcacgcatcggccgagtctccggcaacaaggacctctacctcggcactttcagcacgcaggaggaggcggcggaggcgtacgacgtggcggcgatcaagttccgggggctcaacgccgtcaccaacttcgacatcacccgctacgacgtcgacaagatcatggccagcaacaccctcctccccgccgacctcgcccgccgcaacgccgccaccaccacctccaaggacgaccactccgccgccggcgccggcgccattgtctcggtgcactccgccgccgacatcgccgtcgccgacaccctctggaaggccaccactgccccgaggcagcagcagcagcaccacgacgacgtcgtgctgtccggcgccgaccaggccgcattctccgtcctccacgacctcgtcgccgtcgacgccgcggcggcgcaccagcagcagcagcagcagcagcacatgtccatgtcggcggcgtcgtcgctggtgacgagcctgagcaactcgcgcgaggggagccccgaccgcggcggcggcctctccatgctcttcgccaagccgtcgcccgccgtggcggcgtcggcgcagcagcaggcgtcgaccaagctcatggcggcgccgctgccgctcggctcctgggtctcctcgccgccggcgtctgccaggccgcccgccgtctccatcgcccacatgcccctcttcgccgcctggaccgacgcctaatcaccctcgccgccatggctcaccggagtagtaattagctagctatagctagagctaggcaacgacgacgacgacactagcttaattagctcgtgtttagttggttaatttagggttcttggttgctcggcgacatgattagctaagctagcgatgtagtagtagcactagcagctagttggagtattaattagtatcactcaaggcgaggaaaccgacgcacgccatggccgcggcctctcccccacctttccttcttctccggcgacggccggccgccatgtatcagagagctcgatcggcgccggagaagaagggtttttgtaacacggaggccggagatctatcgaggcggtgcttctcctccaaaatccaaaactatatatcttatattaattaattaattaattatagcctcaccaaattaatttctcaaaaaaac

SEQ ID NO: 5238 - DNA, 2510 bp, Oryza sativa
  Predicted polypeptide sequence is orthologous to G15
tccttttgcagtttttttctgctcagctcaccgggtcccctctctcatcttcctcgtcgtgcaccttgcatggatgtagaagtagcgagctagcgcgcggcgactgcgagccgagagagcaacgcaagaacggcacgagaggctggcagcgagcgagcgtgtgcatggttggtgcgagcaaatggccagcggcggcggcagcagcaactggttaggcttctcgctctccccgcacatgccggccatggaggtgccgtcctcctctgagccatcgactgctgctcatcatcatcatcatcatcatccacctgctgctgctgctgctgccggagccatgtcgtctcctcccgacagcgccacgacctgcaacttcctcttctcccctcctgcagcacagatggtcgctccttcacctggctactactacgtcggcggcgcctacggagacgggaccagcaccgccggcgtctactactcgcacctccctgtcatgcctatcaagtccgatggctccctctgcatcatggaaggcatgatgccgtcgtcatcgccaaagctcgaggacttcttggggtgtggcaatggcagtggccatgacccggccacctactatagccagggccaagaagcagaggatgcaagcagggcggcctaccagcaccaccagctagtcccctacaactaccagccattgacggaagcagagatgctgcaagaggccgcagcggcgccaatggaggacgcaatggcggcggccaagaacttcctcgtcaccagctacggcgcctgctacggcaaccaggagatgccgcagccgctcagcctctccatgagcccagggtcccagtccagcagctgcgtcagtgcagctccccagcagcatcagcagatggcggtggtcgctgcagctgctgctgctggtgatggccagggaagcaacagtaatgacggtggcgagcagcgtgtcgggaagaagaggggcaccgggaaagggggccaaaagcagcctgttcaccggaagtccattgacacgtttgggcagaggacatcgcagtataggggcgtcaccaggcacaggtggactggaagatatgaagcccacctctgggataacagttgcaaaaaggatggacagacaaggaagggaaggcaagtatatctaggtggttatgacactgaagataaagctgcgagggcttatgatctggctgcgctgaaatactgggggctatctacgcatataaatttcccgttagaaaactaccgagatgagatcgaggagatggaaaggatgacaaggcaagaatatgttgcgcacttgagaaggagaagcagcgggttctctcgcggtgcttccatctaccggggagtaacaaggcatcaccagcatggaagatggcaagctcggattggcagggttgctggcaacaaggacttgtatctcggcactttcagcactcaagaagaagcagcagaggcatacgacattgctgccatcaagttccgtggcctgaacgcggtgacgaactttgacatcacaaggtacgacgtggacaagatcatggagagcagctcgctgctgcctggtgaggcagcgcgtaaggtgaaggcgatcgaggcagcgccggaccatgtgccaataggccgcgagctcggtgcgaccgaggaagcgagcgctgctactgtcacgggcaccgactggagaatggtgctccatggatcacagcagcagcaagctgcagcgtgcaccgaagcaacggcagatcttcagaagggcttcatgggtgacgcgcactcggctctccacggcattgtcgggttcgacgtcgagtcggcggcagctgacgagatcgatgtcccgggagggaagatcagtggcatcaacttctcgaactcgtcttcgctggtgactagcctgagcaactcgagggaggggagccctgagaggcttggcctcgccatgctctacgccaagcatcatcccaccgccgtcagcctcgccgccatgaacccctggatgccgatgccggcgccggccgcagctcacgtgatgaggccgccgagtgccattgctcatctccctgtttttgcagcctggacagatgcttaattagagccatgttgctgcttgctcgatcttgcttttgatcggctctttttgtaaactaaagcaagatcagcagcaatcaggtgcttatggtacttaaattagctggaagcctggagtagcatacttggttatgatggtaagcactaggctggtggtgtaagtgtttaaccagtaaacccataggtaggacattcaagcaaaatccaaatctctagagcatccactggtagtagtagtagtagacctttagtgttagaccggtagtgttctttgcttcttttgagcctctttttttgggggaaatttggttggaatgtatggctttttaacacgaaatcaggaatgtatggcttttaacacgaaatctggctgtggcattaaaaggaaaaggttcagtgag

SEQ ID NO: 5239 - DNA, 593 bp, Oryza sativa
  Predicted polypeptide sequence is orthologous to G15
cttgatggctacagctatggcgtcggctacggcagcagctgcatcgatcaggtcgacaacgacaagctgttccagcatcatcatcagcaggatcaggcacaagaacagcagcagcagctggtgtacaactacgacgagatcaagcagctgctgatgaacacatcaaccacaagtaatagtattaatgctggtcaggatcatggcggcagcatggaagcagggttgatcggctcacaagggaaggtaaccatgatgtaaattaaactgatcgattaaagaggaggggaaggcagcagctgggcacggcaagattaaggatggattaattaaaccaaggtgtgttgttttttttactgttctttgattggattctaccgtacgtacgtgatgcatggcgcgtttaattgttgtggttaaaaaaaaaaaacaaaggaaagaagtgtgtcccgtgtcacggtcgcatgcacgtgccagtgcagctgctagtatagcgtttgcgttcgtgttacagcctgcagtgtgttgtatgtcactgtgacatgggatcgatcgatggatatcatgactagagataatctctctctctctctctc

SEQ ID NO: 5240 - DNA, 1164 bp, Oryza sativa
  Predicted polypeptide sequence is orthologous to G19
acctcgctctcctcgtcaccgcgatcgatcgatcgccgccggtttagatttccttcctacgcggaccgcacccacgcgctaggtttagctagctagtttgcttgcgcgcaagcgtcgatcgagctagctagtgaagatagatatgtgcggcggcgccatcccgctgatcagcagccgcggccccggcggcaagaggagcctctccgccgccgatgagctctggccgccgccgccgcagcacgccagcgacgacccggccgagcaagcggcggcggatgaggaggagcaggagcagcagccggcggcgaggaggcagcggcgaggggagcggaggacgctgtaccggggcatccggcgcaggccgtgggggaaatgggcggcggagatccgcgacccggccaagggcgcccgcgtctggctcggcaccttcgccaccgccgaggctgccgcgcgggcctacgaccgcgccgcccgccgcatccgcggcaccaaggccaaggtcaacttccccaacgaggacaacgccttcgccgccgcgccgccgccgtaccacctcgccgcctactacggcgacgcctcctccacctcctacctctacccgatggccatgacgcccgccgccgccggactgagggagcagcagctgatgacgacgacggcggtggagtacagcgttaatgacgccgtcgacgtggccagcgtttacttccagccgccgccgccggcggttgcttacgagttcagcgccgtcggcggtggcgccgtcgtcgtgccggtgtcggcggtggcgccggcgatgacgtacggacagagccaagaggtggcggctccgctcatgtggaatttcgatgacatcacggccatgccaatgtgattgtcttaccgtggagattaaggcatttaaaggcttatagataacataaatttgccatgtatgatcaatggttaattcctattgctcaagggcttatattaagggttacctacacggcatggctagcttagcctacaatttatgtttcttgcatttctttctctttttttgagatgagctagtgtgttatactatttgttcatcttttctggtagtggtggatacattttcgccggctagggttggaatttgtaaatagaagatggtcaataataagattgtttctggct

SEQ ID NO: 5241 - DNA, 1050 bp, Oryza sativa
  Predicted polypeptide sequence is orthologous to G19
gagaagaaaagccttgtgagttggtaattgatagtagcaagacaatgtgtgggggagcgatcatcgccgacttcgtcccgcccgccggcgcccgccgcgccgctgcctccgacatctccgacaacgccgtcctctccgctgccggtgccggtgacgagtcgttcgcggcggccaaggcgccggcgccggggaggaagacggcgtaccgcggcatccggcgccggccgtggggacgctgggcggcggagatccgcgacccgaggaagggcgcccgcgtctggctcggcacctacgccaccgccgaggaggccgcccgcgcctacgacgtcgcggcgcgcgacatccgcggcgccaaggccaagctcaacttccccccgaccatcggcgccgccgccgcgccaccgccgcccaagaagcgacgcaaagccgccgccgcggcgaaccaccaccaccaccaccaccagcaggagagctcaggctcctcgtcggcgtcgtcgctgcctcccaccccgccgccggccgccgagcaccagctccgcgagtgcatgtccgggctggaggcgttcttgggcctcgaggaggaggaggacgacggcggcgccggtgagccatgggacgccgtcgacatgatgctcgagtaggctcgccgggaatggcagcgttgccatgctcatgcatccaagcttattcatgcatgcagcagcaagatatacaactttagtactactactatgttaattactacttactgcgtaggtaaatgaaataaaatggggttggttaattagggtgttcttctgggaatccttggctttgctaattgctagtactactatgtactttggcgttaagcattgcattgccaggtgatgcatgtcatgtaatcgtggtaattatatggccgtcctcctagagctagctagcagattagatttactatataaagtggtagtagaaatatatgtcctcctagagctaactagtgtcttgtaatgatttcagacttcttgggcaacatgagcaatgcatttcgacttccactttacatct

SEQ ID NO: 5242 - DNA, 1236 bp, Oryza sativa
  Predicted polypeptide sequence is orthologous to G20
aggtgcatatgatgatgaagaggctgcagcaagagctatgaccttgctgcattgaaatactggggagctgggacacaaataaactttcctgtctctgattatgcaagagatcttgaggaaatgcagatgatctccaaggaggattatcttgtgtctcttcggagaaagagcagtgccttttccaggggtttaccaaaatatcgcggccttcctaggcagctccataattccagatgggatgcttctttgggacacttgcttggcaatgactacatgagcctagggaaggacatcacgctggatgggaaatttgcaggaacctttggcttagagaggaaaattgatctgacaaattacataaggtggtggctcccaaaaaagacacggcagtcagatacatctaaaatggaagaggttactgatgaaatccgtgctattgaaagttcaatgcaacggactgagccttataagtttccttcccttggcctccattctaactcaaagccctcttccgtggtcctatcagcatgtgatatcttatctcagtctgatgccttcaaaagcttctcagaaaaatctacaaaactatctgaagaatgtacttttagcaaagaaatggatgaaggaaagacagttaccccagtacctgcaactggacatgacacaactgcagttaacatgaacgtgaatgggttgcttgtgcaaagagctccatacacattgccctctgttactgcacaaatgaaaaatacctggaaccctgctgatccttctgcggaccctcttttctggaccaacttcatcctgccagcaagtcaacctgtcacgatggcaacaatagcaacaacaacgtttgcaaagaatgaggtgagttcaagtgatccattccatggtcaagagtgaccgtacgagcttaccaaagtgcatgcaggatttgctttttggcttggtgggtgataacatcctgcacgtctatgggtttccttcttcctagcttttgaggtgacccgtgaacaaataccctttgtatccatagttcataagccatgaatagaaggtaagagaagtacaaccatagttatgtaatatatacagtgcctagtggcctagtgccccgttaatgatatttagttatagagctgtctgtacatatcgcggttcttatttcagctacttggttggttctatagaatgaagagaacagaagaacacgaatttttcaaagcttaattgttt

SEQ ID NO: 5243 - DNA, 1038 bp, Oryza sativa
  Predicted polypeptide sequence is orthologous to G21
accacacaccacgccactcgcctcgcctcgcacagtcgctcgctcgcccgctctagctagctcacagctcgctcactcgctctcctcttccaaccaactccaccaccaccaccagtccaccacagcgcgcggcgccatggacgactcgtcgttcggttccgagccgaccacgtcctcctcgggcggggaggcgccggcctccccgccgtccaccgcgtcgtcgtcctcagacggcgccggcggcaagaagaagcggccgcgcaaggacgggcaccacccgacgtaccgcggggtgcgcatgcggagctggggcaagtgggtgtcggagatcagggagccgcggaagaagtcgcgcatctggctgggcaccttcgccaccgccgagatggccgcgcgcgcgcacgacgtcgccgcgctcgccatcaagggccgcgccgcgcacctcaacttcccggacctcgcccacgagctgccgcgcccggccaccgcggcgcccaaggacgtccaggccgcagccgcgctcgccgccgccgccgacttcccggcctcctccgccaatgcgggcgccagcaataaccccgacggatcggacgacgcgagcgccgggtccgcctcgccgcccccgccgccggacgccgctgacgacgcgctgttcgacctccccgacctcctcctcgacctcagatacggcccgcccagctcgggcctctcgtgcgcgtcgtcttgggaagacgaagtgggcttaatctccggcgccggtgccgccgccgccggcgtgttccgcctggaggagccacttctgtgggagtactaaaagccaaagcgccgccggtaaaacactcgtcagtgctaaaatcgagcagcctgcatgtacaacccgtaattttccacgcatgaccaaaagaattcatgcatgcaagccagctacggcctacggcgcacagaaacttgagccaaaaaatcagcgtcgttttgtcctgcgtttgcgtcgccaaatttgggaagcagaccatgtataaaaaatcatccttcttttcc

SEQ ID NO: 5244 - DNA, 1109 bp, Oryza sativa
  Predicted polypeptide sequence is orthologous to G21
cctggaaggaagcgcatctccttcctgcggtattctgtgtgcctctctctctctctcctccaccttgtcgtagagaggaggcggccatggaagctgccgcgatccatgcgcccaccaccaccacctcctccgactccggctcgtgcgtcaccaatggcacgcgagagaagcgcgagatctctaagcacaagcagctcaagcggaagaggagcacctctcctgctcctcctcccggctgcggcggcggccaaggacaggaagcggcggtggagactgacgctgacgctggcgccgccggcgaggaggagagcagcagctgcggtggcgctggcgccggcgagggcgagcgcaagaggggtgacgccggcaggcacccgtcgtaccgcggcgtgaggcggcggagctggggcaagtgggtgtcggagatccgcgagccgcgcaagaagtcgcgcatctggctcggcaccttcccgacggcggagatggccgcgcgcgcgcacgacgtggccgcgctcgccatcaagggccgcgccgcgcacctcaacttcccgagcctcgcccacacgctcccgcgcccggcctccacctcaccctccgacatccaggccgccgccgccctcgccgcagctgcagccgccaccgaccaatgcgagtcctcctcctctgccgtcgccgccgccaccgccaccgacgccgaggcggcggagtccacctcgtcggccgcggccagcccgtgcgccgccaccagcagcgtcgaggagaacgcgctgttcgacctgcccgaccttctcctcgacctgagcgacgggctctggtgctcacccgtctggacgacagcgccggccgatcagtacgacgccggcgacgacggcgacgacgccgcggcgccgctcctgtgggccgagcagtgctggatggacgccccagcggcgcccgtgcagcctgactaattaagccaatccacctgctccgactcgccggccggccattgcaccggttgggttggtcgcagcagtcaacctatcgacaccatgggcgtctttttcttttctctctgtttttttttcttttttggacagagtaataaggaaaaaaatatagattaaaaa

SEQ ID NO: 5245 - DNA, 870 bp, Oryza sativa
  Predicted polypeptide sequence is orthologous to G21
atggccatggcgaaggagctccaagaaacctcctcgtcttcgtcctcctcggctgcctccacgtcctcctgctcctccgccgtcacggacgcgtggtcgtcgccggccagacccaatgctgtggccggggggaagaggaagaaggaggtggtaggagaggctgatgaggctgcaggcggcggcgcaggagaggaggaagaggaggaggcggaggcggcggcggcggggaagtcgtcggcggcgacgaagaagaggaagcggagcagcgacgggaagcacccggtgtaccgcggcgtgcggatgcgggcgtgggggaagtgggtgtcggagatccgcgagccgcggaagaagtcgcgcatctggctcggcacgttccccaccgccgacatggccgcgcgcgcccacgacgtcgccgcgctcgccatcaagggccgcgccgcgcacctcaacttcccggacctcgccggcgtcctcccgcgcgccgcctccgcctcgcccaaggacgtccaggccgccgccgcattggccgccgcgttcaccacgtccccgtcctcgtcgccctcctcctccttgtcggccgacgacgtcgcgccatgcgtcgtccacgccgacgccgacgagcagcctgccgctgccgccaagaacgacgacgacgacggctcaaccaccgcgccggtggcggcggcggcggcggcggcggcggcggatgagcagcagctgttcgacctgccggacttgctgttcgacatccaggacgggccgttcgggttcccggcgatgtgggcgccgctcgccgacgtcgacgaggtcaatgcggagctccggcttgaggagccattgctttgggacttgggagtaacagatgcttaa

SEQ ID NO: 5246 - DNA, 741 bp, Oryza sativa
  Predicted polypeptide sequence is orthologous to G22
tcaatcacataagttagttccctttaaacctattcttgaaatctagtactgttagatggtttaactctatagctaaacattagagttgatttattctatagcttctgctatattagttagccacaagtttgtaaatacccatgtatcttataataatatctcctctggagccttgttcaaatttatgcaatgaagatccagattattgaacctgtatcaatctactgatccagggcttgatacagtctaaatatgtcgattaccgaattattagttttgggacccgacaaggggaagtaggagccgtcggacaggagtaccgtcggcacaagcaccgctctgaccgaactgccatcactgtcaccggtctctcgttcggtcaccgccaatgatgcaatttgggagaagggcattgggagagaataatttggggacttgggttttgctccaccccttccaccagcgacttcacccgcacgaaagaaatatcagcaatccattagatcagacggctcaccatctcctcgtgttgggtcgtcgccgttggtgggtcacttggctcttgggccatagaatttgattagaatttttacattaccgtgatattatttttttgttacttcttcccaacggtgatgtgatttaggacattaatgtctttagctaatcatttctgcccaacgatgacttgattttgattgtaagtaatttcatttaatgtttccttcgttttgtcaaaaa

SEQ ID NO: 5247 - DNA, 885 bp, Oryza sativa
  Predicted polypeptide sequence is orthologous to G25
gactcgtcagcttagagcaccgcaagcgcgcacagccagcaaagatgtgtggcggcgcgatcatttccgacttcatcccgcagcgggaagcccaccgcgcggccaccggcagcaagcgtgccctctgcgcctccgacttctggccgtcggcgtcgcaggaagccgccgacttcgaccacctcaccgccccctgcaccttcacccccgaccaagcggcagaggagccgaccaagaagcgggagcggaagacgctgtaccgtggcatcaggcggcggccgtgggggaagtgggcggcggagatccgcgacccggcgaagggcgcgcgcgtctggctcggcaccttcgccaccgccgaggcggcggcccgcgcctacgactgcgccgcccgccgcatccgcggggccaaggccaaggtcaacttccccaacgaggacccgccactcgacgacccggccgccgacggccacagccacggcggcgccgccatcccgtgcagggagttcatggactacgacgccgtcatggcgggcttcttccaccagccctacgtcgtcgccgacggcgtgccggccgtgccggcggaggaggcgcccacggtggcgtacgtgcaccaccacctgccgccgcagccgcagcaggacgcggggctggagctctggagctttgataacatccacacggccgtgccgatgtgagatcgatctgatgatcattcagatcgatgctagctcatgtgttttttaattatatcttcacagcagaaacaaaaaaaagttcaattcagtttattttgttgttatacgttttaaaatgtttcattaggttttcatgttataggagtgatttatcggattgaactctcaagtgaccgacttctgagttctt

SEQ ID NO: 5248 - DNA, 990 bp, Oryza sativa
  Predicted polypeptide sequence is orthologous to G25
acgcacacacttcttctgcttccctccccttgtttccgctccacttcccttccaagcaagaaaaccgaggcttcagcttagctaggaccgaccgatccgatgtgcggcggtgcaatcatctacgactacatcccggcgcgccgccggttgtgcgcctccgacttctggcccgacgccgacgactccgacccccacacccccgctcccgagaaaccgccgcgcgcgaagagggagcggaagaaccagtaccgcgggatcaggcagcggccgtgggggaagtgggcggcggagatccgcgacccggtgaagggggtgcgcgtctggctcggcacctacccgaccgccgaggccgccgcgcgggcctacgaccgcgccgcgcgccgcatcaggggcgccaaggcgaaggtcaacttccccaacgacttcggcgccgcccccgcgccggccgcggcggcggcgaaggccgtccctcgcgtcgcgcccacgccggccgtgctcccgccgcccaagatggaggcggtgtccgagggcgccggcgcctgctcctccgacgaggtcaaggagctgtccgaggagctgctcgcgtacgagaactacatgagcttcctcggcattcccctacatggagggctgggccgcctccgccgacggtgccgacgaaggcgcggcgcccgccgggctctgggaccttcgaagactacgagctgccgtcgctagcgctctagtaccattgtccattaacctgactttgtatgtgaccaccccgttttcctacccggtagtacgtaccaggggtctacggtacccgtactcaatgcgtgatttcggttgaccttatccattgtgcagttgtaactgtgcttgggcggggcccgtccccgtgaacctttgctgaaccaagtttactctatgtgacaaacaacacagggccgcggtctaaaggtccagttacgaacggtgttgcacgggctagaccccaataaggcccaa

SEQ ID NO: 5249 - DNA, 706 bp, Oryza sativa
  misc_feature (64)..(64): n is a, c, g, or t
  misc_feature (100)..(100): n is a, c, g, or t
  misc_feature (111)..(111): n is a, c, g, or t
  misc_feature (141)..(141): n is a, c, g, or t
  misc_feature (178)..(178): n is a, c, g, or t
  misc_feature (622)..(622): n is a, c, g, or t
  Predicted polypeptide sequence is orthologous to G27
aacgtgggtcaatattcccttcccaatcgctgcacctttcttctgcatggtcggtgatgtcgtnccggatccggctatcccgatcgagtccggtcgcttnttggtgaggtnccgccgcgctgccgccagatccggcggatntagggtcgtccatcgccgtcccgagcgccgtggtggntctcacgtcgtcgggggctgccgaagccgggccgggaagcacgtgcacgatctccggttaattgaggagcacagggcggtgcggcccttggcggcacagcggcaaaatctgatgataatgatccggcgacaatggcgtgtaatgatccggcgacaatggcgtcttggacttatattttgctgctgtgtttgccgatagttcggttgcattgcttgctattgacctcttctcttgttgatctggtgggtggctcccgtctggttgcgttgattgctatttacctcttctcttgttgaactggttggtggtggctcccttctggtgtttggtatttattggagagtcaatcaagattagtttaggaatcggtgacaatcaagattgtcagagtcggattgtttagggtgtttttattttggaatctactgtcttaggccgtgtttngatccaaagtttggatccaaacttcagtcctttttcatcaaaaaaaaaaaaaaaaaaaaaaaaaaaaaaaaaaaaaaaaaaaaa

SEQ ID NO: 5250 - DNA, 988 bp, Oryza sativa
  Predicted polypeptide sequence is orthologous to G27
aagcctccaactactccagtccacacccgcaccaccgcggcagccatggacgactcccacgacctggcctccccgacctcccctgacacggcgtcctcgtcgtcttcgtctacgtcgacatcatcgtcctccgccaccgtcgccccgaagaagcggccgcgcaacgacggccggcacccgacgtaccgcggcgtgcgcatgcggagctgggggaagtgggtgtccgagatcagggagccccgcaagaagtcgcgcatctggctgggcacgttcgccaccgcggagatggccgcgcgcgcgcacgacgtggccgcgctcgccatcaagggccgcaccgcgcacctcaacttcccggacctcgcgcacctgctcccgcgcccggccaccgcggcgcccaaggacgtgcaggcggcggcgctgctcgccgccgccgcagccgacttcccctccgtctccgtcgacgccaatgccaagagccccgacacctgctccgtcgccagcgccgcctcgccgcagccgccaccgccggacgccgaagcggaccctgacagcacgctgttcgacctcccggacctgctcctggacctgagatacgagacgtcctcgagcctctcgtgcggggcgtcgtgggccgtcgatgacgacgtggccggcggcgtcgtgttccgcctcgaggagcccatgctgtgggattactgatcaatgtggctgctcatgggagccagtcatgcttccgtgtattagatcgatcagtggcttgtacatggcggtgcttcttttcttcttctttactctgcttctgctctgttctctttcttcttttctccctttgtattttgttttttttccttccattttttcttcttttctttgccaaatctagcatgcgaggttgtataaagtcagttccttttcctcgccttgcttgatttgggggacaagaatatgtataattaacaagcatcttatcttcgactatcccttttct

SEQ ID NO: 5251 - DNA, 1136 bp, Oryza sativa
  Predicted polypeptide sequence is orthologous to G27
gcagaccgcacttccatcgatctctctcctcgccacgggccacggccttctcctaacgggagccatggaagcagacgcgagccatacacccaccacctcctcctccgtctccgtctccttctcctcctcgtcgctgtccacttcctcctccacctcctccctcgtcgacaatggcgcgcaagaccggcccaagagctccaagcccaaacacgccgccaagaagcgcaagagagcggccgcggaggaacctgccaatgccgcccacggcgcaggggaggataccagcagctgcagcaccgacgacaacgcggcggcgagcggcaaggcgcaggcgggcggcggcggcggcggcgtcgacagcagcagcacctgcaccgccgcctcggcgccgaggagcggcttcaagcacccgtcgtaccgcggcgtgcgccgccggagctgggggaagtgggtgtcggagatccgggagccccgcaagaagtcgcgcatctggctgggtaccttccccaccgcggagatggcggcgcgcgcccacgacgtggccgcgctcgccatcaagggccggaacgcgcacctcaacttcccggacagcgcccacgagctgccccgcccggagtccacctccccggcagacatccaggccgccgccgccaaggctgccgccgaggtgcggtgcgaggaggagtcgtcgccgtcgtcgtcgcccaccgccgagcaacccgaggaggaagccgcctgccctgacacggtgcacgccgacggcggccaggacaatgctctcttcgacctacccgaccttcttctcgacctacgggacgggctctggtggtcgccggtgtggccggcggcactggcggccgaggagtacgacggcggcgacgccgtcgtgctcaatgagccactcttgtgggccgagtagccattttacctttctgggctcatgaataggctacaacgacaactctcaagaaagaaagaaaaaaaagggaaaaatgttattaccgctatatttagtagttactgctattgacaaagtttagtctatgttgtgcttgattaggccatgaagcctgtgtgctttgtgtaccaacaatcaaaaagatctctctactaatagaagttaattaattcgaagc

SEQ ID NO: 5252 - DNA, 1473 bp, Oryza sativa
  Predicted polypeptide sequence is orthologous to G27
gttggggtccatattcccctcctcaccgctgctcctttcttcggcatggtcggcgatgtcgtagccgccggatccggctatctctatcgagtccagtcgctttttggcgaggcgctgccgcgaccgccgccggatcggggtcgtccatcgccgtcgcgagcgccgtgtggctctcacgtcgttgggggctgccgaagccgagcggggaagcacgtgcgcgatctccggttagttgaagaggacgggggtggcgcggcccttgatggcacggcggtggcgaacgtgcagagccagatgcgcgagttcttgcgcagctctcagatctccgacacccacttgccccaactccacatgctgctgctagatccaacgggcggcgagcttcgtcggtggagagcttttgcgccgactgctcgagcatccagcaaaatgtaaggtggaggtggtgcggtggttgggtcacggatcggccagggtggcgagcctgggggaattggcaggcaggcaaaggagggaaagacgggccaaacattaaaaaaaaataaaggttgccagtggaagaaaacaaactgtagaaggcaaatccggtgacttggagctgctaaggggctgtttggtttccagggacttattccaagtccatgtcacatcggatatttggacactaatttggagtattaaacatacattaattacaaaacctattccataagcttggactaattcgcgagacgaatcttttgagtctaattatgtcatgattttgacaatgtgatgctacagtaaacttttgataattatggattaattaggcttaaaaaaatcgtctcgcggattagctctcatttatgaaattagtttttttattagtctatgtttaatactctaaattagcgttcaaacatctgatgtgacttgggctaaaaagttttagccccatctaaacaccccctaagcaaatccggcgacttttgctatctcgctgttctgattgccagcaaatttgatgatttggagctgctaagcaaatccggcgacttctgctatctcgctgttctggttgccagcaaatttgatgattgccactggttgcatgttgtttgctattgacttgatttgttgttggctgtgggatgtgaatccgatcgtcaaagcagtcggtttcggtgacagtcatagcagtcggtttcggtgaataatagcagtagtttggaaaagttttggctataggaatctttgcatgtcaatccgtgtgctacactgtttcagtgaaaagtagtagtatttttatgtcgtgctatgagtagtactccctccctccgtataagcatattttcaaatctgaaaattctatgaaaattctatttttgataagcatatttcaatttaacaatctatcatcttaatgactttctcggatttaatgtatgactctccattcttctatacaagattggctacttgagcatcgcg

SEQ ID NO: 5253 - DNA, 1648 bp, Oryza sativa
  Predicted polypeptide sequence is orthologous to G27
gtttcttctcctctcctcttctctcgtttcttcctgtgctgcctcttatcacccttctcacctccttcaatggccagatctgatcaggtgaggtaaaatccgatgaggagaagtaactgaaagggagaggtggaacctgagggaaacttctctctcagcatggggtccatattcccctcctcaccgctgctcctttcttcggcatggtcggcgatgtcgtagccgccggatccggctatctctatcgagtccagtcgctttttggcgaggcgctgccgcgaccgccgccggatcggggtcgtccatcgccgtcgcgagcgccgtgtggctctcacgtcgttgggggctgccgaagccgagcggggaagcacgtgcgcgatctccggttagttgaagaggacgggggtggcgcggcccttgatggcacggcggtggcaaacgtgcagagccagatgcgcgagttcttgcgcagctctcagatctccgacacccacttgccccaactccacatgctgctgctagatccaacgggcggcgagcttcgtcggtggagagcttttgcgccgactgctcgagcatccagcaaaatgtaaggtggaggtggtgcggtggttgggtcacggatcggccagggtggcgagcctgggggaattggcaggcaggcaaaggttggttgacgctatttttcttttctaatcatttgcatgaattatatgtttggatgcttcatgtgcaatcggttgcaaaattaggtctgtatatatagaggtgataaaaaatcataaataaaataacagatcgcatagtaatatatctcagtttattcacatacaatattcagctattataatatagtacatgtaatgatctgtattgactatgagctattctttctagctagtatcattaactgcaggatattctaccgaggtactgctaattatgaactattctcatgagctctaagcactatctgtatacttagaattcattttccttgttctctgaggccttgtgttgcatgctatattgtctggttgaacacatgttttcttacgtttctcaacagagctttccttgcctatgccattgatggttttcgcctgtctttttcctgccttgatggattcttgaacaactgatttgtttatttcatggctgtagttgtcatttctgatttctgcctttgtgggttttgcatgagcgccttttgcatttttgcctcgaacttttgcatctacacattttatcatacttgtttcgttgctctcctcttctgaatcgtcttctattatgtatgtcctccgtcttatttgtttgcaactgggaggtttgtccgacgaagtgagttcatcttcactcatgatttcctggtcactatcctctagctcttgcttcacgggtagcagtgagatggatctgttttttaataagagggcccctgctggtttgttccttcaaaggcaataaagtatttgtcatatgtgctatatattataaataaatgaatatttgtattatgtgttcaaatacctgttgatctgtctctctatcttgttttagtatgttatccacatcgtcgtccattaactcctgtaaaatcataatgtggaaacatttcggaaataaaattttcaagattttgtgt

SEQ ID NO: 5254 - DNA, 306 bp, Oryza sativa
  Predicted polypeptide sequence is orthologous to G27
atggaaaacgagtgtagcttctgcgactccctcgtcgtcaagtccaacctgctatgtccactcgccgtcgacgctgccctcgccgccgtcgatccggctcacccggacctcctcgatctccacagcagcggcagcgaggcggacctggatcgagttggcgttgtccgactcgggaagtccgccgcggcggcaagtgcggctacggcttggacatccttgggcgccgcgatggctgggcgtgacagcgcgtgggcgaggtccgagacgtcgagggagggggatgaggaccgaatggagacggtgtga

SEQ ID NO: 5255 - DNA, 528 bp, Oryza sativa
  Predicted polypeptide sequence is orthologous to G32
atggcggacgcggcggagcagcatcaccggcaggaagagactgcggcggcgacgacgacgccgcagcagatgatgatgcggcggcggcgggcgcgcgcgtcgagcgagtacctgggcgtgcggcggcggccgtgggggcggtacgcggcggagatccgcaacccgtacaccaaggagcgccactggctcggcaccttcgacaccgccgaggaggccgccgtcgcctacgacctctccgccatctccatctccggcgccgccgccgcgcgcaccaacttcctctaccccgacatgcaccaccaccacccttcgccgccgcagcacgcgctgtctccggcagtgccaccgccgccaccgccgccgccgccgtcgccgctgtacgatgatgattacctgtcgccggcggcggcggaggaggaagtggaggccggcgacgacgagtcgctgacgatcgcgaccatcctgcagagcttccagtatcagcagagcgtcccaccggcgtcatcgggttccatgttttattattag

SEQ ID NO: 5256 - DNA, 879 bp, Oryza sativa
  Predicted polypeptide sequence is orthologous to G32
atgatgaacttctcctcgtacttctactcgtcgtcggcggcggcggcgggtggtggtggtggtggtggggagaagaagtcgtcgtcgtcgtcggcgtcgaagaagaagcagcagcaggcggcggcggcggagggagggaataaccagacgaggtaccttggggtgaggaggaggccgtgggggaggtacgcggcggagatcagggacccggcgacgaaggagaggcactggctggggacgttcgacacggcggaggaggccgccgtcgcctacgaccgcgccgcgaggtcgctccgcggcgcccgcgcgcgcaccaacttcgcctacccggacctccccccgggctcctccgtcaccccctacctctcccccgacctctccgccgacgcctccgatcagctgctccagccgttctacgccaatccctccgccgccgccgcgctgcccactccggcggcggtgatggccggaggaggaggagtcgaattcggcggcgagtacatgtacggcggcggcgtcgacatgtcgtcgctgatggacgacattgcggccatgcccgacgacctcccgcccagcgtgacgggcggcggcggcggcttcgccagcagcgacgaatactccagcggcggcggcgggatggtcgacgacgtctccatgtactgcggcggcaatggcggagggtcgtcgtggtgcgacgcctccgacttcgcctcgtactcgtcctcctcgccggcggcggcggcggcggcaggctcgcacgggatgtacttcgaggaggggtacgtgcacagcccgctcttctcgccgatgccggccgtcgacgacgccggcgccgacgggttccagctcggcggctcgtcgtcgtcctactactactga

SEQ ID NO: 5257 - DNA, 1151 bp, Oryza sativa
  Predicted polypeptide sequence is orthologous to G38
gattctgatacatcgatacaatcaagctagcatggagatggacatcggcgagggcgagagctgctgcggcaggcgaaagcagcagcagcagcagaatattagcagcagcaagtcacgcaagtgctgcccgctgcggcggtcgcggaaggggtgcatgaaggggaagggcgggccggagaaccagcgttgccccttccgcggcgtccggcagcgcacctggggcaagtgggtggccgagatccgcgagcccaaccgcggcgcccgcctctggctcggcaccttcaacaccgccctcgacgccgcccgcgcctacgactccgccgccagggccctctacggcgactgcgcccgcctcaacctactcctcgccgccgccaccgccggtgctcctcctgctgctgctaccccttccgtggccacgccctgcagcaccaacgacgactccaacaactcgtcttccacgacgcatcagcagcagctgacgacgatgctgcagctggacgacgacaactacacgctgcagccgtcgtcgtcagatcaagaggacttcgagacgtacgtcacgcggctacccaaggcggaggactttgggctggagggcttccaggaggttccactcgacgtcctcgacgaagccggcggtggcatcagcatctgggacctctccatctgccccgccgatttcatggccaccgccgccaccaccaccgccaaatcatcttaattatatattcataataataataataataataataataataataattaacgacgacgacgacctacctacatcatatatctatctatctagcgcccgcgcgcggctgcctatatagatatatgatgatcagctccatctctctctaaagtctaaacatgcatgcttgtcgtcgtcgtcgtcgtcatcatcgtcgttacttgtatatatactccactacttagtactaactactataattagctctagcgtactgctacttttatacggcatgcaagcggccgacatcctgatcgatcaactgtgagcatgctgtatgcatcgatcgatcttaattagttaggcgagctgtgcttgcttatcgatcttaattatatcatccgatcccatattatataagtaatactaattaatactatatatattatgt

SEQ ID NO: 5258 - DNA, 1616 bp, Oryza sativa
  Predicted polypeptide sequence is orthologous to G38
ggcctttccttccgatctctctccctctctctcttcttcttcttcttccttccctctcaacccgacgacccacgcgaagcgaactctcgcgcgagacgagagtagtaaaccctagaaacctagaggagatccccaccaccaccatgacggtggatcagaggacgacggcgaaggcgatcatgccgccggtggagatgccgcccgtccagcccggaagaaaatgtggaggcgaggaaagtactggaaaccttgattccgtccaaccgataggaaaaagcgaccacggagatcacgcgatggacctacttcagttgcagagaccatcaagcggtgggccgagctcaacaatcagcaggagcttgatccacagggtccaaagaaggcaaggaaggcacctgcaaagggttcaaagaagggctgcatgaaggggaaaggaggaccggagaatacacgttgtgacttccgtggtgtgaggcaacgtacctggggcaagtgggttgctgaaattcgggagccgaatcagcaaagtagactctggttggggaccttcccaactgccgaagctgcagcttgtgcttatgacgaggcagccagagcaatgtatggtccaatggctcgcactaattttggccagcatcatgcccctgctgcttccgttcaggttgcactagcagctgtcaaatgtgctttacctggtggtggcttaacagcaagcaagtctagaacatccactcagggtgcatcagcagatgttcaagatgttttaactggtggcttatcagcatgcgagtccactacaacaacaattaataatcaatctgatgtcgtctctaccttacataagccagaagaggtttctgagatctctagtccactgagagctccaccagctgtcctggaagatggttctaatgaagacaaggctgaatcggttacctatgatgagaacattgtcagccagcagcgtgcccctcctgaagccgaggctagtaatggaagaggcgaggaggtctttgagcctctggaacctattgccagcctaccagaggaccaaggagattattgttttgatattgatgagatgctgagaatgatggaagctgaccctacgaacgagggtttgtggaaaggcgacaaagatggatcagacgccatcctggagcttggccaggatgaacctttctactacgaaggggttgatccaggcatgctggacaacttgctcaggtctgatgagccagcatggttattggcagatcctgcgatgttcatctccggtggcttcgaagatgactctcagttctttgagggcttgtgatttccccttggcggcagccggccatactaaaattttctggtgctttggtcggctagctcctgcacatcgccctcaggatcagcaagagaaacactggaccggattgggttcgttggtggaactggatgagcatctagtagctaaggaaaaaagatccttttatttagttctgtaggcaatggaactccttgagaactccgtttcagtgtttgttaatttgataacgcttgcttgtttgtgtgtgtatatcgatctcttttgaagcaatgagaaaaaaaaaaggactgaagaaaatgtg

SEQ ID NO: 5259 - DNA, 811 bp, Oryza sativa
  Predicted polypeptide sequence is orthologous to G43, G46, G1419
ctttttttgcgctcaattgctctgagcctctgatgttcttcattagtactcttcaacttgtaattaatacatatttatatcatttcattgacaaatcgcaatgaagctactatgatcatcgatcacctgagcagcaatagaacgaaagaattcaatatttggccgaaagccaaatcgattacctaatattacgaagtttagcgaattaatcaaagaacaccctatctaattcaggattaaggccatatccttcgcacgtgacgtcacggacaccaccacgcggcagccatgcgtgtaccgcgccgggcgcgcgccatggctgcactccaagctcgccacggcgccgtccatggccggagctagcgatcgatcagcttacgaacagctgcgggaaggccatgtgcgggtgcggcgacagcggcgagagcggcggcaggctgcagatccccttcagctcgtcccagatgtctccggctgccgccgccgccgacgacgacgacgaggaggagttctccggcggcgccatgatcagcctctccttcttcacctccctcaagtagtactgctcctccgacctcaccctcttgcctcttccggcggacatggcggcggcggggataggggcgacgggaggggcccacttgacggcggcgtcggcggcgacctcgttggggaagttgaggatggccttggacccgcggagctggaacgcggcgcggtcgtaggcgcgcgcggcctcgacggcggtgtcgtaggtgccgagccacaccctcgcgcccttccctcgcgggtcccggatctccgccgcgta

SEQ ID NO: 5260 - DNA, 1399 bp, Oryza sativa
  Predicted polypeptide sequence is orthologous to G43, G46, G1419
gaggcacagctaactcaacgcaaacaaatcaaacgccacgcacctctcgctctcccactgaagttgtgtgtgccaccgcaccgtgtcgttccctctccttgcaacggcccacgaccagccgccatacgcagcatacatggacttccaccacggagacgccgacgacttcgccctcgagttcatccgcgagcaccttctcggcgtcgacggcgccaccgccacggccaccgagccggcggacctcgaggtcgtcgaaccggcggcggcgtacccgcctatgtcgtggcaagagcagcggcagcaggagcagcatggttgtcacgtagaactaacggacgagcacctggaatccgcacccgctgctgaggcagcggcggcgttccgaacggcgcccgcgcagccggcggccgaggtgatgatcaagttcggtggcgagccctccccggtgaggccgtcgtcgtcgctgaccatatccctgccaccgagctcgttcggcagctgggcgtccgcggcggcgccggccgcggccgccgtggaggacttccgcaagtaccgcggcgtgcgacagcggccgtgggggaagttcgcggcggagatccgcgacccgaagaggcgcgggtcgcgcgtgtggctgggcacgtacgacacccccgtggaggccgcgcgcgcgtacgaccgcgccgccttccgcatgcgcggtgccaaggccatcctcaacttccccaacgaggtcggcacccgcggcgccgaactgtgggctcctcccccgccgccacccgcgcactccgccgccgcctcgacgacgaacaagcggaagcggcagccgtcggaggaccccgacgacggcgtcgaggtgatcggagtggtaagcaaggccgtcaagaccgaggcgccgacgtccaactcgtcgtcactgtcgtcgtccctgacgtcgcgggacacgacgccggccacgtcgtcggcgggggcggagcacgccggcgcggccgccgagagttcgccggcgacgccgtcgagctggagctgggagcagtactgggaagcgctgctcggtggcctcccgccactgtcgcctctgtcgccgcacccggcgttggggttccctcagctcaccgttaactgagaaaattaaacaatgattagctgacgtgggcacagaaataatgcgtttttttcccgttgttaacgacgtcatgtgtacattggaactttttttgggagcttaacagaaggggcgtatagacaaacatcagaaagtggtagtcgtgtttacttttttttttctttcgagttgagaaccttgagatcaatcgatgcttgtaaagaataagcagagggtgctgtttggcatttgatatgacaatgtaaacaaatagtacaagttactttgtttactgag

SEQ ID NO: 5261 - DNA, 1312 bp, Oryza sativa
  Predicted polypeptide sequence is orthologous to G43, G46, G1419
cccatcttagctttctcctcgcagatgcaattgcgcgaacacctccaaactcccgagtcccctctcctctctcgtcttcctctccacgacgacctctccgcttcaattctgcgccgccgcctcagagcgccatggacttcagcggcgacatcgatgacctgatctccctccagctcctccacgatcagctgctcggggtcgaggccgacgcgtgcctcccggtggcagttcatcacgatggcgtcgccgcgttcgccgagcatcagcagggtttccatcccgcggcgttcttgccgcagcagccgatgacgatgacaccggctgggtacgtggacatggcgaatgatcagtatttgggtgcgcatgccgccgctggcgaggcggaggcggtctaccgggcggcggcggcggagccggtgatgatacggttcggcggcgaggtgtccccggtgtcggacccccggaggccgcccctgacgatctcgctgcctccgacgtcgcacgcgtgggcggcggcggaggcggtgcacccggccgctctgctgcaggcgcaggccgcggccgcggccgccgacccgaacgacttccggaagtaccgcggcgtgcggcagcggccgtggggcaagttcgcggcggagatccgcgaccccaagaagcggggctcgcgcgtgtggctcggcacgtacgacacggccatcgaggcggcgcgcgcgtacgaccgcgccgccttccgcatgcgcggcgccaaggccatcctcaacttccccaacgaggtcggctcccgcggcgccgacttcctggcaccgccgccgccgcccccgccgccgacgacgtcgacccacggcaaacggaagcggcacgagacggcggcggccgacccggacgtcgaggtgatcggagaatcatccaaatccgtcaagaccgagacgtacacatcgccggcgtcgtcgtcgctggcctcaacgacaacctcaacggtgacatcatcatccacgtcgccttccccctcgtcggaggcagctgcctgcggcggcggcggcggcagcgagctgttcgtcccaccgatgccgtcgagctggtcgtgggatcagttggaggggttcttcggcatcctctcgccgctctcgccgcacccgcaaatgggattcccggaggtcgccgtaaactaattaagcgcgctaatgatctctctaagcatgattaattaggcgcaataatcggcaattaattagtggcttctagttctcgacggccttcgctttggacacatctcaggagatttggcttggagcagtgtactataaaaaaaaaa

SEQ ID NO: 5262 - DNA, 1145 bp, Oryza sativa
  Predicted polypeptide sequence is orthologous to G43, G46, G1419
ctcgctcgcgcgccacactcctcgaaccaccaccaccaccaccacgtgttcgatcgcgtcctccaagccccagcacctacgcgtcgtcgcgccatggccggcttcggcttggaccagcacctcgacctcatccgcgcccacctcctcgaagacgcccaccaccacgtcctcgcgccatcgccgtcgccctcgccaccgggtactgggcgtgtcaggccggcgcccgtgtcgctgcccccgaggccgccgctcctgtgggcggcggcgtcggcggcgccgcggcagcaggaggagtgcttcgagctcggcggcggctacgcgggggagggggagggggaggaggaggacgacttccggcggtaccgcggggtgcggcagcggccgtggggcaagtacgcggcggagatccgggacccggcgaggaagggcgcgagggtgtggctcggcacctacgacaccgccgtcgaggccgcgcgcgcctacgaccgcgccgcgttccagctccgcgggtccaaggccatcctcaacttccccaacgaggtcgccgccgacgccgccgtcaagtgggcccctcccgtcgcccctatccccgccgccgccatgtccgccggaagaggcaagagggtgaggtcggaggagcagtactacttgagggaggtgaagaaggagaggctgatcatggcgccgccggagaactcctcctcgtcgtcgtcgtcggcggcggcggcagccggagacatctgggacgagctgaaggggatctgcagcctgccgccgctctcgccgctgtcgccgcacccgcacatggccttcccgcagctgttcgtaatcgatttggctttcggccaaatattgaattctttcgttctattgctgctcagaacacgtgattttgcttttgactatgctatttgatgattaaacagagaagaaatattcgtcttacaagatcatatcaccgaaaagactagctaggcgcatggagtagtactggaaacaagctctgctaaggccctctttgtttaggcttaagcttattggactagacttttaagccagctgtggttaatctaggcccattttggaaaaaaaaacattagctgtaatttttctcgaagttatatatttcttgcactaaaaaatta

SEQ ID NO: 5263 - DNA, 1511 bp, Oryza sativa
  Predicted polypeptide sequence is orthologous to G129, G136, G140, G146
aatcagattggaattggccacaaaagctactgctaactacattcacctcacatttcttcttcccctttccctcctcctcctcttcttcctcttcttctcccccacctctctctttaatacctctcctcctcctgttgctgcttctgcctctctcacatcttctttctttccttctctggatctcttccatcttcagaagagagagcactagttagcatacccatccatgatgaacatgatgaccgatctgagctgcgggccatcgtcgatgacggagctgaccgcggcagcggcgccggctgggtcaggatcgtcggcggcggtggcggcggggagcagcgagaagatggggagggggaagatcgagataaagcggatcgagaacacgacgaaccggcaggtgaccttctgcaagcgccgcaatggcctcctgaagaaggcgtacgagctgtccgtcctctgcgacgccgaggttgccctcatcgtcttctccagccgcggccgcctctacgagtacgccaacaacagtgtgaaatccaccgttgagaggtacaagaaggcaaacagtgacacctccaactctggcacagttgcagaagtcaatgcccagcactaccagcaggagtcctccaaactgcgccaacaaatcagtagcttacagaacgcaaacagtctaactcggcttgcctaaatatctctagtaggaccatagtgggggattctatcaacaccatgagcctcagggaccttaaacaggtagagaacaggctggagaaaggcatagctaagataagggctagaaagaatgagctgttatatgctgaagttgagtacatgcagaaaagggaagttgagctgcagaatgacaacatgtacctgaggagcaaggttgttgagaatgagaggggacagcagccactgaacatgatgggggcagcatcaacaagtgaatacgatcatatggttaataacccatatgattccaggaactttcttcaagtgaacatcatgcagcagcctcagcattacgcccatcagctgcagccaactacccttcaactcgggcagcagccggccttcaattagttttggtgtagacaccgtacgtacacacgtacgttagatgaaatctgaaggcgtcgatacccgcggctacgtaacagcgtgatcaacctgaagaaatcgatgcagtaattctatgtgttcgtcagatcatcataaccagtattgtcattaggcgttgtgaaaaaaaaatgtgtcagcatgcattgcaagctagcgtttgtggctgctcatcagctgcatgcgtaattgcgtacgtgcacaaattaaacagaccttgccaccattgtgccatattgtgtgtgttgtatgatatatatatatatatatatatatatatataaacagcacgtttgtgctctgattcgtgtaactgatcagcagatcaaactctaccactgccgatatatatgtgaggaccatggattgatgcattgtcgttgatcttc

SEQ ID NO: 5264 - DNA, 1407 bp, Oryza sativa
  Predicted polypeptide sequence is orthologous to G129, G136, G140, G146
gataatgtgcatcagccataactaccagcacacacaacgactacccttctttaaaaggaaacctcacagagcccaaggcttctccatgccgttgccctaagttgtcttctccaatctccactccccacccatcgatcaactcacagctcgatccagccccctccagatcttcagatcggtggatcgattgatcaacatggggagggggaagattgagataaagagaatcgagaacaagacgagccgtcaggtgaccttctgcaagcgcaggaatgggctgctgaagaaggcctacgagctcgccatactctgcgacgctgagatcgcactcatcgtcttctccagccgaggacgcctctatgagttctccaatgtaaacagcacaaggtcaacaatcgagaggtacaagaaagcctctgccagcacttcaggatccgctccagtgatagacgtcaattctcatcaatactttcagcaagaagcagcaaaaatgcgccaccagatacagaccttgcagaatgcaaacaggcacctcatcggtgagtccattggcaatatgaccgcaaaggagctcaagagccttgaaaatcggcttgaaaagggcatcagccgaattcgatcaaagaagcatgagctgctgttctcggagatcgaatacatgcagaaaagggaagcagatcttcagaacgagaacatgttcctgagagccaaggtggcagaggccgagcgagctgaacatgatgatcagcaggcggcggaggacgacgagatggcgccggcgccggcggtcggcggcgggtcatcgtcggggacagagctggaggcgctgccggcgacgttcgacacaagggaatactaccagccggcgccgccggtgagcatgctggccgccgcggcggcggcggcggcggcgcagtactcgtcggaccaccaccagactgctctccacctcggctacttcaaggtcgactccggcaaaggcggcctcctctagatcgatcgccatggatgcaaatattgcatgcattcgatcgaattatactgtattccgtaagagcgacgacgatgaagatgacaataattattgtggtattgtacgtatagtacgctggtagacctacgtatacgtatacgtatgtatgatgaagaataaggtggtgtttggttggaggggctaaagtggggctaaactttagttcctctcacaaaaatataagttcctattatagagacttatatttttgtgagagagactaaatttagtcctagttcccaaacacccctaatatacatttgtggtgtgcatgcatggtgtgtgggtactatatgatcagagtgtgctgcatatgcgtattccgtttgctagctctgacatgcatttgtctaaatatatatttttatttatgc

SEQ ID NO: 5265 - DNA, 1214 bp, Oryza sativa
  Predicted polypeptide sequence is orthologous to G129, G136, G140, G146
gagaaaacccaccaactggagctctcctttcctactccaagaaacgaagttgagagcaagaagacatggggaggggcaggattgagatcaagaggatcgagaacacgacaagccgccaggtgaccttctgcaagcgccgcaacggacttctcaagaaggcgtatgagctctccgtcctctgcgatgccgaggtggctctcatcgtcttctccagccgtggccgcctctacgagtactccaacaacaacaatgtgaaggctacaattgacaggtacaagaaggcgcatgcttgtggctcaacttctggtgcacctctcatagaggtcaatgctcagcaatactaccagcaggagtctgccaaactgcgccaccagattcagatgctgcaaaacaccaacaagcacctggttggcgataatgtgagcaacctgtcactgaaggagctgaagcaacttgaaagccgcctggagaaaggcatttcaaagatcagagccaggaagaatgaactgctggcttcagagatcaattacatggccaaaagggagattgagcttcagaacgacaacatggacctcagaaccaagattgctgaggaggagcagcagctgcagcaggtgacggtggcccggtcggccgccatggagctgcaggctgcggcggcggcgcagcagcagcagcagaatccgttcgcggtggcggcggcgcagctggacatgaagtgcttcttcccgttgaacctgttcgaggcggcggcgcaggtgcaggccgtggcggcgcagcgccagcagatcatccccaccgagctcaacctcggctaccaccaccaccttgccattcccggcgccgccgccgccgacgcgccgcctcctcacttctgaacctcatgaacttcattctgcaccggcctgctgccatggatatgatgatcagctcatcttctatatcttatgctgttatgcagacagacactactgatgtggctatatatatagtatttgtgtgctgctgcattttgttaatcccttataaattgctacttaattatctcatggagaattggagagaccaaatgggcagagctagctagttagctgtgcccaattaagaagctaaatctatcagaagtgtgtactgatgagtgatgagtatttttcttcatttgggatcaaattaaactaagtaaaacatatatatttgacttatgttttacgtgc

SEQ ID NO: 5266 - DNA, 1181 bp, Oryza sativa
  Predicted polypeptide sequence is orthologous to G129, G136, G140, G146
gactccatctcatctcatccttccccaaccattctcttctccttgaacacacccctctcttcctcattataatctcttctttgattagagaggaattagcaaacatgcacatatacaaagagcaggaggctgaaccatccactggcctgatgatgccagagccagcacctgttgcttcccccggctccggtggctcaggtggctcaggctcggtgggagctgagaagattgggagcaggggaaagattgagatcaagcgcatcgagaacacgacgaaccgtcaagtgaccttctgcaagcgccgcagcgggctactcaagaaggcgtatgagctctccgtgctctgcgatgccgaggtcgccctcgtcgtcttctccagccgtggccgcctctacgagtactccaacaacagcgtgaaggaaactattgagaggtacaagaaagccaacagtgacacctccaacgccagtacagttgcagagatcaatgcccagcactaccagcaggaagctgctaagctgaagcaacagatcaccaacctgcagaactccaacaggaccctagtaggtgataatatcaccaccatgaaccacagagaacttaagcagctggaaggcagactggacaaaggcctaggaaagattagagcacggaagaacgaattgctgtgtgctgaaattgagtatatgcagagaagggaaacggagctgcagaatgacaacatgtacttaaagagcaaagttgctgagagtgaaagaggactgcaaacagtgaacatgatgggttcagcatctacgagcgagtacgtgcaaaatatgatccattatgatccaagaaacttcctgcaattcaacatcatgcatcagcctcagtattatcctgaacaggaggaccgaaaggcctttatgtcagatgaaagataaatatggatccgtatcatgcaactatctcaatcatgcatgtgccttcttcaaggagactgatcagttagatattacactgtgtcagtagaacttttatgtgtgaactcttgtatgcatgaataattaactttatcccataattcaggcttggcactatcaaggtgatgtacctaagtattggttcaacctgtgaaattaaaatacttcatacccttcctatgtttatatatgaaatattggtgataatatcttgtgtat

SEQ ID NO: 5267 - DNA, 1373 bp, Oryza sativa
  Predicted polypeptide sequence is orthologous to G131, G135, G155
ctcgatcgatccatccatcgatcgatcggtcccccccaccgcgcgcgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggagggaggaggaggaggaggaggaggaggaggaagaacaggaggaagatggggcggggcaaggtgcagctgaagcggatcgagaacaagatcaaccggcaggtgaccttctccaagcgcaggtcaaaactgctcaagaaggcgaatgagatctccgtgctctgcgacgccgaggtcgcgctcatcatcttctccaccaagggcaagctctacgagtacgccaccgactcatgtatggacaaaatccttgaacgttatgagcgctactcctatgcagaaaaggtccttatttcagctgaatctgacactcagggcaactggtgccacgaatataggaaactgaaggctaaggttgagacaatacagaaatgtcaaaagcacctcatgggagaggatcttgaatctttgaatctcaaagagctgcagcagctggagcagcagctggaaaattcgttgaaacatatcagatccagaaagagccaactaatgctcgagtccattaacgagcttcaacggaaggaaaagtcactgcaggaggagaataaggtcctacagaaagaactggtggagaagcagaaagtccagaagcaacaagtgcaatgggaccagacacaacctcaaacaagttcctcatcatcctccttcatgatgagggaagcccttccaacaactaatatcagtaactaccctgcagcagctggcgaaaggatagaggatgtagcagcagggcagccacagcatgaacgcattgggctgccaccatggatgctgagccacatcaacggctaaggaggcttcgagtccataccagtaatcacaagttgcaacctgacccggtccggtcgcctgctgctctggtttactactagtactattgtcatcttgcggttgcgagacgaggaaagcattttagccctaaattcagcattagtagcaagctgcaatgtgtatattttggcttcgtccagcaccgtcttcctcccaccagtaatttacccatgtaatatatgcgagcagcatgaacaaattttcccgtttccaaccatctccattggtgtcatgtgtgacttaaatagcgaaatttcagcattgtgcatagtgtgattactgtaagataaaaaaaaaaaaaaaaaa

SEQ ID NO: 5268 - DNA, 1347 bp, Oryza sativa
  Predicted polypeptide sequence is orthologous to G131, G135, G155
ctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaactcgatgaaccggcaggtgacgttctccaagaggaggaatggattgctgaagaaggcgcacgagatctccgtcctctgcgacgccgaggtcgccgccatcgtcttctcccccaagggcaagctctacgagtacgccactgactccaggatggacaaaatccttgaacgttatgagcgctattcatatgctgaaaaggctcttatttcagctgaatctgagagtgagggaaattggtgccatgaatacaggaagcttaaggcaaagattgagaccatacaaaaatgtcacaaacacctcatgggagaggatctagaatccctgaatctcaaagaactccaacagctagagcagcagctggagagttcattgaagcacataagatcaagaaagagccaccttatgcttgagtccatttccgagctgcagaaaaaggagaggtcactgcaggaggagaacaaggctctgcagaaggaactggtggagaggcagaagaatgtgaggggccagcagcaagtagggcagtgggaccaaacccaggtccaggcccaggcccaagcccaaccccaagcccagacaagcttcttcttcttcttcatgctgagggatcagcaggcacttctttcaccacaaaatatctgctacccgccggtgatgatgggccagagaaatgatgcggcggcgcggcggcggtggcggcccaaggccaggtgcaacttccgcattggaggctttccgccatggatgctgagcaccttcaaggcttaagatgatcatcggcgtcgtcgtcgggccaacaagttgccgattgcaccgggaatcatgggagcaaccttgaatgaaatggaagcattgggattggaagcggataatatatatgaatctcctaaaaggaaatggactcaaaaaaaaaaacctagcgattaagctattcttatatatgcgtttgcctgctgctccctaccctacaggctacatatgatttgcaagaaattaattatgagcaaggatcaggatgtgtctttgtgtaatcatcagcacgtacctagtgcttcctactgatatatatgcatgcaattgtgtgcatataaatatatttgcatgccatgctcccgtgatggttaattaatttatgattgtgtttatacgctaattaactgcagatgcaaactaatcaatcgaattat

SEQ ID NO: 5269 - DNA, 998 bp, Oryza sativa
  Predicted polypeptide sequence is orthologous to G131, G135, G155
atggggagggggaaggtgcaggtgcggcggatcgagaacgaggtgagccggcaggtgaccttctccaagcggcggccggggctgctcaagaaggcccacgagatcgccgtcctctgcgacgtcgacgtcgccgccatcgtcttctccgccaagggcaatctcttccactacgcctcctcccacaccactatggagcgaatccttgagaagtatgacagacacgagttattatctgaaggaaataatgtgattgaagagttccctgagctggagggaagcatgagatatgaccacatcaagctgaggggcaagattgaagctctaaaaaagagccaaaggaatcttatggggcaggaacttgactcgctgacactgcaagatatccagcagcttgaggaccagatagacacttctctgaataacataagatcaagaaaggaaaagttgctgatggagaaaaacactattctggagaagaaaattactgaactggagacactgcatacaagcatcagggcgtcacccactgaagctgctgctcctcctgcctgcaatattgctgatgcatttgttcccaacctcaacatctgctgcggcgattccggcgagccggaaaccgtgacggcgccacttggctggaccagcagcaacaatggcttgccatggtggatgctccagtcatcatcgaacggcaagagctagaagatgttcagatgaaatggtccctgcagccattgcatggttgctgaataatgtcgtcccagatggttaggcaagcaacctacctagaactttcagttagtgagcggtagtagtatctcccccttcttaatccctactatactccgtagattaattctaagcatccttttgtttccattatctacgctgctggtttgatgaaattcctgtgttgtattcagctgcattgggatcattgctcagcctttggtcatgtctctcactggaatcaatgtgtcatgtctgtcttgcaatca

SEQ ID NO: 5270 - DNA, 2563 bp, Oryza sativa
  Predicted polypeptide sequence is orthologous to G131, G135, G155
gactgacacccgtccccaaaagcaaagaggcctctctctctctctctcgccgatccctctcctcctcctcttcttcttcttccactagctagttcgtcttcctccttcagctagcttgtagcagctaaggttaggtcggatcgagatcgggatcggccgccggcgagcggcgagcggcgaggatggggcgggggaaggtgcagctgaagcggatagagaacaagatcaacaggcaggtgacgttctccaagaggaggaatggattgctgaagaaggcgcacgagatctccgtcctctgcgacgccgaggtcgccgccatcgtcttctcccccaagggcaagctctacgagtacgccactgactccaggatggacaaaatccttgaacgttatgagcgctattcatatgctgaaaaggctcttatttcagctgaatccgagagtgaggtaaaacacagtaggttgtatgatatataacttttacatgaagggaatattattgttccttttctattgcattagcatttcaatcatatcatttccttgtggccttttaaatcacatgttaacaaagcagtttttctgaattctatcgttctacttgccaaaactagatgttggtaaccttctgttttatactttttaacttcaaacctcgtgtcttttgcactctggcatatttcttaaaatttctacttattgggatatcatgcaggagagtcctcattcccttcatttaatcccctcaaattttatttattatggtcatacaattaatgggccacatgcatggaagtcgatcgccagcttgcgatcagcatcctatcattaatgttatgatctatactaattcttctgtaaataaattaaaattgcactagtttttaactaaatgctactattctatttttttatccatactccgtttgagtggtttcttttgtgtttcatgaagccatataatatgcttaagaaaacatagaaacatgcacaatacaataatagcgctggtaggatccggttggagaccaaatgtttcgatattctaagtgcatatttatatatactaagtaaaactgtaatcataaacatgcatatggactgtgatcgatgaaatgtttcttcattttttttttcaagataactcttccccagttgacaacatgcactgcatccagaagtactcatggtatttgttttcagtactgtttgatgagtaaaactttggtaagtgttaaaaaatgatgataagtgcaaatatttgttcctttaccacttccaccttcttggagtaaagaaaaaaatgtgtgtggtttggcaaagttgttgcatatatcacggcattagtgtgcggataatgcgaataaatgcatcaataagcactaggagtaagttaattagttctctaccttaattgaaaagttcatgtacatttaaaaaaattaaacatgcctctttttatcatttgttgaatttctacatttatcaagacagcaaaggagttctcatctactaataaattaatttaaggagctataactcccttaattttatcaaatattcacatacacggttgcatttgaggattttctatatactccactaaatgaggatgcatttaggttctttataatattttatttccatcgtttcatcatctgtttatgtttacagtaatttagtaatagttctctaattttgacagtaatggttggctcacagaaaacatcaaccaaccatatatattggtttatactgacaaagagtttttttttgtacagggaaattggtgccatgaatacaggaaacttaaggcaaagattgagaccatacaaaaatgtcacaaacacctcatgggagaggatctagaatccctgaatctcaaagaactccaacagctagagcagcagctggagagttcattgaagcacataatatcaagaaagagccaccttatgcttgagtccatttccgagctgcagaaaaaggagaggtcactgcaggaggagaacaaggctctgcagaaggaactggtggagaggcagaagaatgtgaggggccagcagcaagtagggcagtgggaccaaacccaggtccaggcccaggcccaagcccaaccccaagcccagacaagctcctcctcctcctccatgctgagggatcagcaggcacttcttccaccacaaaatatctgctacccgccggtgatgatgggcgagagaaatgatgcggcggcggcggcggcggtggcggcgcagggccaggtgcaactccgcatcggaggtcttccgccatggatgctgagccacctcaatgcttaagatgatcatcgtcgtcgtcgtcggccaaacagctgccgtatgcaccgtgaatcatgggagcaaccttgaatgaattgaagtcattggtatcgatcctagcgatgatatatatgattctcctaaaatgaaatttatctcaaaaaaacaaacctagcgattaagctattcttatatatgtgtttgcctgctgccccctaccctacaggctacatatgatttgcaagaaattaattatgagcaagg

SEQ ID NO: 5271 - DNA, 1088 bp, Oryza sativa
  Predicted polypeptide sequence is orthologous to G131, G135, G155
ctccccccatttccatcttccccgagctctccaccctccacccgccaccgccaccgccgccttcgccgccgccgccgccgccgacgacgatggggagagggccggtgcagctgcggcggatcgagaacaagataaacaggcaggtgaccttctccaagcggaggaacgggctgctgaagaaggcgcacgagatctccgtgctctgtgacgccgacgtcgcgctcatcgtcttctccaccaagggcaagctctacgagttctccagccactccagtatggaagggatccttgaacgctaccagcgttactcgtttgatgaaagagccgtactggagccaaatactgaggaccaggaaaactggggtgatgaatatggaattttgaagtccaaactggatgcacttcagaagagccaaaggcaactcttaggtgaacaattggacacactaacaataaaagaactccagcaattggaacatcaactggaatattctctgaagcatataagatcaaaaaagaatcagcttctgtttgaatcaattcctgagcttcagaagaaggaaaagtcacttaaaaaccagaataatgttctgcaaaagctcatggagacagaaaaggagaaaaacaatgctataataaacactaaccgggaggagcaaaatggagcaacaccaagcacatcatcaccaacaccagtgacggctccagatcccatcccgacaacaaataacagtcaaagccaaccaagaggatcaggggagtcagaagctcaaccgtctccggcacaagcaggcaacagcaagcttccgccatggatgctccggacaagtcacacatgaaggcatctgttgatctcaaacgtcactccactcaatggccaacatcaacatgtttcttccaactaaggcagccactgttgtgcaatccatcttccagcgatattgatatatcggcattcggcatagccaatatatattaatgtaatgtatcttgtcaaagcttcatagggttaatgacgccttgagcttctctgttctatatctgtcttgtaacgatctttgcatatctgctgcatttttttttctctc

SEQ ID NO: 5272 - DNA, 1784 bp, Oryza sativa
  Predicted polypeptide sequence is orthologous to G131, G135, G155
gctcgtcgtctcccccactcgatcgatccatccatcgatcgatcggtcccccccatcgcgcgtgacgcattccgccgccgtctcgccgtgtccacgtgatgggggccggggctaggggataggcggatagccagcagccaccaccaccagtagttgccgtgtggggataggtgtggctatagggctagtggtcgtcgctgatagcgaggtgggtagggttaattttggttggaggtagagagagagagagagggagggagggaggaggaggaggaggaggaggaggaggaagaacaggaggaagatggggcggggcaaggtgcagctgaagcggatcgagaacaagatcaaccggcaggtgaccttctccaagcgcaggtcggggctgctcaagaaggcgaatgagatctccgtgctctgcgacgccgaggtcgcgctcatcatcttctccaccaagggcaagctctacgagtacgccaccgactcatgtatggacaaaatccttgaacgttatgagcgctactcctatgcagaaaaggtccttatttcagctgaatctgacactcaggtaaaaataaagagctctaattctgttgtttctcatatctcaatatcttgtttattttttgaacttttcactacacctgtttcggttgactcattcaagacgggtacatccaacattttagctctcctcaagttggataaatcaattaggcatcattttttatggcaattttccattgttatgtagatcaacttttaataaatattgctttacatctctttgaacagtaatctcttacttcaatgtatttatcaaatatgtagatttattctaaattagattatatccattttttattacatagcgtcctgaccttttggcatcccagcccaattgaacctatttgctgtctgaaatcttgaaaactcaaactgaactgttctttatattggtgcaattaattaggctctctctctcaggtcagatcattaaaaattgtggtattgttacatttcataagtgaaattttgttcacaaattagatcaaatttatcttccatgtttgtttacacgtatacagctttgccagttccctcttattcaaacattttttacactatgattcaatataccttttgtggattttactggaacaaaatcatagttattgcctaatgaaaaactataaaaaaaaattttggatgcatgactacatcaacactcattatggaattttgtgtgccagagaatatcacaaaacatatttttcatcaaataaaacaaaataaacattttccagaacttttggcgtggctcatcagaagtttggaaccttaaataatccttgttttcatttagctgggacttactatagtcaattatgctattaaaaagatccattcgtctatttgttacgaataatctttactctttagttggggttgatggactaatggtgtactccaaaatcagaagttcttttatggctagatacatgtagaccggatttgaaaactttcaagtttagatttgacaaaaactttcaactcgcgattgaaaattttcaagtccacatttgaaaactttcaagtttagatttgaaaactttcgacccagatttgaaaactttcaactcgagatttgaaaactttcaagcctagatttaaaaactttcaagttcagattgaaaaactttcaagttaagatttgaaaattttcagctcaaatatttttgaaaacacgtatcctaacaattaaaaaaatcagaaaaaacacg

SEQ ID NO: 5273 - DNA, 980 bp, Oryza sativa
  Predicted polypeptide sequence is orthologous to G131, G135, G155
ggtacaggtcggaattccgggtcgaccacgcgtcgaaatctctcccatacatacactacagcggcgaacctttccttattctcgcaacgcctcggtaacgggcagcgcctgctccgcgccgcggttgcgagttcgggaaggcggccggagtcgcggggaggagagggaggattcgatcggccagaatggggagggggcgcagcgagataaagaggatagagaaccccacgcagcggcagtccaccttctacaagcgcagggacggcctgttcaagaaggccagggagctcgccgtcctctgcgacgccgacctcctcctcctcctcttctccgcctccggcaagctctaccacttcctctcccccaccgtcccctccgtgagggagtttgtcgagaggtacgaggccaccacgcacaccaaggtttgggcagatatcaggcaggagaggcgcgccgagctggagaaggtgggcagcatgtgcgacctcctggagaaacagctgaggttcatgacggtggacgacggcgaggagtacacggtgccgtcgctggaggcgctggagcacaatctggagggcgccatgcgcaatgtgcgctccgagaaggaccgcaagatcggaggcgagatctggtacctccagaacattatcagggggcgaaagaggagcggtacggctgtgggaaagatggtcatgacagatctgaaggatgtggatgggatcacgtcataggaagggttggacttactggttgtctagacgaatcgttctatgttaatggtaccgtgatggtctaacctggattgcggtaaagaaaagacgtgataatatagggtagcgttataatatgatgggtagaaagctatggactttacacataaaaacgtctattgtgtgtatgtgaagtatgataagaattgatataattagagtgtatatatcacgaaaatgttgtgttctatatgtataatttttttatag

SEQ ID NO: 5274 - DNA, 1063 bp, Oryza sativa
  misc_feature (617)..(617): n is a, c, g, or t
  misc_feature (804)..(804): n is a, c, g, or t
  misc_feature (814)..(814): n is a, c, g, or t
  misc_feature (847)..(848): n is a, c, g, or t
  misc_feature (850)..(851): n is a, c, g, or t
  Predicted polypeptide sequence is orthologous to G131, G155
gcccacgcgtccgggccgacttctctctctctctccatttctctcgatttctccacttctctctctctctctccctttctctcggtgtgcagcggcggcctggcagggagagaggggagcgtgcggcggcccagcggcggcggcgccctcccctccaccagatctaacaggagcgggaggagaggcgcggtcatggcgaacggtctggaggtgcaacgccggtgaccacaagccgactagggctccaagtttggacaacccgagctcggggggctgtggatctagctgtcccgagtttgggtactccagatccagtggcctccggcgccaacagcgccagatccaggctcatggtgagtggatggcgtctcctctctcctccaatcggctgtgtgcgctgccgtccgccgtcaaggcctatcggctgtacggcgagcatgtgcttctcctcatcctgtgcagtcaccacctaccggctacatgagctagacatctttggagctgcttctccagttgctgcagctctttgagattcagagattcaagatcctctcccatgagatggctgcaggaattaccgacaatcacttttgctgcaagatcctcttctccataangtaataggggtccatagactatggagtggtgacttgagataatgatgatcggtttctaaggcagcctgtgtcttgggttatttatccgactgggagtgggcgggctgttctttggaaccaaggccttggagggcgcctcaatggaggctgcaaacggctcagggagagctggatcggtgagggaacnatccgcgacntccatctgctttgtgccgcccggtcgtgcgggnntnngaacagaacagaaaaaaaaacacgcaaacacgaagaacacaacgaaacagaaaaacacgacaaaagcacggaaaatcaaataaaaagatacacaaacaaaacaaacacaaagacaagaacaagagaaaataaacacacaaaagaaagaaacacaataataatagcaacacaagacaaaatcaaaataagaaaactaaaaacaaaacgaatag

SEQ ID NO: 5275 - DNA, 1210 bp, Oryza sativa
  Predicted polypeptide sequence is orthologous to G133
ggagttgggaatccgttgctgtcgtacgtctcgtctatggcgtgctgtatgtcctctccttctttcttcctttccaaataagcactcctcttcttcctcctcctcctcctccgcctcctcttctcattcccaactcatcgatccatcagtagctagctagctagctagctagctgcattgtccggcgagagagatagctgctgcagggggcggccatggggaggggcaagatcgagatcaagcggatcgagaacgcgaccaacaggcaggtgacctactcgaagcgccgcacggggatcatgaagaaggccagggagctcaccgtactctgcgacgcccaggtcgccatcatcatgttctcctccaccggcaagtaccacgagttctgcagcccttccaccgacatcaaggggatctttgaccgctaccagcaagccatcggcaccagcctttggatcgagcagtatgagaatatgcagcgcacgctgagccatctcaaggacatcaaccgcaacctgcgcaccgagatcaggcaaaggatgggagaagatctggacgggctggagttcgacgagctgcgcggtcttgagcaaaatgtcgatgccgccctcaaggaggttcgccacaggaagtatcatgtgatcaccacacagactgaaacctacaagaaaaaggtgaagcactcctacgaggcgtacgagactctgcagcaggagctggggttgcgcgaggagccggcgttcgggttcgtggacaacaccggcggcgggtgggacggcggcgccggcgccggcgcggcggcggacatgttcgccttccgcgtggtgcccagccagcccaacctgcacggcatggcctacggcggcaaccacgacctgcgcctcggttgatatatcatcgccgccgccgccgccgccgccggcggcctgctcgtcgccggccggccggccgccggacaccgtatcatcgctcgatctagataacaagccgacgaataaattgcagtgctcgtgttacttacctgcatgcgcatgcattattatcgatcaacgcaagaacttcatttcatttaccaaaccacttgatgtgtgctatgatccagcggttaaaccgtgtgttgtctcttgacattttgtaccagttactgatgatgttgtattatgtatgcgtggtgtgcaactgtgcttggataatttcacacttatttgtc

SEQ ID NO: 5276 - DNA, 1027 bp, Oryza sativa
  Predicted polypeptide sequence is orthologous to G134
gaccctcttgtttcttcgagagcgaggtgaagatttgtttcttggtttgtgttcttggagtggaggaggaggaggagttggatatggggcgcggcaagatcgagatcaagaggatcgagaactcgacgaaccggcaggtgacgttctcgaagcgccgcgccgggatactcaagaaggcccgcgagatcggcgtgctctgcgacgccgaggtcggcgtcgtcatcttctccagcgccggcaagctctccgactactgcacgcccaagaccacgtccgtgtttcccccgctgtcaaggatcttggagaagtaccagaccaactccgggaagatactctgggatgagaagcacaagagcctcagcgcagagatcgatcgtgtcaagaaggagaacgacaacatgcagatcgagctcaggcatatgaaaggggaggatctgaactccctgcagcccaaggagctgatcgcgatcgaggaggcgctcaacaacggccaggccaatctgcgggacaagatgatggaccactggaggatgcataaaaggaatgagaagatgctggaggacgagcacaagatgttggcttttagggtgcaccagcaggaggtcgagctgagcggcggcataagggagctggagctcggctaccaccacgacgacagggacttcgcggcctcgatgccgttcaccttcagggtgcagcccagccaccccaacctccagcaggagaagtaggctgctgagcactgccaatttggctgaacctcctgcttgctagctttgcatttcctcatgcgctgctagatgtatctgtggtttctctcatgcctgtctgaatgaactcacactgatgagagggtgtcagttgttttgtgctcctcccagcattagcactcagaattcagaaatgactcaatgtcagttgcttttgtgcttctcccagcattagcactcagaattcagaaatgactcaatgtcagttgcttttgtgcttctccctgcttgtttaattagccactgttcttgtttcc

SEQ ID NO: 5277 - DNA, 1098 bp, Oryza sativa
  Predicted polypeptide sequence is orthologous to G134
cctcgaaagcctcctcatcaccattcctcttcctcccatggcgaactcctttactcctcctccacccccaccgcctcgcccatccacaccgacgccaaggcagcgcttgttcttgttgttgttgttgttgttggcttcgctttgctgctaagctagctggaggaaggaggaggaggaggaggaggcgggatgatggggcgcgggaagatcgagatcaagaggatcgagaactccaccaaccgccaggtgaccttctccaagcgcaggagcgggatcctcaagaaggcccgcgagatcagcgtcctgtgcgacgccgaggtcggcgtcgtcatcttctccagcgccggcaagctctacgactactgctcccccaagacctcgctatcaagaatcttggagaagtaccagaccaattccggaaagatactgtgggatgagaagcacaagagccttagcgcggagattgatcgaatcaagaaagagaacgataatatgcagattgagctcaggcacttgaaaggtgaagatctaaactctctgcagcccaaagagctcatcatgattgaggaggcacttgacaatgggatagtgaacgtgaatgataaactgatggaccactgggaaaggcacgtgagaactgataagatgctggaagacgagaacaagctgctggcttttaaactgcaccagcaagatatagcgctgagcgggagcatgagggatcttgagcttgggtaccatccagacagggactttgcggcccagatgccgatcaccttccgcgtgcagcccagccaccccaacctgcaggagaacaattaagctgctaggttgccccgccacttcgatcagttatctcatccactgatccaccactggattgaatgtcctagtgcattgtcaactgtatccctgttttcatgtctgtttcgatgaactattgagcatgtcatatgtgagttgctttgtgtgccaatatatagtctgtctctagtacaagctctgtgcttgccattctgcctcgctgtagatagcaccagcaatggagctagctcagatatcagtaacttcgtgcaagctgcaaggtaaaaaaaaaaa

SEQ ID NO: 5278 - DNA, 715 bp, Oryza sativa
  misc_feature (715)..(715): n is a, c, g, or t
  Predicted polypeptide sequence is orthologous to G135, G155
tttttttttttttttttttgacatgaccaaatggctgatcaatgatcccaatgcagctgaatacaacacaggaaattcatcaaaactagcagcataggaaatgcttgcaatctacttagggattaagaagggggagatactaccacggtactaccactgtactactgctcactaactgaaagttctagctaggttgcttgcctagccatctgggacgacattattcagcaaccatatgcaatggctgcagggaccatttcatctgaacatcttctagctctagaagtttgatgatgactggagcatccaccatggcaagccattgttgctgctggtccagccaagtggcgccgtcacggtttccggctcgccggaatcgccgcaactgcggttttagttgatggccagatgttgaggttgggaacaaatgcatcagcagtattgcaggcaggaggagcagcagcttcagtgggtgacgccctgatgcttgtatgcagtgtctccagttcagtaattttcttctccagaatagtgtttttctccatcagcaacttttccttctgtcggagctcgccgatcgacttgagcaagagattggtctttcttgatcttatgttattcagaagaagtgtctatctggtcctcaagctgctggatatcttgcagtgtcagtgagtcaagttcctgccccccccttgtctcgtcctctggctcn

SEQ ID NO: 5279 - DNA, 1284 bp, Oryza sativa
  Predicted polypeptide sequence is orthologous to G137, G145
gaattaagccacagcttgagcagatcagctgcaggccggccggtgtgcgtgtgtgacagtaggagagagagctagcgagagagagcaaggaatcggaattgatttcatgcactgatcgatccatccatcatgcagatgctgcatggatgagaagagctagcagctaagctttgctgaagaaaattcttcagaggtttgtgttgatttgctggtctgctagagatcgatctagagagagagagaggaagggaagactgaagagagatctcgagcgggagatcgagatggggcgaggcaaggtggtgcttcagcggatcgagaacaagatcagccggcaggtgacgttcgccaagcggcggaacggcctgctcaagaaggcctacgagctctccatcctctgcgacgccgaggtcgccctcgtcctcttctcccacgccggccgcctctaccagttctcctcctcatccaacatgcttaagacgcttgagagataccagaggtacatttatgcttcgcaagatgctgccgcaccaactagcgatgagatgcagaacaactatcaggaataggtgaacttgaaggcacatgttgagattctgcaacaatcacaaaggaaccttctaggtgaggatttagctccactggctacaaatgaacttgagcagcttgagagtcaagtagtcagaaccttgaagcaaatcagatcaagaaagactcaggtactacttgatgaactctgcgacctaaagagaaaggaacaaatgctacaagatgcaaacagggtcctgaaaaggaagcttgacgagatcgacgtagaggcagctcccccacagcctccatggaacggaaactgcagcaatggccatggcggcggcggcggcgtgttttccagtgagcctccccaaccagagcacttcttccaggccctcgggcttcatgccgtggacgtgaaccagccgccggcgccgccaccgggcggttatcctcctgagtggatggcctagctagctagctagctaccgtttcagcttcagttaatcagggtcaagtatcagctgagtttggccatatgtatggattctatatgttgcttcagaagttcctctctccttcctcttcaatttgttgctaattaagtgcttgccaaacttttctcagtgtaatgtactactactatgtatagttttgtcttgtatgaacagtttgtgagtactgtcactgcgagtaaggtgcgtgatatggtaccgtgaaaacaaaagcgggacaaccatcctttttgcgttt

SEQ ID NO: 5280 - DNA, 1203 bp, Oryza sativa
  Predicted polypeptide sequence is orthologous to G137, G145
gagctttcccctctctttcgcttcgcgagattggttgattcatctcgcgattgatcgagctcgagcggcggtgaggtgaggtggaggaggaggaggaggaggagatcgggatggggagagggagggtggagctgaagaggatcgagaacaagatcaacaggcaggtgacgttcgcgaagcggaggaatgggctgctcaagaaggcgtacgagctctccgtgctctgcgacgccgaggtcgccctcatcatcttctccaaccgcggcaagctctacgagttctgcagcggccaaagcatgaccagaactttggaaagataccaaaaattcagttatggtgggccagatactgcaatacagaacaaggaaaatgagttagtgcaaagcagccgcaatgagtacctcaaactgaaggcacgggtggaaaatttacagaggacccaaaggaatcttcttggtgaagatcttgggacacttggcataaaagagctagagcagcttgagaaacaacttgattcatccttgaggcacattagatccacaaggacacagcatatgcttgatcagctcactgatctccagaggagggaacaaatgttgtgtgaagcaaataagtgcctcagaagaaaactggaggagagcaaccagttgcatggacaagtgtgggagcacggcgccaccctactcggctacgagcggcagtcgcctcatgccgtccagcaggtgccaccgcacggtggcaacggattcttccattccctggaagctgccgccgagcccaccttgcagatcgggtttactccagagcagatgaacaactcatgcgtgactgccttcatgccgacatggctaccctgaactcctgaagggccgatgcgacaaccaataaaaacggatgtgacgacacagatcaagtcgcaccattagattgatcttctcctacaagagtgagactagtaattccgtgtttgtgtgctagcgtgttgaaacttttctgatgtgatgcacgcacttttaattattattaagcgttcaaggactagtatgtggtataaaaggccgtacgtgacagcctatggttatatgctgcacaaaaactacgtatggtacagtgcagtgcctgtacatttcataatttgcggtaaagtttattgactatatatccagtgtgtcaaatataataaaatgtcgaggtttaattacc

SEQ ID NO: 5281 - DNA, 1188 bp, Oryza sativa
  Predicted polypeptide sequence is orthologous to G137, G145
gaggtagccaaaccacaccaccataaagctagcttgcaaaggggatagagtagtagagagagagagagaggagaggaggaggaagaagatggggagggggaaggtggagctgaagcggatcgagaacaagatcagccggcaggtgacgttcgccaagcgcaggaacggcctgctcaagaaggcctacgagctctccctcctctgcgacgccgaggtcgccctcatcatcttctccggccgcggccgcctcttcgagttctccagctcatcatgcatgtacaaaaccttggagaggtaccgcagctgcaactacaactcacaggatgcagcagctccagaaaacgaaattaattaccaagaatacctgaagctgaaaacaagagttgaatttcttcaaaccacacagagaaatattcttggtgaggatttgggcccactaagcatgaaggagctggagcagcttgagaaccagatagaagtatccctcaaacaagtcaggtcaagaaagaaccaagcactgcttgatcagctgtttgatctgaagagcaaggagcaacagctgcaagatctcaacaaagacttgaggaaaaagttacaggaaaccagtgcagagaatgtgctccatatgtcctggcaagatggtggtgggcacagcggttctagcactgttcttgctgatcagcctcatcaccatcagggtcttctccaccctcacccagatcagggtgaccattccctgcagattgggtatcatcaccctcatgctcaccatcaccaggcctacatggaccatctgagcaatgaagcagcagacatggttgctcatcaccccaatgaacacatcccatccggctggatatgatgtgtgtgttcagttcaggcttcaggcttcagagaagccaatgcaaacagtgtcctgtaatccagtaattacagggcatatgtaatgtaatgtaatgtaatccctgatctatattttgctaagtacgtgcgtgctctcttacgaccttctcccccgaacagttaatcaggggaataataatttcgtttgatgcacgtactgtatgtctgtatctgtcactgtatcgtaggaccgtccatgtataacaatttccgttttggatgtggtaacaagttaattggcacttaaatttatatttgtgatgatctgggagagtacctaatctc

SEQ ID NO: 5282 - DNA, 1265 bp, Oryza sativa
  Predicted polypeptide sequence is orthologous to G137, G145
caatccaacaaatctacataggaattactctttcggactcaaactcctcaattttttcccacttaaaaatccttcgccctaattaaagttcacccgttacaaatggagagcgatcgagctctcaactagcctaattcaagaggtgatgaagaaaaatggcagagaaaaagaagaagaagaagaagaagaagccgcaatcactcctagtccttacaagctggagatcgatcgggatggggaggggtcgggtggagctgaagaggatcgagaacaagatcaaccggcaggtgacgttcgccaagcgcaggaatggcctgctcaagaaggcgtacgagctctccgtcctctgcgacgccgaggtcgccctcatcatcttctccaaccgcggcaagctctacgagttctgcagcacccagagcatgactaaaacgcttgagaagtatcagaaatgcagttacgcaggacccgaaacagctgtccaaaatagagaaagtgagcaattgaaagctagccgcaatgaatacctcaaactgaaggcaagggttgaaaatttacaacggactcaaaggcaatactacaaatctaaacataggctgtgtttagttcggtccaaagtttggaatttggttaaaattagagacgatgtgactgaaaagttgtgtatgtatgaaagaaatttgctgggtgaagatcttgattcattaggcataaaagagctcgagagcctagagaagcagcttgattcatccctgaagcacgtcagaactacaaggacaaaacatctggttgaccaactgacggagcttcagagaaaggaacaaatggtttctgaagcaaatagatgccttaggagaaaactggaggaaagcaaccatgttcgcgggcagcaagtgtgggagcagggctgcaacttaattggctatgaacgtcagcctgaagtgcagcagcctcttcacggcggcaatgggttcttccatccacttgatgctgctggtgaacccacccttcagattgggtaccctgcagagcatcatgaggcgatgaacagtgcgtgcatgaacacctacatgcccccatggctaccatgatgatgacggggacaatgaattacgaaataacaaggatatgtggcatatatgtggtgccgcatacatgcatgtatcatggctagctacttaattggagtgatggatttgaactagtttcgtatgtagcctgtttgtgtgtaacttgtgtgagatactaccttaaaaacaaaaaaaaaa

SEQ ID NO: 5283 - DNA, 1094 bp, Oryza sativa
  misc_feature (992)..(992): n is a, c, g, or t
  Predicted polypeptide sequence is orthologous to G137, G145
ctgcaagggagagggagagagagggaagcttgcaggctgcagctaactagctaggcggggagagagaggagatagatcaagaagagattttgagaccgagagagagctagagagagatcgatggggcgagggaaagtagagctgaagcggatcgagaacaagataagccggcaggtgacgttcgcgaagaggaggaacgggctgctgaagaaggcgtacgagctgtccgtgctctgcgacgccgaggtcgccctcatcatcttctccacccgcggccgcctcttcgagttctccacctcctccggtatgtacaagacactggagcgataccgcagttgcaactacaaccttaactcatgtgaagcatctgctgcactggaaactgaactaagcaattaccaagagtacttaaagttaaagacaagagttgagttcctacaaacaactcagagaaatcttcttggcgaggacttggttccacttagcttgaaggagctcgagcaacttgagaaccagatcgagatatccctcatgaatatcaggtcatcaaagaatcaacagttgcttgatcaagtatttgagctcaaacgtaaggaacaacaacttcaagatgctaataaagacttaaaaaggaagatacaagaaactagtggagaaaatatgcttcatatatcttgccaagatgtagggcccagtggccatggttagtaaggttaccaaggagttttccatcatgcatttgggaccttcccgggatatgggtatcagcttaatggttacctcaccatgatgatggctttccctatggacatcccagggggagcgggcgacgaagcccctactgcggtacctaggtgggggcaatcgggtggaacgccgacgacagagaacgtgaagaggccaacacctgtcggccagtcaattggcccaaacaaaacaaaggggcaacacacgagaaatagaaagctagacatcccgaccgcgccctcgcnacaacatacacaagaaacaccacgaagaaacagaacacacaacaaaaagcaaaaacaacacgaagagacacacaacacagcacgaaaataccaaacgaaacc

SEQ ID NO: 5284 - DNA, 690 bp, Oryza sativa
  misc_feature (28)..(28): n is a, c, g, or t
  misc_feature (77)..(77): n is a, c, g, or t
  Predicted polypeptide sequence is orthologous to G142, G148
aagaaaggccttacgagctgcccgtttnttctgcgacgccgaggtcgcgctcatcatcttctccagccgcggcaagntctacgagttcggcagcgccgggtataattaatacagacacaacaacacacacaaccaacaaaccagcatcaatttgaacctgcagatctgctgttttctctgatcaattgcttctttttttttgttcttttttgtttcttttatctgctgcaacggcgtcctgctcctctggggtttctcgttttctttttcatttatttttagcaggtgccaagtagccgagctactatacttacctggccatgttaattattttattccgtctgtctgtgtgtgtctgtgcatactactatagggacatggcgcggtgttcttataaaccgggaggccggatccctaactagcatgggaggatatcttttcagcggatctatacaaaccctactcctgctgacctctttcttccagtttctccgggtcttccttggattattattgcccatcttccgggttgtgcgtgtgtcagagacagctcgaacgataaatttctcaaaaccagtactagagagggtgtgttgtgtgtgagaactgagtggagagttagcatgaaggctgcaaactagaaaggaaggtatgttctttcctttttgatccaaaaaaaaaaaaaaaaaa

SEQ ID NO: 5285 - DNA, 566 bp, Oryza sativa
  Predicted polypeptide sequence is orthologous to G142
gagttcgtaaatttttattagagttatttacatagttaataatatcaatcaaaaaaagcaattttaatttttttggtggaatttttaaaagttttttaaaattaaaaaaagcacttttagttttttttggtgggtttttagggtattttaaaattaaaaaggcaattttacaaaagagattatactataaaaatttacaaaagaaaaaatgacaagagagatttgaaaattcttggctgctgttcttcaatccattttgatggtcatatggggttgttgggagggagttgttgctgagaagatggtggaaggtctaccggggtttattccaagatatatatattggatccggcctaaatccaaaaatggattagttttaagaccaacttgccttggatgttgtctgttttgaggcagcatggagttgttggggcatagggaggatcactgggttgttcgtgcaggatggagttgcattatggatcatggaccaccgttgttgttgtagttgccaccagccatctttgaatcccaaccagaagaagaagagaagaccaaatcctttc

SEQ ID NO: 5286 - DNA, 1134 bp, Oryza sativa
  Predicted polypeptide sequence is orthologous to G142, G148
gatattctcgtcatcattggaggctttagcaagcaagaagagaggcagtggtggtggtggtggaggaggagctagctagcctgtgcttgctgatcggtgctgagctgaggaatcgttcgatcgatcgggcgagatggggaggggaagagttgagctgaagcgcatcgagaacaagatcaacaggcaggtcaccttctccaagcgccgcaacggcctcctcaagaaggcctacgagctgtccgttctctgcgacgccgaggtcgcgctcatcatcttctccagccgcggcaagctctacgagttcggcagcgccggcataacaaagactttagaaaggtaccaacattgttgctacaatgctcaagattccaacaatgcactttctgaaacccagagttggtaccatgaaatgtcaaagttgaaagcaaaatttgaagctttgcagcgcactcaaaggcacttgcttggggaggatcttggaccactcagcgtcaaagaattgcagcagctggagaaacagcttgaatgtgcactatcacaggcgagacagagaaagacgcaactgatgatggaacaagtggaggaacttcgcagaaaggagcgtcagctgggtgaaattaataggcaactcaagcacaagctcgaggttgaaggttccaccagcaactacagagccatgcagcaagcctcctgggctcagggcgccgtggtggagaatggcgccgcatacgtgcagccgccgccacactccgcggccatggactctgaacccaccttgcaaattgggtatcctcatcaatttgtgcctgctgaagcaaacactattcagaggagcactgcccctgcaggtgcagagaacaacttcatgctgggatgggttctttgagctaagcagccatcgatcagctgtcagaagttggagctaataataaaagggatgtggagtgggctacatgtatctcggatctctctgcgagccacctaatggtcttgcgtggccctttaatctgtatgtttttgtgtgtaagctactgctagctgtttgcaccttctgcgtccgtggttgtgtttccgtgctacctttttatgttttgatttggatcttgtttgaaaataatcttaccagctttgggt

SEQ ID NO: 5287 - DNA, 1134 bp, Oryza sativa
  misc_feature (54)..(54): n is a, c, g, or t
  misc_feature (121)..(121): n is a, c, g, or t
  Predicted polypeptide sequence is orthologous to G142, G148
tagatcatatctcatcccatcatcggtcatattctcctcagcttcatgttgctnagctataggcgaatggttgacaagagtactagttagcttaataatatagctttgcaaaagttgaggnaatggatcgatcagagatggggaggggaagggttgagctgaagcgcatcgagaacaagatcaaccggcaggtcaccttctccaagcgccgcaacggcctcctcaagaaggcgtacgagctctccgtgctctgcgacgcggaggtggcgctcatcatcttctccagccgtggcaagctgtacgaattcggtagcgccggaataaacaagacattggaaaagtacaatagttgctgttacaacgctcaaggttcaaatagtgctcttgctggtggtgaacatcagagctggtaccaagagatgtcaaggctcaagactaagcttgaatgtctccaacgctctcagaggcacatgcttggtgaagatcttggaccattgagcataaaggaactgcagcagctggagaagcaacttgagtactcactgtcacaggctcgacaacgaaagacacaaatcatgatggagcaggtcgacgatcttcgccggaaggaacgccagcttggagagctcaataagcaactgaaaaacaagctagaagctgaagccgatagcagcaactgcagatcagccatccaggattcctgggtccatggcaccgtcgtcagtggcggcagagtgctgaatgctcaaccaccaccagatattgactgtgagcctactctgcaaattgggtactatcaatttgtccgtcctgaggcggccaatccaagaagcaatggaggaggaggggatcagaacaacaactttgtgatgggatggcccctctgaagtccaagcttgctaataaaaacgctggcgtgctataatatatagttcggcaaatgttgaaacacatgtgttctcagtatgtatatttctcccctatccggtggtactcttagcacgtacctatgagtgtatgtttgtacgttatctatactctatgctaggcaaccctatactattatggtaagacgtctatcttttcaatctatctatacgtaccatactaattggcaaattttgtaaaaaaaaa

SEQ ID NO: 5288 - DNA, 1164 bp, Oryza sativa
  Predicted polypeptide sequence is orthologous to G147
cgaagcaagagatagggataaggggaagaggaggaagaaggaggaggtgtagggagaaaccggagcaacctcgaagctagtccaaactagtgggaggttgtctttccggcaagccggagcccggagctatcgatcatcaagctttctaccccgaccgacgaggaagaagacgactgatcaattgatcaaaccgatctctccatagctaggtagacaggaggagaggaggaagaagagggggagaggagacttatcttgatcgatggcgcgaggcaaggtgcagctccgtcgcatcgagaacccggttcaccgtcaggtcaccttctgcaagcgccgtgccggcctgctgaagaaggccagggagctctccatcctctgcgaggccgacatcggcatcatcatcttctccgcccacggcaagctctacgacctcgccaccaccggaaccatggaggagctgatcgagaggtacaagagtgctagtggcgaacaggccaacgcctgcggcgaccagagaatggacccaaaacaggaggcaatggtgctcaaacaagaaatcaatctactgcagaagggcctgaggtacatctatgggaacagggcaaatgaacacatgactgttgaagagctgaatgccctagagaggtacttagagatatggatgtacaacattcgctccgcaaagatgcagataatgatccaagagatccaagcactaaagagcaaggaaggcatgttgaaagctgctaacgaaattctccaagaaaagatagtagaacagaatggtctgatcgacgtaggcatgatggtagcagatcaacagaatgggcattttagtacagtcccactgttagaagagatcactaacccactgactatactgagtggctattctacttgtaggggctcggagatgggctattccttctaacactaataatggcctgggggatacttgtgttcattactagtgtgtaatatggttaataatgcttgtgttgctgtttgctttgctattctgatgtaccttatttagacaagttcccgcaggaagtgtcttttagtattgtatttgtcttgggctgtggtgctttgtttttccctaaagaactcttgaggagctctgttgttgaaccatttcaagtaattgagactattgtttcc

SEQ ID NO: 5289 - DNA, 881 bp, Oryza sativa
  misc_feature (34)..(34): n is a, c, g, or t
  Predicted polypeptide sequence is orthologous to G147
tggaggcgcattgtgttggtaccgtggaatcggncattatggccggtgggacgagacaaatgtcaatatctccttgcttactagtgccacagctgtagcttcaagtctagtccaggccaaaggttatctgcaggaagagtgaaacaacatggtcagaggaaaggtgcaaatgcgacgaatagagaaccctgtccacagacaggtaaccttctgtaagcgccgtggggggctcctcaagaaggccagggaactatcagtgctttgtgatgctgatgtaggtgttatcatattctcctctcagggaaaactccatgaattagctactaatggaaatatgcataacttggttgaaaggtaccagagcaatgtagcaggtggtcaaatggaaccaggagctctacaaagacagcaggtagcagaacaagggattttcttgttaagggaagaaatagatctactacagaggggtcttaagtctacatatggagggggagcacgggaaatgacactagataaatttgcttgcactagagaaaggtcttgaactatggatttaccaaatacgcaccacaaagatgcagatgattgcaacaagagattccgattctctgaaccacggaacggatactcaacgacgggcactgccagcttccacagaaggggccgacctctccggcccatacagcacacagaaaagacaccccaaagagacaacatagcgacccacggcccacgacaccgcgtcgcgatcatccgtacgagcttgtcaacaaaccgggaaccacaggacccagcaccaagacagtagaatcaccgccaaccacagctataacagagcagaacacagcgacaacaacggaacccagcacatcagcgaacca

SEQ ID NO: 5290 - DNA, 2110 bp, Oryza sativa
  Predicted polypeptide sequence is orthologous to G153, G860
gagctgccggcggaggtgcgaagccatcgaggtgagtggaagcttctggaaccttaccctcctttttcctttctatctcgctgcggttggcttaatttgcctctgcgggcgcgtcgcggttttgcttctagaaccttctagttcttgtggtggtatgaagtttctccgtgagtgtcaaatgtggatccgccattagagatggatttgagttcgctgtgctttgtgacgataggcttgtttcggtggagatttcatggataggtcgacgacgagttcatagaaggaggggctttatatgcattagatgaacggcttccaacagtttccgtagcaagaagcttctatggtttaatctaattctaggagggcggtaggggtgatgtttgtgtgccgaagtcttgctaacctggatcaatggaatgcgcttgttgtgcaatgcagttggaaactgtggagtagcccgtgtgacagtgtgagttaattacttggttgcttatttgaggattaggatacacacaggaggtcatgagatgttgtttggttaaactgaacatttaatttgtagtctattaggctgaaaggaaaataaagaaccattcagcctagttgcaagactagtttttctttgtaacgttggtgaattgtactgtgtttaagccaaactaagttgttaaaggtttagactgacgtccccttatgtgatgtttatctttgttgttgttgtcatattttgaaaattgtgcattcaccatctctaaaatagctcatagggcattaacgagtgatttcaatcgaggtgccttgtttacaactattgctttgcatattctgatcattgcaatgttttcaaccagttattgcatatggtggcaccaagcatgaggttacaactgcattacttgcaagggaatcacaagtcacaagaaacacatgttattacaatggatgtaagatttttttattcccagtttattttcccatgattttgcgacagtgaatagttttattttttttaaataaaatgaacttacatgatcattgatgttgtctttaacaacaactcaccaatgaacaaccatacattgtcatatgtgaactctggttaaagagtatctttttgtaacttaagataaatgggcatctgtcctgcaaatggagatggaaagtttgcatagaagtaacagtgatatgctattctgcttataatcacctttccagatatatgttgtgctgtactagcagtctaatacatactatatgatgtctgttgttaatattcagaaaatgaccctgttttttgccaccataagtttccaacttttcaggctatcatatttcagtatgctgtgatagataagtgaacctctttgtgtgtaaatgtttcatggtctgatggataaacaagataattgtgtacagaacccagcttgcagcatatctgcattaagcagatgtagttttgctgcaagcaaagcatggcttattgctataccattgcctttgtgagtggaatggtatatcttctaaattaaggaaaagatgactttctccttttctggagctatgttggggttggctctgttcaagatcagagggagtatattcctcctctcaagagctcaaaacttttcttgtgaataagtttccatgttaaggactgcatagagccccttttccattgataggtacacccaaggcagcgggcagtctcattatataaaattatgttggtatggtcaaagcgcaccatcagcaggttgaaccttcctacttagttcttcaattccttgtgtcaaaggtggtcctatggcagaagattgattgcttcaatctaaatggaattaaaacaaagttgcagatattaatgaagcacatgctaaggtgaccttcatctgagatgtgactattgacatcacatacgctcattttgagttggttctctaaattccagagatctcttgcatttaggccagcaagctcctgtccatatttatcaataaacacaggacggagttgatttaacattctgagaaaaattgtcacaatttgatttcttatacatgtattctttctcactaacttactaatattatggaagagaagctgcttc

SEQ ID NO: 5291 - DNA, 1406 bp, Oryza sativa
  Predicted polypeptide sequence is orthologous to G154, G627, G1011, G1797, G1798
catttcggggggggtagtttataagggcttgcgcgaggagggggaggagtagcgggtagcggcgggctcgagtcgagtcgagtcgccgtcgtcgtcgggcggcggcggccgagagagatcgggatcgatggtgcgggggaggacggagctgaagcggattgagaacccgacgagccggcaggtgaccttctccaagcgccggaatggcctcctcaagaaggcgttcgagctctccgtcctctgcgacgccgaggtcgccctcatcgtcttctccccccgcggccgcctctacgagttcgccagcgcccccagcctacagaaaaccatcgaccgctataaagcatacacaaaggatcatgtcaacaataagacaattcaacaagatatccagcaagtcaaagatgatactttaggtttggccaagaaacttgaagctcttgatgagtccagacggaaaatattgggagaaaatttagaaggatgctctattgaagaactgcgtggtctagaaatgaaacttgagaagagcctccacaacataagactaaagaagaccgagcttctggagcggcagatagccaagctgaaagagaaggagcggactttgcttaaagacaacgaaaatttacgcggaaagcatcgcaaccttgaggctgcggcgctggtggctaaccacatgacgacgacgacggcgccggcggcgtggccgcgggacgtgcctatgacgagcagcacagccggcgccgccgacgccatggacgtggagactgatctgtacattggattgcccggcactgagcgctcctccaaccggtcggagacaggttgaagaaggccagccacagcaacagctgctatatagcatgcagtagcagcaacgacgccagtgacatcctgttcatctcacaagaataaccagagctctacgcatgcgcacatgaaacccaggcatgcagttctcggtgggtaaattattatctcgcattattagctatatgcgtgtccttgtctttttctttaggcaatggaataaaatttccggtaagtacaaacacaaacggaaacaaagaattaacaaagctgtagcagaccagatcggcaaattgaaatgccaggtaatccagtatatatttcgctaaagttattcatgttggtgtgatgggcctgtgagtgtgggtgcttgggaggagatttcttgggttttttccccgagcaaaatcaatctgctcgtgcccttgagatttcagttccgcccataagaactccgacgcacatttagcattcggagagtaattttgttaggttaaaagtatggtaagttataggtggtatgttatgtttttctttttcttttctcaatgttatctggtacctaagtttgtcaagaaaatcatagtggacaagtc

SEQ ID NO: 5292 - DNA, 257 bp, Oryza sativa
  Predicted polypeptide sequence is orthologous to G154, G627, G1011, G1797, G1798
cttagcttagctagggttcgtggtcgatcggtggaggagttggggaatggagggaggagggaggaggaggaagagggggaaggtggagctgcggcggatagaggaccggacgagccggcaggtgcgattctcgaagcggcggagcgggctgttcaagaaggcgtacgagctgtccgtgctctgcgacgcccaggtcgccctcctcgtcttctcccccgccggccgcctctacgagttcgcctcttccacctccagca

SEQ ID NO: 5293 - DNA, 1117 bp, Oryza sativa
  Predicted polypeptide sequence is orthologous to G154, G627, G1011, G1797, G1798
gggggaccaaaaaggaaagccgaggaggagagggaggggagagaagggagagggggtcggggagaaagaagagcgagcgagcagctttggctacggccaaaccctacagcgcctccaccaccactccttgccttttttggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccagtacgcagaaaacaattgaacgctataggacgtatacaaaggaaaatatcggcaacaagacagtacagcaagatatagagcaagtaaaagctgacgctgatggtttggcaaagaaacttgaagctcttgaaacttacaaaagaaaactgctgggtgaaaagttggatgaatgttctattgaagaactgcatagcctggaggtcaagctggagagaagcctcattagcatcaggggaaggaagacaaagctgcttgaggagcaggttgccaaactgagagagaaggagatgaagctgcgcaaggacaatgaagagttacgcgaaaagtgtaagaatcagcctcccttgtctgctcctttgactgtccgggccgaagatgagaacccggaccgtaacatcaacaccaccaacgacaacatggatgtcgaaactgagctattcatagggctgcctggcagaagtcgctccagcggcggtgctgcagaagatagccaagcgatgccccattcttaagtaacaggccaggaataagctggatctctgcgttgagaaaggagatgatgctaggcatgcaatgacaccaaaccatcctaaaaacagaccacgctgtatattttacttacccgtattgtcgtccatggatgcgaaatgctagacgcatatgcacccacccattcagcaccaccaggcagaaacccttcgatcggcagactccactacccatctaaatctaaatcgagagatctcaagtgcg

SEQ ID NO: 5294 - DNA, 583 bp, Oryza sativa
  Predicted polypeptide sequence is orthologous to G154, G627, G1011, G1797, G1798
ctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgctcaagaaggccttcgagctctccgtcctctgcgacgccgaggtcgcgctcatcgtcttctccccgcgcggcaagctctacgaattcgccagcgccaggaaaattcggcctgaaaagacggcaaaaactatatttccccgtgtggcgattgattgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaaaaaaa

SEQ ID NO: 5295 - DNA, 437 bp, Oryza sativa
  Predicted polypeptide sequence is orthologous to G154, G627, G1011, G1797, G1798
gaggtttgggatgctttcctttgcgaggaaaatcagccagcagcgacatagatcgatctgttcccggccggcgagccggagtagatctctcgcataccctgcacgcacgtactgcttatggcggcggcgggagggcagcagaggcggcgcggcgggcggcgagagatgcggcggatcgaggacacgacgaggcggcaggtgacgttctcgaagcggcggaaggggcttctgaagaaggcgtcggagctgtcggtgctgtgcgacgcggaggtggcgctgctcgtcttctccccgcgcggccgcttcttccacttcgcctccgctccctccctggaggggacaatcgaccgctacattagccacacccaagaggcgcctgcaaacaagaagccccgtgaacttactaatatgaaatctcaatccgaaaccttagcaat

SEQ ID NO: 5296 - DNA, 561 bp, Oryza sativa
  Predicted polypeptide sequence is orthologous to G156
atggggcgtgggagagtagagctcaaaaagattgaaaatccgacaaaccgccaagttaccttctccaagaggaggatggggctgctcaagaaagcaaatgagctggccattctttgtgatgcacaaattggggtgattgtgttctcaggcactggcaagatgtacgagtactccagccccccttggaggattgcaaatatctttgatagatacctgaaagcccccagcacccgttttgaggagatggatgttcagcagagaatcatccaagagatgacaagaatgaaggatgagaacaacaggcttaggatcatcatgaggcagtatatgggtgatgacttggcttcactgactctgcaagatgtgagtaatcttgagcagcagattgagttttctctgtacaaagttcgtctaaggaagcaacagctacttgatcagcagctgcttgagatgcacagccgggtatgtaacaagaggatataccggttcagtattcttccctaccttatacactatattgaaataatcaagttttgattgccctctttccatcccaatagg

SEQ ID NO: 5297 - DNA, 729 bp, Oryza sativa
  Predicted polypeptide sequence is orthologous to G156
atggggcgagggaagatcgagatgaagaggatcgaggacgcgacgaggcggcaggtgacgttcagcaagcgcagggctgggtttctcaagaaggcgaacgagctcgccgtgctgtgcgatgcgcaggtcggcgtcgtcgtcttctccgacaagggcaagctcttcgacttctgcagcccgccggtcatcttgatggagctgtttcaccgttatgagatcaccaccagaaacactcggcttcaggagacaaaccgtgatgatgagcaaatggtcatggagatcacaaggctaaggaatgagatcgaccagctcgaagccagtttaaggaggcaaactggagaagacctgtcatctgtgtccacagtggatgagctcagccagctgcagctgcagcttgaatcatctctcagcaaagttcatgcgaggaaggatgagctcatgagccagcagctggaggatatgcgtcgcatgcatcagaccgtgcatgagcagaacaatttcttgtgccgcatggtaactaaaatactcctactaaatgtgatcacaataatgatacttgctgccatgatttctatcactcatgcacgcattgcccttgatgattgtatgcagttgggatatattgtcatcaagcaagaaaattcttggcgattctggtttatatgacttcctggaagcagtaggaacaacaagagttactgaaccagaaattgaacttgccttcttcat

SEQ ID NO: 5298 - DNA, 1325 bp, Oryza sativa
  Predicted polypeptide sequence is orthologous to G156
agcctttgaagcaagcttagcacttcacaagtttcctcttgtgcagaagaaggagaaacaaaagaacacagaaattaaattaaactcgatcaggaaggtatagcaggcatggggcgcggcaagatcgagatcaagaggatcgagaacgcgacgaacaggcaggtgacattctcgaagaggcggggagggctactgaagaaggcgaacgagctcgccgtgctctgcgacgcccgcgtcggcgtcgtcatcttctccagcaccggcaagatgttcgagtactgcagccctacctgcagtttgagggaactcatcgagcattaccagaccgtcaccaacactcatttcgaggagatcaaccacgatcagcaaatatttgtggagatgactcggatgaggaacgagatggagaagctggacggtggcatcaggaggttcaccggcgacgacctctccaacctcacgctcgccgacatcaacgatctcgagcagcagctcgaattctccgtcaccaaagtccgtgcgagaaagcatcagctcctgaaccagcagctggacaaccttcgtcgcaaggagcacatcctggaagaccagaacagcttcctgtgccgcatgatcaacgagaaccatcatcaggcggcggtgggcggcggcgacgtgaaggcgatggtggagatggcgccggtgctgtcgatgctgacggcggcgccggcgtactacggcgaggagtcgtcgagcaccgcgctgcagctcaccccgccgctgcacgccgtcgacgccgccgccgccgccgggttccggctgcagccgacgcagcccaacctgcaggaccccggctgcagcagcagcagcttccatgccgccgccgccggccacggcctgcagctgtggtaagaacaaacgaagcaaagcatacatggcacatcctgatactctcatcagagatctagatgattgcttgctaattaagcacatgatggcattgtcgattctgggagctaggagtaacttggagaccatgaagatgcatgatcagctgatgatagacgatcgagttgggttgctgtgttgttcaattgttcatcgttctggacatatatatatatatatatgtgtgtgtgtgtgtgtgtgtgtgtgtgtgtgtgtgtgtgtgtgtctaattagcacatcagaataatcaagcttttctacctagttaactagtacagctgctaagtaccttttgatttgttggtgtgtgaactactgaactggagttggatattaaggtctccatgcatttgcatggttaattagcagagagatcattgaggtttttaggatgtaac

SEQ ID NO: 5299 - DNA, 2287 bp, Oryza sativa
  Predicted polypeptide sequence is orthologous to G162
ccacccaaaccctctcgtgtcgcgcggctcgcctgcccccgctccgccgaccacgggcgcaccatggcgctgccgccaccgacgccggaggtcatggacgacctcaccgcctcgctcgcgccggagctcctctccgagatcctcctccgcctcccgccggacgagcccgagcaactcttccgcgctgccctagtctgcaaggaatggctccgcgccatctgcgaccccggcttcctccgccgctaccgcgccttccaccgatcccctcccctgctcggcctcctttacgccgccaagttctacagggagcccccgccccccacctcgcccgcaccaccgcagtgcccctctcgcccgatcccacctttcgccgggccctcgattgccgccatggccgtgccctcctccacgcttcggacgatgattggtatctcattgtctgggaccccgtcaccggcgaacagcaccgcgtgccagagcccggcatcccgtggctgatctactccagcgctgtgttctgtgccgtgagcggctgtgaccacctcgactgccacggcggtcccttccgagtggtctttgtggccaccgatgacggggcggatccaacacctacacccacaaaactcatggataccccggagcacccccttcgattttttcactatgaatgaactaaaagtccctaaatggctggaggttgaaaaaactgtgtaattgagcctccctaattttttgtttctgatccacccgtgatgagtacaaagatctcgttaaggcgagcatgtactcatcggagaccggggcgtggagcaccccggtagttcttgatgatggtcttgattcctgggaacagcgatggcgagatgcacagagtagaggtgaattctaccgcgtaccttatgtcatgcctaggcgagttgcccttgtcggagatgaaatctacttcacacttcgggaggataatgccatcatcaagtacaactggggcatgcactgcttatctgaaattgactcgccgtcgccagacgtgtatggcattgccctcatggagatggagaacggttcactgggttttgcctgcattgaggattccagcctttatgtgtggtcacggaaggtgaattcagaaggggcagcagaatgggtacaatgcagggtgatcaagctggacaaaatgatacctgttgccaatctcagtgatgaagcatttgtggttggctctggggagggtatgggtgccatattcgtgagcacaggtgttggcttgttcacgatcgagctcaagtcaaggagggtgaagaaggttgcagagcctgaggtctactttagcatcttaccctacatgagcttctacactcctgatcgtggcacattgttatcgctagcaaggactcactgatctttgatgtcatgctcaagagtaacttgttgcaaaatggacaaatccattgtcttgactcttgaatctgctgccactgacttcttccagaactactactactactaagctgtttattttttgttgggcagtacaagtacgaacaatgccaagtctgatgttcaaatgtggttgttgtgtcaaattcatcctaccgaccatgaactagatcagcaagtcgtgctaagctgaatagctggctccctattctttattgttcgttttgagagcatggtttgcgctttggccttacaggaatgggccaactatcggaataagcatcaacacgctgatgaggccatgaaggctcaggtgatagtgaagggtaagcagccatgagaaggggaaaagttaagatcaagcccattgcaaatagaaaggctcgtgatgtatgcttctccaagcgccgccaggttgtaatcaagaaggctaacgaactcagcatattatgtggtgtcaatgttgctgttgctgtgctctcacctgctggtaagccctttttctttggctgccctactgttcaagctgtcactcgtcgcttacttggtgtgggtcctagtaaccctaccatgggtgatgggggcaatggtgatgagactgacatagtgcatgagctcaatctgaagtaccagaagttgcaacaagagaatgaagtggagaagaagaaaaaccagcgtggtcaggatgtgaggctagctagtgatgtaaatgcattggggctgcatgagttggaggcattcgacagtaacctcaatgtaatagatgacattgtcgattcaaatgatgtggttaagaatgccaagcaaacagctgagccccagactcagatgagcgtggcatcaaccttgc

SEQ ID NO: 5300 - DNA, 746 bp, Oryza sativa
  Predicted polypeptide sequence is orthologous to G175, G877
gctatgctgggttctctcttgctaaggccctgtttggaaggcatgaattttagtttcacatgaaacggctcgatttccacaggaatatgagcatattcccgcataccaaacgagcccctaagccctaactaaaccaatgcaagaaccaacctacagagccaatacacgctgctcagcggcgcttggaagcagcacacccgaattggactgaagaatagaacaatttacccagctaaacactaccaaaatttcatgctatccactctcttcttttaactgtaaggaagaaactgaagatgcattccgcaaaccatctctgcgcgacgaccgttgcgccctgtccttgtgaggtaaattgctggaagaccatacgctggcattaccggaagaatggctactgttcctggctgctggcacgtcatggctgtgcttgccttcatatgtagatatcacagcctttgggtcttgtgaggatctctcaatatgcttcttcacatcacatccttggtacgtgcatttgtagtaactccttgggtgaggagtcccttttactactttttgaccatacttgcgccatcggtagccatcagtccaaaagatcaacctcactatttgtttgcacaatgattctttgagctggagctggcacatgtcttttgttcgcatttccatcactagtagctgcacccttaaccttcacttcttcctcaccttgatcattgctatcacttgagcccgatatttgc

SEQ ID NO: 5301 - DNA, 2353 bp, Oryza sativa
  Predicted polypeptide sequence is orthologous to G175, G877
gtccttcgcttcaccacctcgccaaaaccgccttcccttcccttctcttcccttccaacctctcgttgcggtttgcgctagaaaaaaaagagaggagagatttcaagaaaccgtgggggagaaagaagcaggcaagaagtagcagcagcagcgagtgaggctaatctgtttgagcttgggattgtcaccttttcatggacgggaccaacaaccatggagcactgatggacgattggatgcttccctcacccagtccaagaacactcatgtcgagtttcttgaacgaagaattcagctccggtcccttttcagacattttctgtgataatggcagtaacaaacatcaggatggacttgggaagagcaaagctttcatcgattcaagccgggaagaaactgctcagctagcaaaaaagtttgaatcaaacctttttggtgccaaccagaaatcaagctcaaatggctgtctgtcagagaggatggctgcaaggacaggttttggtgtcctgaaaattgatacatctcgtgtcggttattctacaccgattcggtctccggtgacgatcccgcccggtgtgagtccaagggaacttcttgagtcgccggtttttcttccgaacgccattgcacaaccttctcctaccactggcaaactgccatttttgatgcatagtaatgttaaaccatcgatccctaaaaaaactgaagatgaaacacgccatgatcgtgtattcttctttcaacccattttgggatctaagccaccaacttgtccagttgcagagaagggtttcagtgttaatcatcaaaaccagccttcagtgacggataatcaccaggagctcagtcttcagtctagctcaactgcagccaaggatttcacttcagcaactattgttaaacctaagacatctgattccatgttagacaatgatgatcacccttcccctgcaaatgatcaagaagagaatgcaacaaacaaaaatgaagagtattcttcagacctgatcattacccctgctgaggatggatataactggaggaaatatggacagaagcaagttaagaacagtgagcatcccagaagctactacaaatgcactttcacgaattgcgctgtcaagaaggtggagcgttctcaagatggccaaataacagagatagtctacaaaggttctcacaatcaccctttgccgccttccaaccgccgaccaaatgttcctttctcacacttcaatgatctgagagatgatcactctgagaaatttggttccaagtctggtcaggccacagcaacttcatgggagaatgccgcaaatggacacctccaagatgtcggtagtgaagttctgacaaaactgtctgcttctcttacgacaacagaacatgctgaaaaatctgttatggacaaacaagaagctgtggatatctcatcgacgctctccaatgaagaggatgatagggtaacgcatcgtgccccgctttctctgggctttgatgcgaacgatgactatgttgaacacaagagaagaaagatggatgtttatgccgctactagcactagcaccaacgccatcgacataggagctgtggcgtcaagagctatccgggagcctcgcgttgttgttcagaccacaagtgaggttgacatccttgatgatggttaccgttggcgcaagtatgggcagaaagttgtcaaaggaaacccaaatccaaggagctactacaagtgcactcatccgggttgctcggtgcgcaagcatgtggagcgatcatcgcatgatctgaaatccgtcatcacgacgtatgaaggaaagcacaaccatgaagttccagctgccaggaacagtggccacccaagctcaggctcagccgctgcaccacaggctaccaatggtcttcttcaccggagacctgaaccggcacaaggtggtggtggtggtagccttgctcagtttggctatggctcagctggtcacagaccagcagagcagtttggtgcagcagcagctggtttctcctttggaatgctgcctcgtagcattgcaactccggcgccgtctccggcgatcgccgtgccggcgatgcaggggtacccagggcttgtgctgccgagaggtgagatgaaggtgaacttgctgccacagtctgggaatgctggtgcagcagctagccagcagctgatgggcaggttgccaaagcagcatcctcagatgtaaaaatggcaggaacatgagacaaatggtgtttgctgcttatgtatatgaaacatttttggtgcttttgttaggagaatggagtgttattgtagctcaatttactttcgggggaaaaaaaagcagatagttcaggc

SEQ ID NO: 5302 - DNA, 2764 bp, Oryza sativa
  Predicted polypeptide sequence is orthologous to G175, G877
gagtcttctcttcaccttcttctcatcctcttcttctcctcctcggtcaaaccgccttttcttctctcccctatcctccgctccgagggagaaaaaaaaacaaagaaagaaagaaagaaagaaaaagagtactagtagcacccggagagtggaggaaagggagtaggcggagccaaatctcgtttctctttagttgttgttagtacccttagtggaagaatctctccccttttcttgtgtttcttgggttttgaagttttttgttgttgggaggtatgaggaatgaaggcctaacctgaggcaagatcttcgttttccttcatttgtgggggtgtttgttggtggaaacggatcaagaaaagccggaatttcggttctgaaatcgtcggttttgatatcggtttctctctgttgattggagagagagggagagagcaaacgcatgatctgtgtctgattctgacgggccttgtcgcggtccgtatcagttcatccatcccaacttgctgttcgttttgtgtggtggtgtttcgcttttttgggaagagaggagaggaagcaatcattcggcggcgacggccccgcccacttgagttaaacttgattgctctgtcgcatggccagcagtagcgaccatggatccctcatggaggactggatgccaccacccacacccagcccgagaacactcatgtcaagcttcttgaatgaagattttgtctctggttcattttccaatattttcagtgatcatgagagcaacaaaccccaggatcagtttgagagaaacagagagcttgtggatttgagtaaggaagtgccttcccaattcgcaagacccgcattccagagggatgcttccctggatcatagcttggtcagtcctacacagagatcaaactcgcatggtggtttggcagagcgcagggctgcgagggctggtttcagtgtcccgaaaatcgatacatcccgtggtggttcatccacagtaattcgatcgcccgtggcaattccaccaggtcttagtccaacaacacttctcgagtcaccggttttcctttacaacgcaatggcacagccttctccaaccactggcacactgccatttttgatggcttcaaatgctaagtcaacaataccgtcagctaccaagatggacgaagattgcacatttggcaatgacactttctccttccaaccgcatgtagggtcgagacggccaaatttctccgctgcagaaaagggtcccaatgcttgtcaccaaaaccaatcgctgtcgaatatccatcagcgggaatccagtcttcagtcaagctttactgcagtcaaagatatcactgatgaaaaaaacattaaaacaaagacatctgactccatgtttggtgataaccactcttctgatgaacaagatgatgagactaaccaaaatggagaaaactctatgccacctccgaaccaccgttcaggtgtccctctgtcacataccaatgatccagaagtgaatgtcctagagaaccgcggttcacagacatgccataactctgcatccttgtgggacaatgccaaaaatgattgccttcaagatgttcaaagtgaagttattgaaacaagaacagctgcttgtcttccagtatcaaccaattgtgatacatctatcatggagtcccaagatgcagttgatgtgtcgtcaacactatctaatgaggaggatgatagggcaacgcatggcacggcttctatagagtgcaacggggatggagatgagactgattccaagagaaggaagctggatgctttgacagctgcaactgctgctattaccaccaccagtaacattgacatgggagctgcggcatcgagaggtgtccgggagcctcgtgttgttgttcagacaacaagtgaggttgacatccttgatgacggttaccgctggcgcaagtatggacagaaggttgttaaaggaaatccaaacccaaggagctattacaaatgtacgcaccaagggtgttcggtgcgcaagcacgtggagagagcatcgcatgatctaaaatccgtcatcacgacgtacgaggggaagcacaaccatgaagttccagctgccagaaatagtggacatgggagctctggatctggaaacgctccatctgcaccgcaatctaacggctctcagcgcaggcaagaacaagggcaagccagcttcagccagtttggtggcgcggctcccttcagctccttcgttctcccaccaagaaaccaatttggaccatcggcgagcaatttcccctttgggatggtcccgccaggcatggcgattcccatgccatctctagggtctcttgctccagcaaagatggctggtcatccatccaccatgcagggctaccaggggctcatgattccggaaggagagatgaagacagagcccatgtcgcagctcggcttccccgcggtaaaccaatcttcatcatccttccaacagatgatgaacaggcctccatcatttggacctcagatgtaaataataatattaaagaaagaaaagaaaatgatagatgtgcttcagcttctatacatggtagcaatgctacaacatagctttgttgttctagcttttacctgttattttttctttgggcttttattttttggaagcaaagaatgcagaagatgttacccgttttgtttatgttgtaattggaaaaaaaaggtggtggtagtgttcaggacaaaaggcaaaatcattcaattggaagtgctgatggtg

SEQ ID NO: 5303 - DNA, 3152 bp, Oryza sativa
  Predicted polypeptide sequence is orthologous to G175, G877
ctctgctggctccctcctcgatgacgatgacgaccgcgacgctggatccgccgccgcctcccctcctcatcgccggctccctcctcgacgacgatcgcgacgctggatctgccgcctcctcctctcctcgctggctcccccgggcgcgcggatccaccgtcggctcccctcctcgccggggaggggaggagaggggaggggaggcggcgacgaggaggaaaggcaacagctcctgtcctgacgacgacgatgactgccgcaacgacgaggacgactgccgcaacgacgacgactaccgcgacgatgatgtgggggcgacgacggatggaggaggagacgcggcggctcttctcccgatggcgatgatgactgccacgacgatggcgccgatgcctgtcgaggcagcggtggacggaggaggagagctgtcatcggccggagagggtggccagcggcgggtgaatctactgcctacgaagatattgtccgcctacgaaaatcatctattttcgcaggcccttgcttgcagggaagatgaatggatcatcgagaagcttgcggtcatcgctgctagacgctcatcatttgtctctgaagaatccttgtgctctgttccggctgcggctttggtctctttggccattgcccatttggctttctcccccatgttggtctatggcgttcttgatcgtttatgttccgtttgccatctgggtgagatggagggagacatagcgatggaggagtggaaggattccaaccatcgaggcgcggattacctgatgacgatgccgatgcagaacttcctcgccgacgcgttcccgccaccggagctcttggagggagaaggcgggttcgagaagcacggcctgtcggtggccgttggctcgccgccgccgacgccgccgcctccggaggacgggtgctcgccgctgccactgacgccgcagttcggccagaagttcggctccggcggcggcggcggcggcagcctcgccgacaggagggcgagaggcgggttcagcaacgtcgccaggatcagcgtgccgtacaaccagccggcggcggacgtgtcgtcggcgggggcgccgtcgccgtacgtgacgatcccgcccggcctgagcccgacgactctgctggaatcgccggtcttctccaatgccatgggccaggcctcgccgaccactgggaagctgcacatgcttggtggtgccaacgacagcaatccaatcagatttgaatcccctcggatcgaagaaggatctggtgcattttctttcaagcctctgaatctcgcatcctcacactacgcagctgaagaaaagacgaaatctctacccaacaaccagcatcagtcgctaccgatttctgtcaagactgaagctactagcattcaaaccgcacaagatgaagcagcagccaaccaactgatgcagccgcagttcaacggcggcaagcggagccgcgctgcacctgacaacggcggcgacggcgagggccagccggcggagggcgacgcgaaggctgactcctcctccggcgcggccgcggtcgccgtcgtcgccgccgccgcggcggcggtggcggaggacgggtacagctggaggaagtacgggcagaagcaggtgaagcacagcgagtacccgaggagctactacaagtgcacgcacgccagctgcgcggtgaagaagaaggtggagcgctcgcacgagggccacgtcacggagatcatctacaagggcacccacaaccaccccaagccggcggcgagccgccgcccccccgtccatcctccgccgccgtcgccggcgacgacgacgacgacgccgctgccgccaggcgacgcgcaggccgaccacgcgcccgacggcggcggcggcagtaccccagttggcgccggacaggcgggcgcggagtggcacaacggcggcgtggttggcggcgaggggctggtggacgcgacgtcgtctccctccgtccccggcgagctctgcgagtcgacggcgtcgatgcaggtccatgaaggcgcggcggcggcgcagctgggggaatcccccgagggcgtcgacgtcacgtctgcggtgtccgacgaggtggacagggatgacaaggcgacgcacgtgttgcccctggccgccgccgccgccgacggcgagagcgacgagctggagcgaaagagaaggaagctggactcctgcgccaccatggacatgagcacggcgtcgagggcggtgcgcgagccgcgggtggtgatccagacgacgagcgaggtggacatcctcgacgacggctaccgctggcgcaagtacgggcagaaggtcgtcaaggggaaccccaacccaaggagctactacaagtgcacgcacccggggtgcctggtgcggaagcacgtggagcgcgcgtcgcacgacctcaagtcggtgatcaccacgtacgaggggaagcacaaccacgaggtccccgcggcgaggaacagcggccacccggcgggctcggcttcgcccggcggcggcgcggggtcgtcgtcgcagccccacggcgtcggcgtcggcgggcgcaggccggaggtgccgtcggtgcaggagagcctgatgaggctcggcggcggctgcggcgcggcgccgttcccgccccacttcggcctgcacctgccgccgccgccgccgagggacccgctcgcgccgatgagcaacttcccctactcgctcggccacgcgccgtcgccggcgctgcggggcctgccgccgcccccgcccccgccgccgtcggcgtcggcgctggcggtggcggggctcggcggcgtggtggaggggctcaagtacccgatgctggcgccgccgtcggtgcactcgctgctgaggcaccgccagggcggcggcatggaggcggtggtggtccccaaggcggaggtgaagcaggaggcgatgcggcccgccgccgccgtcgccggcgcggggcgcggcgcggcggtgtatcagcaggcgatgagcagggtgtcgctggggaatcaactgtagataaataataaaaaaagaagagcagttttaggaggagcttttatattcatatgcttaggttaattaattaattaattaatgttaccatgataagtataacgatcagttcttgttcttagtgtttgatttttgcaa

SEQ ID NO: 5304 - DNA, 1190 bp, Oryza sativa
  Predicted polypeptide sequence is orthologous to G180
ggtctctgtctctctttcttctagctctctctctctctctctctctctcatggtcatcgcttcccttttaacctaaagaaagagatctttcttggcatctcgatcgtcttcgatctctctctagctagctatacctcaccggcaatccaagctgcatgatctcttgtagagcatactactagtagctagttaattagttgctgcatgtatgcgtgcatggaagggagccagttggagacggcttgcctccctgccgcgctctacgcgccgctctgcccgtacacgccgccttcccctccttcctttcttgcgccattgccgagcctgcagcacaagcttccccagctgccgcagctggtccacgaccacgccgccgccaccgggacgaaccatggcgtgatgttctcgtcggaccatggctgcctgtacccgctgctcccggggatcccgttctgcctcgactccggctgcggcgccgccgcctgcgacgacgacaagcccgccggtttcgcgcacttgggctccgccgaggcggacacatcggcggcggcggcgagagtggatagcgagattgctgcagctgccaccgcaaccacttgccatgggcctaattcatggtggaaggggacggagaaggggaagatgaaggtgaggaggaagatgagggagccgaggttctgcttccagaccaggagcgatgtggatgtgctggacgacggctacaagtggaggaagtatggccagaaggttgtcaagaacagcctccacccaaggagctactacaggtgcacccacaacaactgccgcgtgaagaagcgggtggagcggctgtcggaggattgccgcatggtgatcaccacctacgagggccgccacacccacaccccctgcagcgacgacgccaccaccggcgccgccggcgaccacaccgccagctgcgccttcacctccttctgacgaacgcatgcttatgtacatggatcggtgatggattattgttctctgatctgatggtggcaattgggaaatcgaagaagcagggatcgatgtaaaatgaaaatgtactaggaaagcttttagaactcttatggatgctatttaatttcctggtcaatcagctagccgatcgatcaacacgttgcatgatattcagtctaattatgaatgaaaatgtagtaggaagcttaatt

SEQ ID NO: 5305 - DNA, 3435 bp, Oryza sativa
  Predicted polypeptide sequence is orthologous to G180
gaaggaggtggccaactggggacttgtcttccgaatttctatcttttgccagatcaccacggcatgcctcttcctcctccacttcaactaccgtgccatccgaagctactccagatgccattcgaccaagaagatcagcccggaatccatggcgtgatgctctcttctgaccactgcgggctgtaccctctgccggcgcttccgttaagcaactccgccgccgccgccgccgcaaccgtcgcattggggaagcacagtgcagccgccggttccatgcccaatattggcggcgctgaggaggtggccaccactgtaaccaaagctggcaatgagagtactacttgcaatggctccactacatggtggaggggctcgacgatggcggcgatgggggagaaggggaagatgaagatcaggaggaagatgagggagccgaggttctgcttccagaccagaagcgaagtggatgtgctggatgacgggtacaagtggaggaagtacggacagaaggttgtcaagaacagtctccatcccaggtacatatgctcaacttaaccaaaaccctacatatttgatttcttatatcatttatacatatgtgtagataatagattccccgtttcttatcaattaactaattataaacataaacagaagaatgtctcgatgcctatttaatttggttaattagtaatacgcaagtttatatataccagataaaatatcaattttatatgtacagaactgagccatgttgatcttgttttttctcctaaagggcttcttcagaacatggaaaatttgtaggattttcacaggaaacatttcaatttctcccaaattctcgtgaaattcctcccaacccaatataccaagggtactctctatggcagaagagaattaatgcatgcctggttaaactaacttgtcaacaaaggtcttgatatgaatagattagaagctgatttaagacaaggcaaaatatctacaaatataattatatatatgcaggctagattattacttttcctttttatatcaatatagttaaaagcgattttacagtacttaagagatgttaggaggtgccaccgtttttaatgtaaattctggtacctctgtaattagtatttaaggtactaccaagtctttacaatagaaaatatggtatctcttaacaagggaaatgtaaaattcctcatttaatttggtatgtgcttatctattagctctgtacttatgatatatatgtttattttgcttctacctacaatcgaaataaacgcagctactcctataacatattgctgtccaattatatgatccatatgtcaaaagtgttcgccagtatatggaaaagtttcacacacttgtcatcagatgacccttgcaaataatcttaattatgtactagttaattaaggtccaagaattaatgggtattttaattaaatgggggttcactttgttataacaatgaaaataatctattgagctgaatctgacaggctcaccttctgcacagttttattaaaaaaatatttttaatgcaaattgttacattttggtgaacaagcttaattagttactagttacatttcggtgacaagtttaacaaactcatcatacataactagccgtatcagttctttaatttatgataggtactgtcatccctgatgcagataaagggacgggtcataaatagattaaggatcgagttcttaccacaaatattctgaatatgcatgtatgagaaggagtcttggggtaattaattaaggtataacggatcctaatatgggcaccatgaaagagaggaccctaaatttgccaaactaaggacgatgcatgccattctacacactcatacaacacaagtagtgtaagccttagctatttcatgcgataaaataaacggcaattagcagccaattaacataggcacaaaaggtacattaataagaaagatgcttcagttcccaattcatacatccgtttgtgagaagctgtgttaggagtatactgcactgtatctggcatcttatatatctatgtataatgttcatataatgatactatttctttatctcattaaaccatatcacctcaattgtctttgacacttagatgattaatttatggtccaaattatttttatcattttctttctcatacgaagttatatcaccttagttttgtctttagatgattaatctatattatttctccttttttttattttgtcgttgaggcatatcaccttagttttactttttaatgatcaatttatatatgatttaaattattaaaaatcacgccatctaaactatttttaacttttttcatggtcgatcaaagatgaaaattatataaaattacgtcatccgtcatctagctatttttacatgttatttgttctattattatacagaacttccgctgcgatgcgcgggcccaatctaactcccatctccttgcagaactcgatcgataaaaattaattaatgttgtcaattagctaattacgtcgcatgcgggagtcatcgcacggccaaatatctaaaaaaacatgtaatagtcctttcatttcagtaaataaacacatctatatttttttaatctatatattagattgagaaatggaaattggttagtcagtactccctccgtcccctagtataagggatagactagtactccatccgtttcataatgtaagtcattctagcattttctacatttatattgatgttaatgaatctagacatatatatctatctagattcattaacatcaatatgaatgtgggaaatattagaatgacttacatggtgaaacggaggaagtatataggaggacaccatgaatataactctctggttttgcggagcttctgatctgttggagatcagaactacaaacaggcatttttgtgtgatttggatgtacacatgccaaaactgatcgacgatatatatatgaatgcgcatatgcatgcatgcaggagctacttcaggtgcacgcacagcaactgccgcgtgaagaagcgggtggagcggctgtcgacggactgccgcatggtgatcaccacctacgagggccgccacacgcactccccctgcgacgacaactcctccggcgagcacaccaactgcttcagctccttctgaagattttagcactttgcattttcgtcgttgatccatccatcaatatatataccgtcgtatacctatatgtccaccgtttgatcgattaactgtggctagctctagctctctttcattttgatggttgagatatataggcgacgtaatatcgagccatgcctgcgcaatgtaccagtactgctagctatacgtgagatgtattgcgtgcatgcacgtacaatttacaagcagcagtcaataaattaagctatgtatttcttct

SEQ ID NO: 5306 - DNA, 1124 bp, Oryza sativa
  Predicted polypeptide sequence is orthologous to G181
aacctgcgccgatcgagatatggagaacctccagctccagggagatgatcacgacgacgaagcgctccctcacttcccctacttcgcggtgccgtcaccgccgccgctcgccgtcgcgccggcggcatcggcgacgacgtcggatggtcaccagcacggcccactcgaggtgctcgagcagccgccgtgtagtaataacctgcatcccgatggcctggtcgatggccctcagctagcggcgacgacggcggtgccgatgatgctgccggcgatgacgtccttggactggcagtcgctcctgcagacgtgcctgcaggtaccgcctccggtgctggagcagcagcaaccggcggcggcggcgcaggcggatcagtacagcggggagaacgatcacggcgatctgcaggcggccgagagcagcggggcaggtaacaaggagaagcaggtgatggcgaagggcggggcggggaggccgtcggggacgaagaagaaggcgagccggccgcggttcgcgttccagacgaggagcgacaacgacatcctggacgacggctaccgatggaggaagtacgggcagaaggccgtcaagaacagcaagcaccccaggagctactaccggtgcacgcaccacacgtgcaacgtgaagaagcaagtgcagcggctcgccaaggacacgagcatcgtggtgactacgtacgagggcgtgcacaaccacccctgcgagaagctcatggaggccctcacccccatcctcaagcagctccagttcctctcccagttctaattaacgacccatatcgatcggtctcggtcggtctcaaactctgaaatgatcgatctttcaagttgctacacaaacacaataacacacattcacgtgtacatatatacctgcaacaaattaaactctctgtttagcttggggggaagaaaaggagaacaatgtggcctacctcccccgtctcccgtcaatacagtacaatatactgctagttgatcatgtatgtcgtcatactgtatatacgtactccctgtacgtgtatccttgtatattttcatatgtacgctaagcttacgcatatattgtatatgtgacacaaataatgcccccggaaagttaaaat

SEQ ID NO: 5307 - DNA, 1606 bp, Oryza sativa
  Predicted polypeptide sequence is orthologous to G184, G186, G916
agtcttctcttctctatcttctccgcctccgggaagaaggacaagaggagtaggagctccagttgcatggacaagggccacctcggtggtggcggaggaggaggaggtgggctgctcgctctggacgcgtcgccgcgcccgctcggcttcttgaacctgctctccccgccgccgttccacaggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaaccttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaaaaacgagttcggatcagtaattttcacatagatttccaagtttttactcttctttgttcaggataggttcttgatttctctcctttggtttcgatagctcggccgagctgtgcagtgggcacatggtatacactttcttttttcttctccactttcctggttttgcagcagcaaaaagttgtattaattcattgctttttcttagttctttttctaccgcaaaaacagctgttgatacttcgcagtaagtaataatcagtacaataataagtataataatagcatcttcctgagaatt

SEQ ID NO: 5308 - DNA, 373 bp, Oryza sativa
  Predicted polypeptide sequence is orthologous to G184, G186, G916
ggactgaaggagtagaaactgccgtgccggaaaccgagggtgtccgtgcgtgcgcgatccgaagcaccaatgattagtgatgggtgccaatggaggaagtacgggcagaaaatggcaaaggggaatccatgcccgcgagcgtactaccgatgcacaatggctatcggatgcccagtcaggaagcaggtaactaaattaatatatatgcattctcataatatgcgttttcttgtgtagctttaattagcatggcgctatatataaaaaccagctgaaattggaattcatatattttttaaaaaaaaaaaaaaaaaaaaaaaaaaaaaaaaaaaaaaaaaaaaaaaaaaaaaaaaaaaaaaaaaaaaaaaaaacc

SEQ ID NO: 5309 - DNA, 1908 bp, Oryza sativa
  Predicted polypeptide sequence is orthologous to G184, G186, G916
atgctgacctcaatatttcttccctattgcacacctgcatcggcgctcgtaccgccggagatcgaatccgagataaccgtagtagtggcgatcgatcgacacgtcgagcggcggagtggacgtgtacggtgcaccgtccatctgcccgtgcaaatgtacacaaaacctctttcatcaagctacgtggtgtgggcgagtgacagcgcaacggtggatggatggatgatggatgttgaaaaccggtcgaccatggaggccgacgacagcggcggtggcggcggcagggcacgcaggtccgtcgaggtggacttcttctccgacgagaagaagaacatgaagaagagccgtgtctcgggcggcgtcgccgccgaggcggacgacgccaagggacccgccgccgccggcctcgccatcaagaaggaggacctcaccattaaccttcttcccgccgggaacaacgcgaggagcgaccggtcgatggtggtcgacgacgacgcggcgtcgcggccggatcacgaggagaagagccggagcagcaacgagctcgcggcgatgcaggcggagctgggccgcatgaacgaggagaaccagcggctccgggggatgctgacccaggtgaccaccagctaccaggcgctgcagatgcatctcgtcgcgctcatgcagcaaaggcctcaaatgatgcagcctccgacccagccggagccacctccgcctcaccaggatggcaaggccgagggcgcggtcgtgccgaggcaattcctcgatctgggcccgtcctccggcgccggcggcgaggcggcggaggagccgtccaactcgtcgacggaggccggcagcccgcgtcggtcgtcgtctaccggcaacaaggaccaagaacgtggtgacagcccggacgcgccgtcgacggcggcggcgtggttgccgggacgcgccatggcgccgcagatgggcgccgccggcgcggcgggcaagagccatgatcagcaagcccaggatgccaacatgaggaaggcccgcgtctccgttcgcgcgcgatccgaagcgccaatcatcgccgatgggtgccaatggaggaagtacggtcagaagatggcgaagggaaacccttgtccacgcgcgtactaccgctgcaccatggccaccggctgcccggtgcggaagcaggtgcaacggtgcgcggaggaccggtccatcctgatcaccacgtacgagggcacgcacaaccacccgctgccgccggccgcgatggcgatggcgtccaccacgtcggcggcggcgtcgatgcttctgtcggggtccatgccgagcgccgacggcgccgcggggctcatgagctccaacttcctggcgcgcaccgtgctgccgtgctcgtccagcatggccaccatctcggcgtcggccccgttcccgacggtcacgctcgacctcacccacgcgccgccgggcgcgccgaacgccgtgccgctcaacgccgcgcggccgggcgcgccggcgccgcagttccaggtgccgctgccaggcggagggatggcgccggcgttcgccgtgccgccgcaggtgctgtacaaccagtccaagttctccggcctgcagatgtcctccgattcagccgaggccgccgccgccgccgccgccgccgcgcagttcgcgcaaccgaggccgccgatcgggcagctgcctggccctctctccgacaccgtcagcgcggcggcggcggcgatcaccgctgaccccaacttcacggtggcgctcgcggcggcgatcacgtccatcataggcggccagcacgcggcggcagctggcaacagcaacgcgaacaacaccaacaccaacaccacgagcaacaccaacaacacaagcagcaacaacacgacgagcaacaacaccaacagcgagacgcagtaa

SEQ ID NO: 5310 - DNA, 1785 bp, Oryza sativa
  Predicted polypeptide sequence is orthologous to G184, G186, G916
atggagctcaggccgccgccgcccaagcaccaccaccaccgccgccgtcgcggcggcggcggcgaagacggcggggaggaggaggaggaggagactggccgcctgtcgctgcgcggcggcggcttctggcggcgccacgacggggaggaggaggaggagaagggcggcgggaggaggggcgagatcaaggaggtggacttcttcttgggcgccagcggccgcgatgtcgtcgtggcctcccggcggcacgacgacggcttccgcgggacgacgcatggcggcggcggtggcggcgacgtcaacatcgggctagacttgctgaccaccaccaccgccggcgcggcggcgggtggtgcggcggccggcgccggcgaggaggacacggggaagaatcatagaaaggaggcgacgacggcggcggtggatgtggagctccggcgagtggtggaggagaaccggcggctgcgggggatgctggacgagctcaaccggagctacagcgcgttgtaccatcagtatctgcaggtcacgcagcagcaaaaccatcgccatcctgatcatcacctgattatgaacaacaacaacaaccggccttcactagctcaaacacaccggaccgcggcgacgacgacggcgacgacgcagcaattcctggagccgcgagcgtcgtccacggcgcaggccaccgccgacgcggacatggcagcgtccgacgacgaggccggccgcggcggcggcgacggcgacgcgtcgtccccttcgctgagcaacgccgccggcggcggcggcggcggcaacaagatgaggagggttggtggtcaagacgagactgcggcggcggcgccggcgagggagaacggcgagcagcaggcggcggcggcggccgagctgccgtgccggaaaccgagggtgtccattagtgatgggtgccaatggaggaagtacgggcagaaaatggcaaaggggaatccatgcccgcgagcgtactaccgatgcacaatggctatcggatgcccagtcaggaagcaggtgcaacggtgcgccgaggacaagaccgtgctgatcaccacctacgagggcaaccacaaccaccagctgccgccggcggccaccaccatggccaacaccacctccgccgccgcggccatgctcctctccggcccggctgccagccgcgacggcgccgccgccgccctgctcggccaccaccaccaccaccacccggcggcgatgttccaccagtccttcccctacgcctccaccatggccacgctctccgcctccgcgccgttccccaccatcaccctcgacctcacgcagacgcctgccggaggcgccggcgccgccagcctgctgcacgcgctccaccgcccgccggtcatccaccctggtgcggctgcccaggcgatgccgttcgccgtgccgccgcagctggcgatgtacctcccgcagcagagggcggcggccgcggggctgggcggcgccggcgccgccaggcagccgtcggtgatggagacggtgaccgccgcgctcgccgccgacccaaacttcacgacggcgttggcggccgccatctcgtccgtcgtggcgggaggggctcatcatcaggctctgtccaccacaccccgtggcagcgccgccggcgccggagacggcaacggaaacgggagctccgccgcggccgtcgccaccggcgccgcctcgccggcggcgacggccgaggcacctgcggcgtccggatcacctcctcggctcgcgacgcagtcctgcaccacgtcgaattga

SEQ ID NO: 5311 - DNA, 1521 bp, Oryza sativa
  Predicted polypeptide sequence is orthologous to G185
acttcactgcacggcgtcgcggttttcccaagctgagagttgtcgtgcgagagtgaggagcatggcgatgctggggagctcgtcggcggtggtgctggagctgatgacgatggggtaccagtcggcggcgtacctcggcgagctgctccgggcggcgtccccggcgcaggcaggggatgagcagcaggagctcgccgcggagatcctccgctgctgcgaccgcgtcatcgccgagctgaaccggggaggagccactggtgctactaccggcaagaagcggaaggcggcggagtccgccgccgccgccgccgtgacctccccttctctccccgtcacgccgaccaaaagaagggcgcgtggcgcggaggcggtgagggaggtgaggagcggcacgacgacggacgggttcatctggaggaagtacgggcagaaggagatcaatggctgcaagcacccgaggctctactaccgctgcgcgttcaggggccagggctgcctcgccacgcggcgggtgcagcagtcgcagtcgcaggacgacccggccgcggcgttcgtgatcgcctactacggcgagcacacctgcggaggcgacgccgccgccgccgccgcgtgccgggacggggaactaatgccacctgccgtcatcaactccggcgcgtcgagcttcgccgccgcttggaacatggcctcgcgtgagccggcgtcgtcgctcgccgtcgagcggaggagctgcgacggcgacgctcccagcgagacgtcgcaggggtggtctccctccttctcgtcggaggtggagctggacgtggtgggattcgacctcgccggagccgactcgtcggcgtcgccggtgtgggagttcttgaatggcagcttcgactgggaattcgtcatcaactccctctgaattttcgatgcttcgtgatcagtagcacaccagctgccccaagagtgcagtagtctttgcaaaacgcacaaaatttcgcgggaactatcgaatttcccgcgtttgcgcttaagttaatagcctcagtagttcgtcagataatcgcacgcactattttaattcaggaagggatttagattgacaaagtatattaggtgagagttaatatgggagaattcgtaatgaagagttgaatgtgttgacgttgacgtacaggggaaaaacacatgctaagaagaaaaatggcaggtgaaaggggcaagaaatggcaaagctgagcaacagagcaggtaataatagagaattgctactcctactacttgcaagcatatatgtccagaagagcagccaaagagaacacaagaccgtcagcttgacgcataactgacgcacttctgatggtaacaaaaaaccggccaccatgtcccatgtgaacgaatggattcattagttgtaataatggtaatagtagtgacactcaattgcaatatcatgcttggtacagggttaaggatcagatggttagtttaaccaccaatagcaacaagctgaaacgaatactggttttgctggatttc

SEQ ID NO: 5312 - DNA, 1492 bp, Oryza sativa
  Predicted polypeptide sequence is orthologous to G187
acataagctagctccccatactctcacaccccatgtcttctggaggaggaggaggaggaggaggagatcgccatggcccctaccaccagcacgggcacctcggccgcggcgaaggcgctgattacgtgtacagcagcagcgacatggagagcttcttcttcagccaacccgggggcgtcggcatcggcgggggtggtggtggcgtcgtcggcgccggcggtgccgacgagatcatgccgtactccagcatcacggactacctgcaggggttattggacccctccgggctagctcggcacctcgacgtggcgtgcccgtcgtctcaggacacggtggtcaagcaggagctgtcggtggatgtgacgagccacgacagccagggcaccggcggcgtcgccggagaaggcgtcgcgcaggccacgccgaactcgtcggcgtccttctcgtccagcgacggagaggcggagggcggcaaatcgtcacgccggtgcaagaagggtcaggcgaaggcggaggaggaggacgacaaggatgaggaggatggagagaactccaagaaaccgaacaagcccaagaagaaagctgagaagaggcagcggcagcctcgcgtggcgttcctcaccaagagcgaggttgatcacctcgaggacggctaccggtggcgcaagtacggccagaaggcagtcaagaacagcccatacccgaggagctactaccggtgcacgacgcccaagtgcggtgtgaagaagcgggtggagcggtcgtaccaggacccctccacggtgatcaccacgtacgaagggcagcacacgcaccacagcccggcgagcctccgcggcggcggcggcggcgtcggcatcgtcggagggcaccaccaccaccacctcttcatgcccggcgtgcatggcctgccgccgtcgcacctcatgccggcggggttccaccctgagctgatgggcctcatgcaccaccacccggccatggccgccgccgccgcaaaccctagcatgtacttcccgggcgtagctgcttctgctccgccgcctcctgctgtggctggcggcggtgcaatgccgcccaacgatcatcctcctcttcagcagcatcacttcactgactacgccctgctgcaagaccttttcccttccacaatgcccagcagcaacccatgatgatgactgatctaactgattctgcacaaatatatactactcaatatttaactagcacccggaatttatcaagatgcttttcaaacattggagtcgttgcgccaaaaatgtgatggctagggagtgcttgatgatcagcttggtcttgagatggaagctacaactttataactagaacggctgcattccacttgattcttcagcatagccctttactgttctgcacctctagacttattgtacatgcatgtactagtgtatatcatgtgtacctcattgactcattttcggagagagcaaattaattaatatttcgtctc

SEQ ID NO: 5313 - DNA, 1064 bp, Oryza sativa
  Predicted polypeptide sequence is orthologous to G187
caactatacaagatcttcagcagctggctccctccatttaggttgcaactgacatgcaactacctgagttctacgtacggtgaccaccttctcccatggcatcaaattcacagactaccacaacaggggccggaggagggagaggccaaggcgacgacgaggagccgacgccgacgccgccacctgcgccgccgccggagacagcgccatccactgtcggcggcggcggcgacggcgttcagctagtgatgcccgaggacgggtacgagtggaagaagtacgggcagaagttcatcaaaaacatccagaaaaacaggagctacttccggtgccgggaccagcggtgcggcgccaagaagaaggtggagtggcacccgcacgaccccggcctcaacctccgcgtcgtctacgacggcgcccaccaccacggctccccctcgtcggccgccggcgaaggaggcacctccgctgccgccgccgccaaccagtacgacctcagcacgcagtacttcggcggcgccggcgggccccgctcgcagtgagcaacggtggctggccaagaacggctaattctctcttcttccatgtacgtactacgtcttgatcagcgtctctctcgccggagtaactagcagggcgcgagcggggggtggggcccacggcggcgaccggcggggcgacgccggccggccgccatcgatcagatgcctacgtgctttgcaacttgcaagtggcgggtgccggttgaaggcttgcgccggtagctgtgtgcaatcgtgacgttgaccggcaattatagagggtcaacgctgttggacgccagccagccgtgcgtgcatgacgattattagtagagttaattaattaagcacctgacgctggcagctagctgtcacgtactagtactactggtagattagctagactgaatattagtagtaactagtgctattgttttctttagataatggattaattagtggttaattactagtactactacacatttcaacacatatgtactggtagtagttattatatggagtaacattggtagctctctt

SEQ ID NO: 5314 - DNA, 1715 bp, Oryza sativa
  Predicted polypeptide sequence is orthologous to G188
agatgcaaagtctctctcaagcttgcctaggaaatataaaaagagagagaaaaaaaagggttgttttgatcagccaagaactggaaggatttgatgctctcctactgctaccattgctaaacaactaatttttagtatgctgctgctgatggtgatgatgacgatgattaatggcggattaattggatgctctaatctcttcctccctcttcctttccctttcctttttcttgcgagctgatgagctaaaaaaagctaagaacggcgcggcgatctgtgcgagctagctgccggcggcggtgggctccgtccatggcgagggcaagaagggctcgtcggcgatgtcctccacgagcagctcttcctcctcctcctcctcctcgtcctcctccatggacggcgtccgcagcggtgtggtcggggagagccccgccgcctcggctccaccacccccggcgccgaccaccaccaccgacggcggcggcggctggggctgcgcggaggcggcggaggcggcggaggaggaagggagcttgttgcgggtggtgccggcgagcgagttgcggtgggtgggcgccgagtggttgtgctcgccggtgtaggtgaggatgaaggtgttggggtcggagcggctcctctccacctgcttcctcgccgggcaccccttcgagctactgcaccggtagtaccccctgttgcaacaaaaccatagctccggaaggagatgaggagttcagctgctgccatttctggcgaggtgaaaaagagaagctcgctcacctcctcttggatctaggcacgccgccagctggcacctgcctcgccgccgccggctgcgacgccctcgccggagccgtcgtcggagccggtagattctcctgcaccgtcaccggtttctgctgctctggctgcggctgcgtcggaggaggaggaggaggcgtcggcagaggcgacgacttcgacgaggaagaagaaggaaaggcggcgcagaacgccttgaggagctcgtcggcgtcgcggccgagcccgccgccgccgccgtccctgaccgtcagctccgggaagctccacgcagcctccaccccgacctccttctccgccgcaacctccatcgccaccccctgctgcaagaacgacgcgaacggatccacctgctgcgccaccgccgccggagagatcctccgtcggcagcagccgaggcggacgacggcgtcgaggtcccagttgttgccgcagagctcctcctccatggccgtcgagaagaaatcaagaaaatcctcaagaggaggaggtggtggtggtggtttcttgggctctagagaggagataagagggaggcgctgacttttgctagtttattgattgatttggaagagagaaggagactatgggaaagggtaaaaggagagagagagagagaggaggaatggtggtgatggcattggatcctgccctaaaaaggagtgagggctactggtctattttcttgggttttttttttctttttcttcttggagggaggctggttttataggggtgtgggggcagcacaccccccacttgactctgcagcatgtcaaaggggtgagaaaggggatactccatgggtgggaggggtataatgggaaaagctcactgtgattttttttggacttttcttggagaaaatgtatacctcctgtattggatttaagaaaatgggaggtgatcagtat

SEQ ID NO: 5315 - DNA, 1841 bp, Oryza sativa
  Predicted polypeptide sequence is orthologous to G188
gattcctcctctctctctctctctccttttaccctttcccatagtctccttctctcttccaaatcaatcaataaactagcaaaagtcagcgcctccctcttatctcctctctagagcccaagaaaccaccaccaccacctcctcctcttgaggattttcttgatttcttctcgacggccatggaggaggagctctgcggcaacaactgggacctcgacgccgtcgtccgcctcggctgctgccgacggaggatctctccggcggcggtggcgcagcaggtggatccgttcgcgtcgttcttgcagcagggggtggcgatggaggttgcggcggagaaggaggtcggggtggaggctgcgtggagcttcccggagctgacggtcagggacggcggcggcggcgggctcggccgcgacgccgacgagctcctcaaggcgttctgcgccgcctttccttcttcttcctcgtcgaagtcgtcgcctctgccgacgcctcctcctcctcctccgacgcagccgcagccagagcagcagaaaccggtgacggtgcaggagaatctaccggctccgacgacggctccggcgagggcgtcgcagccggcggcggcgaggcaggtgccagctggcggcgtgcctagatccaagaggaggaagaaccagcagaagaaggtggtgcggcacgtgccggcggacggcgtgtcggccgacgtgtgggcgtggcggaagtacggacagaagcccatcaagggctcaccctacccaagggggtactaccggtgcagtagctcgaaggggtgcccggcgaggaagcaggtggagaggagccgctccgaccccaacaccttcatcctcacctacaccggcgagcacaaccactcggcgcccacccaccgcaactcgctcgccggcaccacccgcaacaagctcccttcctcctccgccgcctccgccgcctccgcgcagccccagccgccgccgccgtcggtggtggtggtcggcgccgggggtggtggagccgaggcggcggggctctccccgaccacaccgctgcggacgccgtccatggaggaggacgaggaggaggaggaggaggaagagctgctcgtggaggacatggagatggccggcgaggacgagctcctcttcctcaacggcggcgacgacaacgccgcattggatggcacccccatgtcctccctcttcgacatcgccgacgagcccttcttgccctcgccatggacggagcccaccgccgccggcagctagctcgcacagatcgccgcgccgttcttagctttttttagctcatcagctcgcaagaaaaaggaaagggaaaggaagagggaggaagagattagagcatccaattaatccgccattaatcatcgtcatcatcaccatcagcagcagcatactaaaaattagttgtttagcaatggtagcagtaggagagcatcaaatccttccagttcttggctgatcaaaacaaccctttttttctctctctttttatatttcctaggcaagcttgagagagactttgcatctcttcttttctttcttttttttttcttttcttcaccttaggtgtctggttttttttttttacatttgtaaatagaaagtggtagatgatgaaccaacaaaaggagatgaaacaaaaggggaaaaaaagatgatggtgtgtatcatgtagtactatctctctgcatggatgcagcaggggtgctttgctcttcttggctcttcctttctctgttcaacaacctaacctttctgcatgtagctcccttgggatgtttgtaagcttgaagaagagagaaagaagctccctctaatggc

SEQ ID NO: 5316 - DNA, 1077 bp, Oryza sativa
  Predicted polypeptide sequence is orthologous to G190
atgcaggcgcaatcccgcctcgctgctgccgcgagcggcggcagcggcagtggaattagcgggagcggtggcattagcaggttgggtggtggagcgggggaggagcacgaggcggtggtgagggagctgacgcgcgggcacgagctgacggcgcggctgcgggcggaggcgctgcgggcgctgcgcgggcaggggcaggccgaggccaccgctacattcatcctcggggaggtctcccgcgccttcaccgtctgcctctccatcatggccagcgcctccccgtccgcctcgccgccacaaccggacgagacgccgccggccgactcagccgtctcgccaccaccaccgcgcgcggcgagagaggacaacgtcccgcgaaagagattattgacagcctctccttacgacgatgggtaccagtggaggaagtacggtcaaaagaagatcaacaacaccaacttcccaaggagctactacaggtgcagttaccaccgggagcgcagatgccccgcgcagaagcacgtgcagcagcgcgacggcgacgacgtcccggcgctgcacgtcgtcgtctacacccacgagcacacgtgcctgcagggggcgcccgccgagcttcccgacgcggcgacgaacggtggcgccgccgccgccgcgtcgccggactacttccccgccggcggcgagacgccgtcgtcgctgcggcggctccggggcgtcggcggcggcggcctgcagcctcagttcgtggaccaccgcgccgccatggaggagcgcgagcgccaggtgctcgtctcgtccctcgcccgcgtgctgcaggggcggcagtgctacgacgacgacgacgacgacgacaccgacgtcgcctccctcggcgccgtgcacgcgcgcgcgcctgcggcggcggcgccggtcgccgcgtcgtcgtcgtcgtccgggcccgtcgacgctgccggcgaggagctggacgtcatggactacgacatgacggacgcgctgttctgggggcctttcggcacggacagcaactcgtacgacggaaacctgacgtcgacacgctgttttgatctaattaattaa

SEQ ID NO: 5317 - DNA, 840 bp, Oryza sativa
  Predicted polypeptide sequence is orthologous to G190
atggcgtcgccgcggctgaagagggagcagtcgttcgacttcgaggaggcgagcgcgcaggaagccgtgggatccgcgtcggcgtcgtacagccctcccgggggcggcggcgtctttggcatctcgccgccggagtcctcgccgcgcgacggccggaagagaaggaaggatagaccatcattggtgaaacatacgttcacacctcattttgatggtcatttgtggaggaagtatggccagaagaacatcaaggactctgctttccctagatgctcttaccgtgaggacagacagtgccttgcctccaagctggtgcagcaggagaacgacgacgacccgccactgtacagggtcacctacacgtacgagcacacctgcaacaccacgcccgtcccgacccccgacgtcgtggccgagcagccgccgccgggcgccgccggcgacgcgtacctcctcaggttcggctcctccgctggcggcggcggcggcggcgctcatcagcagcagaccgagcgagaacgacagcagcaaaatacagcgagaagaaggccattcatgatgctgagcttcgattctagtagcagccatcagctgcacgagcagccgcacgcgttccctcccgacggccagctgccggccacggccgcggccgcgtcgccgtcgtcgttcacggcagccgaggcgttggcggcgccgccgctcacgacgacgatgaacgacggaggcgacctgttctcgacgtgggacgcgctcaggtatggtttggactatgaccacgggcaccttggtaaccatgtttatctccctgatgactgtaatggtggtgatgataattactga

SEQ ID NO: 5318 - DNA, 1387 bp, Oryza sativa
  Predicted polypeptide sequence is orthologous to G192
gagcttgccgacgtcggcgttcatgcgcggcccgctgctgctgcgcgccgtcgtcgtcgtcgccatggagcacttcaacgactgggacctgcaggccgtcgtgcggagctgcagcttcccgcaatcggagcctcctcgcgtcggcgtcggcgtccccgcggcgccgggagcgggcggggctccggtggtggtggcgccgcccgcgcgcgcaccggatggtccggatcagatggcgcgggcgtcggcgtcggcgctgtacgacctcgagtacctggatttggatcataagccgttcttgctgcccgggtcgtcgtcttcgtcgtcgtcgtcccgagcggtggcgcgggcgcgaggggaggatgacggcaaaggcagacacgaggtgatgatctctttccccgcggcggcggcggcctccacgtccggtgcgcagccgcggtcgccgtccggtcggaagccgggcatacgcaccccgcggcctaagagaagcaagaagagccagctgaagaaggtggtgtacgaggtgccggtggcggacggcggcgtctcctccgacctgtgggcgtggcgcaagtacggccaaaagcccatcaagggctcgccttatccacggggatactacaagtgcagcagcatgaaggggtgcatggccaggaagatggtggagcgcagcccggccaagcccgggatgctcgtcgtcacctacatggccgagcactgccaccccgtgccgacccagctcaacgcgctcgccggcaccacccgccacaagtccgcccctaccggcgacgacgacaagccgacgtcgccgggccctgcagccggcagagcggccgccggcgagggagtggtcaagtgcgaggacgtcgacggcaacgagctgtcggcgatggccgcggatggcggcgcagaggacacggcggcggcggcggatgacgacggtgagttgtggccggaggggatggggctggagctggacgagttcttgggtcccatggatgacgacgtgttcgagttcgaccatgtcttggaggacgacggcgtgctggggcgacggctctcgctatagctgcaagagaaaagctgtactagctagctttgacgagccttttaggacagttgactgtcagctccaacctcttcaggagatccaagccatgtataggcggtttttattcgtgcgtgtttgtggcatgatctctctcaagtcaaggttccaagtttcaaatttgcacaagtgtatatacttgtaatattcgcagggatgtcagtgcgcattgacacttttgcattcctgtacataattctcgtggttggtgactttgtcccaacacgtggaccgggctcaaagggaagtgacagcttcagtgcagtttgcctgcttgcc

SEQ ID NO: 5319 - DNA, 930 bp, Oryza sativa
  Predicted polypeptide sequence is orthologous to G192
atggagtactccaacgattgggatctccaggcactggtcaggagctgtggcacggccgtcgccgactcggagccggagccgccggcggcgccgtcgacgacgcggcgggctgaagccgaaaccgtcttcgttggccgtgctggtggggtgccggagttcgttgggcaaccggtgaggtcgtcggcggcatcgttttacgacttggagtacttggacctgtaccacgagcggcctcgggcgccgttcttggtgacggcgccgtcgacgagccgcgagcgtggggagggcggcgagcatgaggtgctcatctccttcccggcgattgcctcgacgtccgggcagggtaggaagcagcctggccggaaaccgggcgttcgtactgccaggcccaaaagaagcaagaagagccagctgaagaaagtggtgtgcgaggtgccggttgccgacggcggcgtctccaccgacctttgggcatggcgcaagtatggccagaaacctatcaagggctcgccgtatcctcggggatactacaagtgcagtagcctcaaggcgtgcatggcgaggaagatggtggagcggtcgccggagaagcccggggtgctggtcatcacctacatcgccgagcactgccacgccgtgcccacgcagctcaactcgctggccggcaccacgcgcaacaacaagccggcgtcccctgaccagcagcagcagcagcagccgtctcccggcggcgcgtcgacggacgaggcggcggcggcggcggccaagacggaggacagcgccgacactacgtgctccatggcggacgacgagaacgacctctgggcgccggtggagatggatatgaacgatttctttggccccttcgacgatgatctcgaccactttttggatgacgacgccgttcttggacgccggctgtcgctctag

SEQ ID NO: 5320 - DNA, 673 bp, Oryza sativa
  misc_feature (72)..(72): n is a, c, g, or t
  misc_feature (130)..(130): n is a, c, g, or t
  misc_feature (294)..(294): n is a, c, g, or t
  misc_feature (351)..(351): n is a, c, g, or t
  Predicted polypeptide sequence is orthologous to G194
tgggcgccaaagtacggcaagaaagtccggtccaagaaacagccccaacccaaggaactactaccggtgctngacggaaggggtgcaacgtgaagaagagggtggaacggggacaaggacgacccgagcnacgtggtgacgacgtacgaggggacgcacaaccacgtgagccccagcacggtgtactacgccagccaggacaccgcctccggccgcttcttcgtcgccggcacgcagccgccaggttctctcaattaaccgcgcgcgtacggttaatttgatcgatcgggtcanccatgggacttttccaatgctagctagctaatagtgtaggtgttctgggccggattnttgatcgagatagcagcctcttgattgagatgcccagatgggtcattttggatgtagctggatctttttttccccttttcttctctcgatctctgtcccgtcctttttgcctgtttcgatcattggaaggccgggccggcctggctggtttgcagcgatagtgatcaaatgctgtgctgctgtgtttctgtgctcttgaggatcctcccaactatcccccttgagcctaggtaatatagccatgggaaatgtaacatatatatactgtttaaccgtgcaataaaaatgtacagagcttgaaaaaaaaaaaaaaaaaaaaaaa

SEQ ID NO: 5321 - DNA, 1776 bp, Oryza sativa
  Predicted polypeptide sequence is orthologous to G194
cgcctttgcaaaactcctctcatttcatttcctcccaagagtcaagctagcccttcttgcttgctccgttcaacgcctcttccccagcttcacagtactccatgtctggacctggaggaggaggtcatggcctctacgaggatcatcctgcagccgccggcttcctccccttcgaccacgacgacgacgtggtggccagcttcttctttggcagatcggcggcgtccggaggaggagccggcgccggcgccggcgctggagacgatgatggtgttgggctcatcacgccctactccagcatcacggattatctgcaaggcttcctgcaggaccccgtgtacgcgtcgtccccgttgggcggcgatgctgccgtgaagcacgaaacggtggtggatcatcccagtcaggccggcggcgtggcggcggcgccggccacgccgaactcgtcggtgctgtcgtcgtccagcgaggcggctggaggggacgatctgcgccggtgcaagaaaggtcgtcggccggaggacgaggaggaggaggagattgacgatgagggatcggccgttcagagttgcacgaacaaaatgaagaataaaaaaggggcgaagaaggagcgtgagccacgtgtggcgttcatgaccaagagcgaggtcgaccacctcgaggacggctaccggtggcgcaagtacggccagaaagccgtcaagaacagctcctacccaagctactaccggtgcacggcgccgcggtgcggggtgaagaagcgggtggagaggtcggagcaggacccgtccatggtgatcaccacatacgaagggcagcacacgcacccgagccccgtgagctaccacatgcacaggcagcaggggctcatgcatgtgagcgcgcgcggtgtcatgcccggcgccgccggcgcctaccagttcggcgcgccgccgccgccgctccttggcttcgacgaagccctcgccgctcggtcccaggacacagtgctggtatcacaggaagacagattatcacagcaacagaggtctctttattatagagtagatgtacagtcatgttgggctgcggacagatcccgagctcacaactgcattacaaaagggaaacggaagccgggacttggaccaaacaacacaggcgcgacttgggaactaggccgaaaccctaaaactcatcgtagccggcttgctcctggaagaactcctcatcagcaggatccgcttcgtcttcttcagcgactggggggggattatttatatagagcaaggaggggggtacactttacccacacgacattactaacccggatcacccagcccgtggggatcagccacgtcgggagacctccaagctttcatgacaaggcatttccaaagccgatacaggtttaccatatgccgacgagaggggtcccagaccaacaacaggaatcggttcttaagtgcgagagcgggaaaaccgtacacccggctcaagatgttcaaaggtggcttgccttgctcgagatctggagcttgatcctcgaaatcctcgcactgcgggtcttcgggctccggaactacacgcgaaacgggacaactcaacaaacggcgaaaatgaagccctaataatgacctctaagcgtgccattagatagatctcgagatttgaggaattttggaagttgaacggagtcaaacggatctacggttgggaagatattgaatttctaagattattggatttttggtctaaaggaaaaggatttaattaaatcctttttggaaaagaaaa

SEQ ID NO: 5322 - DNA, 621 bp, Oryza sativa
  Predicted polypeptide sequence is orthologous to G196
tttttttttttttttttttttttttgtttgaaaagagctctcataatatcatagtcctgatggaatttacatatattgttacagtagatgttagtagtgcttgaagttgcatggggaagataatatctatgcctaaaattaagtgattggagataataaatcttaccaagtttattaaaattgagcacgtagtattacttacatgcattatatagacccccaaaaaagtcatgatagaataatttgtcattagcatttccctacaacagtgttcttgcatcaaagaagctgcactcttggaccacgaaagataagcttggcaagggagatgcagacactgggagctcctcaagctcatcaaagaagtcacagctctcctcttcaccggacagcttggaggatgcaactgttactacctcagcaagggacatgccattgctgagaggatcacttgtgtcaggattatgtgcctgttcttggactgaatttgtagtagtagcagcatagttgtcatggttgtgatctgaggtgtaggtgatgatgagcagagatgcatcattcctgcacttgtctacttgcttcctggctgggcatccccttgctcgtcctctggctcaccta

SEQ ID NO: 5323 - DNA, 1533 bp, Oryza sativa
  Predicted polypeptide sequence is orthologous to G196
ctagctagctaagctagccatgtgcgactacttcctgcagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcgtcgccggcatgcagatgtcgtcgccgcgctccggcgggatcaagcgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaaacccatgggcataaagccatgcatgagggtttatgcatgcatacggttacataaacttgatcccagctaataaccataaagattgtgacaatgtcagcaaaggaaagatgagatttttttttttacttttcttttcttcatttggtctctctgcttcttcatattattgtgtgtgagaattaaattttgtttcaaggtctaggtatatggacctcattttttaggctgtgtcaacttgttgtacttatgcatgagatgatgaccactct

SEQ ID NO: 5324 - DNA, 1623 bp, Oryza sativa
  Predicted polypeptide sequence is orthologous to G196
aatcgagctggtagtagccggccagtagcactctgagtgcgtgcactactagtgctcctgcaggcaaggctggacgggagtgggagtgtgtgtaccagtactagctactagtgaatactgaataggcagcagcaacagcagcagcagctaattaagcatcagacagaaactagaaagagcgagcacgccactatggatatgatggaggaggaggctgccaacgccgccactgctcaagctgctgctgctggcgacctcgccgacgtcgtggcccgtgccaatgcacgcgcattcctcgtctccacccctcaccatcacccctcacctctgcatcctcttcctcctcctcccatgcctcaggcgcctcaccaatactatcccgccccccagatcaccatcccttaccaccaccaccaccacggagagcttcggcgccctaccaccatcgcttacaccgacgcacctgtgccgttcgagacggcggggccgccatccacggtcgtcgactcataccaccacctcacacccggcgacgccggctacgggatgccgcggccgcttgctctccagatctcccagcacgccctctgtggcggcggcgacgtggtgatgggcggcggaggcgcaggcgctgccgatgatggagaagaagccatcaggatctcgccactgacgccgtctgctcatcatcaaatgatgaaaaggaagaatgaggtgaagaaagtggtgtgcatcccggcgccgccagcgacgagtagccgtggaggtggaggagaggtgatcccgtctgatctatgggcatggaggaagtacggccagaaacccatcaaaggctctccttatccacggggttactacagatgcagcagctcaaagggatgtatggcgaggaagcaggtggagcgcagccgcagcgaccccaacatgctggtgatcacctacgcggcggagcacaaccacccatggccgatgcaacgtaatgtgctcgccggatatgcccgttctcatcacagtactcatgctactgcctccagcagccgccacaagcaacagcagcagcagcagaccaaccagctgcagcctgcactgatcacaagctcatcgtcttcttcctcctccccattcaatctctacgccgacgtcgtgctcggtggccaacaggccaacatgatgatgacgacggagggcgccggcgctggacttggcatccaaccttcagcagctgatgaggtctttgcagagctggaggagttggagcctgataatcctactatgatcaatgcaaacatgcaggtgtactccaccaccagcaggccaggggtaagcagctatgatcatcagtggcacaagttctaataattaaaccatgcagtacctatatatatatatatcagaacttcaatattcgagagaggagatcagaggaaattgaattctagcacgtacaattaatacatcatgactatgcaaaatttacatatatatgatatgatggtcgcctgtgcgattattagtgaccaaattaaagattgtcagagatataggcgtgtacttacgcttatatgtatcacgctgaggtatactgtatttacaagaagataaataaaatatccatatccctct

SEQ ID NO: 5325 - DNA, 1633 bp, Oryza sativa
  Predicted polypeptide sequence is orthologous to G196
tgcgagcgtcagagagagagagagagagaggaggtggtggtggtggtcagatcatcatgtgtgattacttcttgcaacggatagagggggagcaggccgccggagacctcgccgacatcgtcctccgcgccggcggggctgctgctgctgctgttgcgggcggcggcatcccgtcgacggagtggcagctaccaccggcggaggaggaggaggaagagccgggtctcttcccgctgccgccgtcgtcgtcggatggctccggcatgagcggcgcggatgcgttcggcgacccgttcgctggcctccccgaccccttcggtggcgactacccctcctctggcggagcggcggcggccgccgacttctttgacgccgtcgtggccaaggccgggttcgtcgacgtcggtgtcctcggtggcggcggcggcggtggctgcgatggaggtggcgttgatggtggtggaggagggtcgtcgctgctgggcatgagcaagcctatcttgcctagggccgccatgcagttgccgtcggtgtcgccgagggcgatacggccgtaccccgtgatggcctgtgacacggtgaagctcggcgcgccgatggccggcgggccgtgcgcgttcgacggcgccgccgcggcagggctgcacatgtcgtcgtcgccgcgtggcgccgtcggcgggatcaagcgcaggaagaaccaggctaggaaggtggtgtgcatcccagcgcctgcagcagcaggagggaggaccagtggggaggttgttccttccgatctctgggcttggaggaagtatggccagaagcctatcaaaggctctccttacccaagagggtactacagatgcagcagctcgaaaggatgctcggcgcgcaagcaggtggagcgcagccggaccgaccccaacatgctcgtcatcacctacacgtcggagcacaaccacccgtggccgacgcagcgcaacgcgctcgccggctccacgcggtctcatcacgccaagaacagcagcagcaacagcagcagcagcggcgcctcctcagcctccaagaacaactcctcccacagcggttaccaccaccaccaccaccagaagccactcgtcaaggcggaacccaacgatcaatccgccgccgccacgaccgccgccacggtgccggtgaaagaggaggccgccatggtagggacgtcgtcggaagcattggcgaagacgacgcagaaatccatggaggatgctgctgctgctgcttcagccacggcggcggcggtggagcacagtgatctcatgcagcagatgttcagccagagctaccggccgatgataccggaggcagcggccggcggccaccacgacgacttcttcgccgacctcgccgagttggagtcagatcccatgagcctgatcttctccaaggagtacatggcgaccaattacaagccagcaggtgacccagcaggcaaggagatgaatgcagtagacaagggcttggatccagcgtacatgctggattggtcttctaccactgttgttactagagctggtgggagctcatttatgcaaggggagggaggtttatgacattttaatcactttgaaacaaaaggcaaaagctagtatatgcgaatgcaaacacc

SEQ ID NO: 5326 - DNA, 900 bp, Oryza sativa
  Predicted polypeptide sequence is orthologous to G196
atgtgtgacagcttgttttggcagtcgtcggccgaccaaggggacctctcggatgtggtgagggccagccttcagctgcagacggcgcctcgccatcaggctgcatcgccgccgtatgtgcacctcttaggaggaggaggaggaggaggagaagaccagcttgcagcagtgagccaacacgctgagcagcagcagcagagcatggtggatgcttctgcagcttgcgaccttctccatgcgctgttgccaccaccaccagtagtgcaggtgcagcagcagggagcgtcgaggacgaggacgacgattgaggaggacaccaccggcgacggcgaggagttatttgctggtgctcattatgtcgttccgcccatcaagcgaaggaagagccagacgaagaaggtggtgtgcatcccggcgggggcgagtggcggcggcggcggcgaggtggtgccgtcggacctgtgggcgtggaggaagtacgggcagaagcccatcaaggggtcgccctaccctcgcgggtactaccgctgcagcagctccaaaggttgctccgcccggaagcaggtggagcgcagccgcgccgaccccacaatgctcgtcgtcacctacacctccgaccacaaccatccatggccaacccaccgcaacgccctcgccggctccacccgcccctcctcctccaactcatccaacatacgcctccaagacagtactccagttcatcatcagagtcagactggccacgatcgtcttacgaccactcacctcaagcaggaggacgtgatcatctccccctccctgctgcagcccgaccaccatcagctgtgtaccattattgacaccaagcaccacctcttgtttcatcaagactatcctcacagcttcggcttgttcgactag

SEQ ID NO: 5327 - DNA, 1545 bp, Oryza sativa
  Predicted polypeptide sequence is orthologous to G196
atgccgccttgcgtgtggggatcgcacacacctctctctcttctctcccccccggccgcttgggcgggcgagaggatggagggcgaccaggccggcggcgacctcaccgacatcgtccgcgccgggggaggggccatgccggggagcgtcgtcgtcgacctcccgtcgacggccgccgagtggcagctcccggctgagccgatgctcttcccgccgccgccgtcgttgtcgtcgacgacggacggctgtggcgccgggggagcggcaggcgccgacatcttcggcggtggcggcggcgaccttttctccggcctcgtggacccgttcagcagcgactactcgtccggcgcggacttcttggacgccatgccggacgcgatggcgaaggtcggcttcgacacagctgtcggcggcggctgcggcggcggcggcggaggtggtggtgggagcggtggacacctgttagacatgagcaggaagcctctcttgcccagagggatgccgatggcggccgtcggtgggctggcggcgccgagggtgatgccatcgccgctgtcgccgcgagccatacggccgtacccgccgatctccgcaggcgacatgatgaagctcggcatcacggcagggcaggcggccgggtgcgccatcgacgccgccgtcgccggcatgcagatgtcgtcgccgcgctccggcgggatcaagcgcaggaagaaccaggcgaggaaggtggtgtgcatcccggcgccgacggcggcgggaggaagacccagtggtgaggtggtgccttctgatctctgggcttggaggaagtacggccagaagcctatcaagggctcaccctacccaagaggctattatagatgcagcagttcaaaaggttgctctgcaaggaagcaagtagagcgcagccgtactgacccaaacatgctcgtcatcacctacacctcggagcacaaccacccatggccgacccagcgcaacgccctcgccggctcaacccggtctcaccacagcaagaacagcggcggcggcggcggctcgggttccaagggctctcagaacgacaagtcacagcagcagccaagcgttaaagaagagcagaaggatcaggcgacgacggcgacgacgacgaccaccagcacaatcactaccacgaatagtgcttctcctgtggttgtgaaggaggaagaggcggcactggcaggatcgtcggaagcattggagttggagagagtcatggacactactgcagctggagtagtagaccacagtgagctcatggatcatgttttcagtgagagctacaagccgatgataccggagactggccagccggatgatttcttcgcagacctcgccgagttggagtcagatcccatgagcttaatcttctcgaaggagtacatggaagccaagccaagtggtggcgatcatgcccaggagaaggcaatggccaaggaattggatccattcgacatgctagactggtctactactactaactcttcggcagggagctcatttgagcaagggaagagaggctaa

SEQ ID NO: 5328 - DNA, 1176 bp, Oryza sativa
  Predicted polypeptide sequence is orthologous to G197, G255, G664
ccgccgcggctcacctggaaactgggcagattggacaatcgctcgagcgagctagcgagagagagcgcgagagagcgaggcggcgcgcgcggtggttgcggatttgtagcttagagcgcggggccatggggaggtcgccgtgctgcgagaaggcgcacacgaacaagggggcgtggacgaaggaggaggaccagcggctcatcgcgtacatcagggcgcatggcgaaggctgctggcgctcgctgcccaaggcggcgggcctccttcgctgcggcaagagctgccgcctccggtggatgaactacctccgccccgacctcaagcgcggcaacttcaccgacgacgaggacgagctcatcatccgcctccacagcctcctcggcaacaagtggtctctgatcgccgggcagctgccggggaggacggacaacgagatcaagaactactggaacacgcacatcaagcgcaagctcctcgcccgcggcatcgacccgcagacgcaccgcccgctgctcagcggcggtgacggcatcgcggcgagcaacaagcggcaccaccgccgccgcatcccatatccgtcccggcgaaggcggcggccgcggcgatcttcgccgtgcgaagccgccgccgccgccgcgcccggtcgactcctcggacgacggctgccgcagcagcagcggcacaacgagcacgggggagccgcggtgccccgacctcaacctcgagctctcggtcgggccgacgccgagctcgccgccggcggagacgcccaccagcgcgcggccggtctgcctctgctaccacctcggcttccgcggcggggaggcgtgcagctgtcaggctgacagcaagggcccacacgagtttagatatttcaggccgttggaacaaggccagtacatatgagatatgaccatgagatgtgagatggcttaattagcttcaattcccaacatgtgtaacacagggagtttttctagtggacgacaatactgtttaatttcagaaaaaaaagggaaagaaaaaggttctaatctgttcatatttcttactattatccaatcttcatgatctcaatctctctctctctttattatttttctttgtagtaattaacttcatgttggttcctctaaaaaagattggtcgatgttattcagtgataaatattcctag

SEQ ID NO: 5329 - DNA, 1069 bp, Oryza sativa
  Predicted polypeptide sequence is orthologous to G197, G255, G664
cgccatggcgccaccatgcatataaactcgagctccctctcctcctcttcttcctcctctccactctccaccatcgtcttcgtcgtcgtcttcctcagctcggagcgatggggaggtcgccgtgctgcgagaaggcgcacacgaacaagggcgcgtggaccaaggaggaggaccagcgcctcatcgcccacatcaaccagcacggcgagggctgctggaggtcgctccccaaggccgccgggttgctgcgttgcgggaagagctgccgcctccggtggatcaactacctccgccccgacctcaagcgcggcaacttcaccgacgaggaagacgagctcatcatcaagctccacgagctcctcggcaacaagtggtcgctgatcgccgggaggctgccggggaggacggacaacgagatcaagaactactggaacacccacatcaagcgcaagctcctcgcccgcggcctcgacccgttacgcaccgcccgctcaatgccgccgccgccgtcgccggccaccaccacctcgcgccggcggctccagctgctcgcccgacgcaacaagcggccacagcagctgcagcgacggcgacgagtaccgcggcggcatcgacctcaacctgtccataagcccgccgtcgtcgtcgtcccagccgtcttccccgccgccgccgccgcacgaagcagaggcgagacgcgccggagcgacggcgagctacacctaccaccaccactactcggagacgagggagaagatatgcctgtgcttgaaccacctcgggctgcacggcggcgacgagtgcagctgcggcggctcgtcggcctcttcctcctcctcgccgccgccggcgacggcgagctcgcgagcgttcacattcgccaatgcatcgtcgtcaacagtgtaaaacacagagaaattcagcgattttcagactaagagaattaatgagaggtagagcacatgcatgctgaattaattgaattaactcaatccaagcttgagctaggcatctagctaactttgtgatttgatcatgatcagctagcaaaatcatcataatcatcatc

SEQ ID NO: 5330 - DNA, 600 bp, Oryza sativa
  Predicted polypeptide sequence is orthologous to G197, G255, G664
gccaacgcgaagctctcgtcgcgcacaaccaactcgacaccgcggcgaggccaaccaacgcgcggcgtgggcatggggaggtcgccatgctgcgagaaggcgcacacgaacaagggggcgtggacgaaggaggaggaccagcggctgatcgcctacatcaaggcgcacggcgagggttgctggcggtcgctgcccaaggcggcggggctcctccgctgcggcaagagctgccgcctccgctggatgaactacctccgccccgacctcaagcgcggcaacttcaccgacgacgacgacgagctcatcatcaagctccacgcccttctcggcaacaagtggtcgttgattgcggggcagctgccgggaggacggacacgagatcaagaactactggaacacgcacatcaagcgcaagctctgagccggggcattgacccgcagacgcaccggccggtcacgccggaacacgcccccccgggaaaacgggcttacacgacggcaacaccgcgcttttcgtccttggcccggggccgccgccgaagaagacaggctaaaacccgggcacgcccgggggccaacattgcagctttccaggtccgg

SEQ ID NO: 5331 - DNA, 1054 bp, Oryza sativa
  Predicted polypeptide sequence is orthologous to G197, G255, G664
aacagcagcagcagcagcagcagcaacttccactgaaacaacccaccgaggcagcagaagaaaggaaagaatcaagaaagcttcatcgtcttcatggggaggtcaccgtgctgcgagaaggcacacaccaacaagggagcatggaccaaggaggaagatgaccggctcattgcctacatcaaggcgcacggcgaaggttgctggcgatcgctgcccaaggccgccggcctcctccgctgtggcaagagctgccgcctccggtggatcaactacctccggcctgacctcaagcgcggcaacttcaccgaggaggaggatgagctgatcatcaagcttcacagccttttaggcaacaaatggtctctgatagccgggaggttgccaggaagaacggacaacgagatcaagaactactggaacacgcacatcaggaggaagctgctgagccgtggcatcgacccggtgacacaccggccgatcaacgacagcgcgtccaacatcaccatatcattcgaggcggccgcggcggcggcgagggacgacaaggccgccgtgttccggcgagaggaccatcctcatcagccgaaggcggtgacagtggcacaggagcagcaggcagccgccgattggggccatgggaagccactcaagtgccctgacctcaatctggacctctgcatcagcctcccttcccaagaagagcccatgatgatgaagccggtgaagagggagaccggcgtctgcttcagctgcagcctggggctccccaagagcacagactgcaagtgcagcagcttcctgggactcaggacagccatgctcgacttcagaagcttggaaatgaaatgagcacctcctcctctgtagtttcttctttcgttttgtcacttggatattggttagcttttcttctaggtgaaaacacacagagagagagagagagagagagagagagagagataacatctcctctgctgctcttgctgctccattttgtctctgttgtaattaccatatattgactaatcatgacaaataatacttgatgctaagt

SEQ ID NO: 5332 - DNA, 1037 bp, Oryza sativa; identical to SEQ ID NO: 1965
  Predicted polypeptide sequence is orthologous to G197, G255, G664

SEQ ID NO: 5333 - DNA, 2930 bp, Oryza sativa
  Predicted polypeptide sequence is orthologous to G197, G255, G664
attttcaaaatctctcggggggcaatggagctcaccgccgccaccgcgggagcgacccgtgccaccggaggattcctcgggaccagccgtcgccggccgcaatcgtgggcttttcagttctgcagggatatacatcagcactgctcaaatgaagcatcaatgcgtaccacagatagattagaagtacatatataaaagagattactgttggctggagcaaatgcatctgtgtgatacgatagtggtaaggcactctggttcaggatgacctgagcagttagcatcttttggacacacctctttagaaaacacaacctctcccagaatctgagtttcctgcttctgctgtacagtatttatcttcatcaaatatttgagaaatattgtcctagcaaggtagcacccgtgatgcaatggcaaagattcatagaagcttccaatccatatcgagcctaccatatcttcaagcttttatcataccagagtggcttggtcactatgacctggtgtttgcgcgtcttgtagtccctgtggtttcctttttcaaggtacatcaaaattaaaggaatggtaatcaatagatttgtcaaagaccatgactttggaaagtttatggtacttggacgagcaccttcagatgctcctgcaaggttatatatgcttgcacgcatgtggtgatacttcctttccatacccccaggcatgcaccatgcttcgtacattttctgaagactccaacactcctacataaccagctcagttcctctatcatcttacgtctgcatagagaggcttacactacacctggaaacaaatgaggatggccggcatggaggcttacttgttgcctagaagctcatggagcttgatgatgaactcgtcctcctcctcggtgaaattacctcgcttgaggtccggtctcaggtagttgatccatcgcagccggcagcttttcccgcaccgcagcaaccctacacacaggaagggacacgagctagcccaaggttttcaattggtccaagggattgctgttgcttgatggaagaaaaagtctgagttggaaacaaacttcaatggctcaacacccacttccacgttagtagattttttggggcacacatcagcagcacatggcgatgcttaatgggctcacccaccgacatttttctagcaccccacgctagctccccctcctttctgagattctagaaaacccagcagcatgtctttgtgtgtgtgattgtgcaagaaagaaagcaaagaaagggaaagggtgaagcaagaaaggggagaatctgatcaatttggtgagctaccccctccttccttcccgctcctaattcccctccctcttgatatggaggaagttgtgcacttgtttaacccgttactttattcttggttggtgtacatgttgtaaggttagggtaggccgagtattccatgtactcatgcttgctgcatcggaattcacacatccagctgttgcgacaacagtatcatcacgagtgtattacgtcaattttatggctattttgtttgttgtttggttaagtttgtatagtgaaatggtcatgatggtggcaggactgttcgaactagtcttgctgcaatatttgaattctaaagaggaaggttccttttttttaaaaaaaaaacccgaatatagaggaaggttggactgtttccatttccatgaggacatcctggagtcttgagtcttgagaggacaaaatacaggtaatcctagtagagtaagctcagctgttcatgttcaaacaaaagaaatattttaatggtttaatctccaacgagtatccttaagaattgtaaactcattcggggtttggtggtgacattgattacagtgctaaagaatatttttcgtggtactccggtccagtcagctgccccccttttggtgccatgaaacctcactctttgcattctttctgttgcatgagtccaaagataataccaccagatctactacagttaaaagtgcttatctgctccatcaaaaagagaactagtactacaagcatggtatccaaagcgatcaattgagacaataacaatcctgaaagattgttttcatagcagataagaaatgctccaaaacatgatgcagatctactgatgagaagaagaggaggcaaggcaaattgatggagattggagaggaggtgtatggagctgtggatgtagacctggtgtactcatggggcattcctaggaagggaagggaagccaagagaaggaaagggaagagaagagatgcagcaggcagcaggcagcagcagcagcaatggtggtgtaataataaaggtgtgtcaatgaatgagatgagatgctgctgagctactaccctccctccatgcaccttgggccaaatccaacaagagaaagaataacctgaaggaacgacttggccattcactcgttcaggccggtcaatgcagcatcacattaacaagacgaggcaacagtaacaaaagagcagttggtgcacaacttttcaagcgatgtccccattccaccggaaagttttccctagcggacacaacaaaagacaaacatttactctgccccttttttcctcttcgttgtcagacacgtcaccagtgaaaattaaattataaacatcgaaccttgttgttcatgcatggtacagtatggaggtgagtcaagagatggactagccgtagagactgtaggagaaaaaggaagaacagtgattgggaccaagatgactcgttcacccttatatttaattaatcagcaccgtttcttttatgaatcatgatgtaatggcgtcattagctacccttatttacccgccaggaatcgtgcacgcacatgtaagcgaggagggaatttgtggtactacactactactttgttcaatggaaaaagcttttattcgaatg

SEQ ID NO: 5334 - DNA, 1680 bp, Oryza sativa
  Predicted polypeptide sequence is orthologous to G200
aaaaacaccgagccaggctaggacaggttgagacttcatcagcttaattgttcatgcaatgccaggttcactaggcagaagcagaggattctgcaggttagcataaaagggacgtgtaacagagagagacacgacacaggccatgtcataatcagggtaggtccggcattaaacgaaagattagggcactgtttatctttgcactcaatgaatgagaacagggcaagaaaaaaaagttgggagctgatttcgtttgcactgaatgtgatcgggggaccaacacagttgccgacagcaaccgtcggagaggtccatgaggtcggcgacctgctccgccgccgcctcgtcgaacagccacttctcgatcgatgacagcggcggcgctgcctggttcatcagctgctgcttgctctcgtcgccgtagccgccgccatagccgccgtactccatgaacgacgccggctgctgctgctggtgctgctgatgaacgtcgaagcagcagtccaggtcggcgccggacatgcagtcgaaggacgacagcaaggggttgccgccgacatcgacggcgggcttgacgtcgtcgtaatagccgctgtcatagtgctgcagcggtggcggcggcggcgacggggagttggtcttcatgaagccgtcgagcagcttggagatgttgtccatgctggaggcgtatgaggaggatgggcagtcggcgaagggggagcgcctagcaatggctgccatctgggtgacatcggagttgctgctcaccgtgtagctaccgccggcggcggaggggaaggtggcgtcggcgaagatggggtggcggttggaggatgaagtggagttggcggcggcggcgagcttcttcttgaggtgggtgttccagtagttcttgatgtcgttgtcggtgcgctgggggaggtaggaggcgatggcggcccagcggttgccgagaagcgactggaggtggacgatgatcccctcctcgtgcgccgtgaagttgccgcgctttatccccggccgcaggtagttcgtccaccgcagcctgcagctcttgctgcacctcatcagccctgcatccatccatccacccacagcttcagcttcttctcagttcatcatcgatcaccatggctacttggctagctatagttcatctacaaaagaaagtaagaaactacacagaattggggaattaggacgtaccagtgttgatgggaaccgatctccagttgccggggccgtgttcttggatgtaggagacgaggatgatgtcctcctcgggcgtccatggccccttcttgatcccctccttgtcgcagcacggcggccggcccatggctacaattcctcactcactaattaactctgatccttcccggatcgatcgatcgagctaactactctttctggaagctgcagctagctgatcgatcgatcggtcgtctctctctgtgctacctgagcttccgacagtgtgcttgagtgtagagatatatatagctaggagactggggactttgggagtgagtgagctccttttcacttgctatctctgatgtaagccactttctgatcgatcgatgtgatgatttactttcactttctagcaagtcagttgatctggttatcgatcgatcgatcgatctgtctgtatgtaggatgctttctctttctgtc

SEQ ID NO: 5335 - DNA, 838 bp, Oryza sativa; identical to SEQ ID NO: 2299
  Predicted polypeptide sequence is orthologous to G207, G227, G230, G242

SEQ ID NO: 5336 - DNA, 1591 bp, Oryza sativa
  Predicted polypeptide sequence is orthologous to G207, G227, G230, G242
gctactgacttaatttagctccgcctccattcacgcattcacactagcatagcatataagatagcacttgtagagaggagatactagtacacatagagaagaggagaggagattgatcggtgagggaggatgatggcgtcttgtcggagaggagggggaggggatgtggataggataaaggggccgtggagtccggaggaggacgaggcgctgcagcggctggtggggcggcacggggcgcgcaactggtcgctgataagcaagtccatcccggggaggtcggggaagtcgtgccggctgcggtggtgcaaccagctgtcgccgcaggtggagcaccggcccttcactcccgaggaggacgacaccatcctccgcgcccacgcccgcttcggcaacaagtgggccaccatcgccaggctcctcgccggccgcaccgacaacgccatcaagaaccactggaactccaccctcaagcgcaagcaccactcttctctcctcgccgacgacctccgccctctcaagcggacaaccagcgacggccacccgacgctctcctccgccgccgcccccgggagcccctccggctccgacctcagcgactccagccaccatagcctcccctcccagatgccctcctcacccccacacctcctcctccctcagcacgtctaccgcccggtcgcgagggccggcggggtcgtcgtccctcctcctcctcccccgccgcctccggcgacctcgctctccctctctctctcccttcccggcctggatcacccacaccccgatccctccaccccgtcggagcctgcggtacagttgcagccgcctccaccgtctcagatgccgccaccaacaccatcttgtgtacgccaagagccgcctcagatgccgttccagctgcagcccccaccgccgccgcgcccatcggcgccgttcagcgcggagttcttggccatgatgcaggagatgatccggatcgaggtccggaattacatgtccggctccgccgccgtggatcctcggtcgtcgcccgacaacggcgtgcgcgccgccagccgcatcatgggcatggccaagatcgagtaatcaaccagccgcagcagcatacggaatgatcgagtaatcaagctcagattgatgcactgcaagcaagaaagcagagcaagaagcagaggcgccggcgcggcaagtgaagagacgacgaccatcaacgtttggatcctccttttctattctgctatagtcttcttcttccccaataattccttgtctagttttaatttttttttctcttcaatttttactcctccaatccaagttgaagttgtcactagtagagttctccagagagagaggagatgaagcaacaacaaggagctgtgtctgcctgtctggaggaactaataccaaaccaaaataagcagagtgtgtgctgctgtgccacaatcagcaccaccaccgtggcaccacccactagcttagcttagctagctagttcaaagttctttttgtatatacttataagaggaaaaagaaaaaagagagctgatcagtgaaaattcagaatgcatcagtgaagagaattgcc

SEQ ID NO: 5337 - DNA, 525 bp, Oryza sativa
  Predicted polypeptide sequence is orthologous to G207, G227, G230, G242
atgaggatcatcctccgcattaggctctcgccggcgtggacgcccgaagaggacgcgtgcctggagcgcctcgccagggggtacggcttccgccactggcgccgcgtcgccgaggagatgcagccgagggagcggcgccgctcgcccaagcagtgccgcgacaggtggcgggaccacctcgcccgcgacgtctaccaccgccccttcaccgccgacgacgacgccgagctcgcccacctccgcctccgcggcggcggcggcgaccggtggaaggacatcagcagggccgcccactgccgcacctcgcgcgccatgaggcgccggtggagggagctccgcaagagcgacgcgttcctcagggcgctgtactggcatcccgaccagccggtgccaccgctacttgacgacgcgttgtcgtgcagcgacgtcctcgactccagcgtggcctcctaccgtggtggctgcgacgccgtggccggcggcggcacgatcgttgcaccagggttcgcctgcttcgccgcatag

SEQ ID NO: 5338 - DNA, 1369 bp, Oryza sativa; identical to SEQ ID NO: 2295
  Predicted polypeptide sequence is orthologous to G207, G227, G230, G242

SEQ ID NO: 5339 - DNA, 402 bp, Oryza sativa
  misc_feature (195)..(195): n is a, c, g, or t
  Predicted polypeptide sequence is orthologous to G207
tggagtcacgcactattctccgactccatccttcgatttcctctcagctcgcccccagtctccctctcggcttcttcattcaccaccctccacaactacaaccatgcgagcacggagagcagggtgctagcgaacatgactgcagtgacggcgaccatcgattaggagcggcctccggcgatttaggatggcggngaggatggcatcgaaataaggaccaaatcccatcgacgagcaaacccgctgcttgattgctccatccgtcactggccatcagctcagccacctctctgcctcgccccctccctctctcaccctccacatccagccactgcagagctctgagacatcccctgaagccgagagatggccggctcgagcggaggcgcaagggggcatcca

SEQ ID NO: 5340 - DNA, 616 bp, Oryza sativa
  misc_feature (424)..(424): n is a, c, g, or t
  misc_feature (450)..(450): n is a, c, g, or t
  Predicted polypeptide sequence is orthologous to G211
ctgatcgccgggaggctgccggggaggacggacaacgagatcaagaactactggaacacgcacatcaagcgcaagctcctcgcccgcggcgtcgacccgcagacgcaccgcccgctcaatgccgccgccgaccaccaccagcagcagcagctccaggcgccacggcggttcgccgccgcgccagccggccaccaccaccaccaccctgaccatttcgccgtcctctccaactcgccggaggcctgcagccacagcagcgacgacgagcccagctccgccacgccgccgccgccgccgcgtcacctcggcatcgacctcaacctttccatcagcctagctccttaccagccgcaggatcagaccagcgagccgatgaagcaggaggaggacgacgaagcgtcagcgacggcgaacggcgccggcnatgcagcgatgacgacgacggcaacnacggcggcggtgtgcctgtgcttgaaccgcctcgggctccacggcggcaaggtgtgcagctgcggaagcggcggcgccccctccatgcaggccagcacacacatgtttagattcatcacgccgcctggaggaagccaccacaacagtagtagcacaaccatgacct

SEQ ID NO: 5341 - DNA, 1031 bp, Oryza sativa
  Predicted polypeptide sequence is orthologous to G211
aagctagctcgcgcgcaaattaatcgccgatcgatcctacgatgaagcggaagcggccggcggcgctgcgcggcggggaggaggcggcggcggcggcgctgaagcgtgggccgtggacgcccgaggaggacgaggtgctggcgcggttcgtggcgcgggaggggtgcgaccggtggcgcacgctgccgcggcgcgcgggcctgctgcgctgcggcaagagctgccgcctccggtggatgaactacctccgccccgacatcaagcgctgccccatcgccgacgacgaggaggacctcatcctccgcctccaccgcctcctcggcaaccggtggtcgctgatcgccgggaggttgccggggcgcacggacaacgagatcaagaactactggaactcgcatctcagcaagaagctcatcgcgcagggcatcgacccgcggacgcacaagccgctgacggccgccgccgatcactccaacgccgccgctgccgtcgccgccacttcttacaagaaggcggtgccggccaagccgccgaggacggcatcctcgccggccgctggcattgagtgcagcgacgatcgtgcccgaccggccgacggtggcggtgacttcgcagcgatggtgagcgccgccgatgccgagggattcgaaggaggatttggcgatcagttctgtgccgaggatgcagttcatggtggcttcgacatgggttccgcttccgccatggtgggtgacgacgacttctcctcgtttcttgattctctgatcaacgacgagcagttaggcgatctcttcgtcgtcgagggcaacgatcacgagcatggcaatggtgagattggtcatggagacgtcatggaatccaaacagtaatctttcgggagattgatcagggaataagttgaccatgagaaaacatgtaagaacagcttgtctgctgagtcatgaccggtgatgtgtatgtgatggaagaaaacgtatgtacgacttaatgcttgcacctatactactgctgtgtgcattattcgagtgatc

SEQ ID NO: 5342 - DNA, 3237 bp, Oryza sativa
  Predicted polypeptide sequence is orthologous to G214, G680
ggagagcgacccccacctctctctcctctctcctcttccccctcgcggccgcgcagcagcagcagcagcggaagcatccaggtagcagcagccgcgagcgagcagcgaaccgagccccccacatccatccatctcgcttggtttggtttggtttgcagtgttagtggcagcgagatccctttgctgttgttgtagcttcgggaggaggaggaggaggagttgtgacggcggcggaggagagagaaggaggaggggcttgtggtggtggtggtggtggtgatcgatgcagctgctgagccggcggcggcgaggccggtgacgcccgccgtggcggtcgcctgaggccgccgtgtggagggctggggcttgcaggcggagcgaggcggcgagcttggttgggattgctttgcttgctctcgagggcgacggcgcggttgggcattcgttcggtggtggtggtgctcggttgcttcgctgaggatcaaggaagtgtttggccttcgtagaactgcgagttttaatctgattctagagttgaagataacgaaaggagcaagggtgaactctgctgacttggtttttgtgtgcacagaccaactgcagctgaggatttagtagattgactgcaattggatcaattcaagtagaggtctaggaggaggtatgaggtactacttgcgtcaggtccagcgtttggttggagatatggaaggaggagtgcttttgtttgtggaagacctcaactctaactgacaaagcgaccaattgccaacacttctgttatatttcttctttttcttgaattgggaatggagattaattcctctggtgaggaagcggtggtaaaggtgaggaagccatacacaatcacaaagcagagggagcgttggactgaggcagagcacaacaggttccttgaagccttgaaactgtatgggagagcctggcagcgcatagaagagcatgttgggacaaagacagctgtgcagatcagaagtcatgctcaaaagttcttcaccaagttggaaaaggaagctatcaacaatggcacttctccaggacaagctcatgacatcgacatacctccaccacgaccaaaaagaaaacctaacagtccatatcctcgaaaaagttgtctcagctctgagacatccaccagggaagttcaaaatgataaggcaacaatatcaaatatgacgaacaatagcactgcacaaatggcaggtgatgcagctcttgagaaacttcaaagaaaggagatatctgaaaaaggaagttgctccgaagttcttaatctctttcgagaagtcccatcggcatcattttcttcagttaacaaaagctcttcaaatcatggtgcatccagggggctggaaccgactaaaacagaagtcaaagatgtggtcatcttggaaagggattctatttccaatggtgcagggaaggatgcaaaagatatcaatgatcaagaaatggaaaggctcgatgggatacacatcagctcgaagcctgatcattctcatgaaaactgtttggatacctcaagccaacaatttaagccaaaatcaaactctgtggagacaacatatgtggattggtctgctgcaaaagcttcacactaccaaatggacagaaatggggttactggctttcaagccactggaactgaaggaagccatcctgatcaaacaagtgatcaaatgggaggagccagcggaactatgaatcaatgcatccatccaacacttcctgtggatccaaaattcgacggcaatgccgcagcacagccctttcctcacaactatgcagcctttgcaccaatgatgcaatgccactgcaaccaagatgcctacagatcttttgccaatatgtcatccaccttctccagcatgcttgtctccacattgttgtcaaaccctgcaatccatgcagctgccaggcttgcagcatcgtactggcctacagtagacggcaatactcctgatccaaatcaagaaaatctttctgagagtgctcaaggaagccacgctggctctcctcccaacatggcatctattgtcacagctacagttgctgcagcatcagcatggtgggcaacacaaggtcttctccctctttttcctccacctatagcttttccatttgttccagctcctagtgctcccttttccacagcagatgttcagcgagctcaagagaaagatatagactgcccaatggataatgcacagaaggaattgcaagaaactcggaaacaagataattttgaagctatgaaggtcatagtgtcttcagagactgatgagagtggagaaggagaagtgtcgctccacactgagttaaagatatctccagcagataaggccgacaccaaacctgccgcaggagctgaaacaagtgacgtttttggaaataagaaaaagcaggatcgctcttcatgtggttccaacacaccgtcaagtagtgatatagaagcagataatgctcctgagaatcaagaaaaggctaacgacaaggcaaagcaagcatcttgcagtaactcttcagccggtgacaataaccaccgtagatttaggagcagtgcaagcacaagtgattcatggaaggaagtttctgaagggggtcgtctggcttttgatgcactgttcagtagagaaaggcttccccaaagcttttctcctccgcaagtagaaggatcaaaggagatcagcaaggaggaagaagatgaagtaaccacggtgacggttgacctcaacaagaatgccgctattattgatcaagaactcgacacagcggatgagccaagagcttcctttcctaatgaattgtcaaacctgaagctgaaatctcgcaggaccggtttcaaaccatacaagaggtgctcagtggaagcgaaggagaacagggtaccggctagcgatgaggttggtaccaagaggattcgtcttgagagcgaagcatcgacatgatttgctttccacctggttgctggcctctaccaagtcagaagttaaatttacatccgagctaccataggacttcagaccttccaatgcattacctcacaaactcaatttattgtgtgttgtatcttaatgcttgccaagcagctcctatagactgcttttaaaccgtatctcatagacttttgattagcatttaagcgactgctaaactttcttcataaaagggtattatccttattatgcattatagtctggggaaggtaataagtgg

SEQ ID NO: 5343 - DNA, 3483 bp, Oryza sativa
  Predicted polypeptide sequence is orthologous to G217
gccactccccctccccctccgccgccgccgccgccgccgcccatccccgcccgcatccgcatccacatccgcatccttcccccacctcgatccccgccctccacttagccctagaacccactctgcccgccgccccggcgaaaccctagcagcctcgtccgggcggggcggggggtgggggtgggggaggggagaagcatcgggggccctccggcgaggaggagaaaaccagcttcggggaggtgagcgaaggagaggggaggcaagatgaggatcatgataaagggcggggtgtggaagaacacggaggacgagatcctcaaggccgccgtgatgaagtacggcaagaaccagtgggcgcgcatctcgtccctcctcgtccgcaagtccgccaagcagtgcaaggcccgctggtacgagtggctcgacccctccatcaagaagactgaatggacaagggaagaggatgagaagttactgcatcttgctaaactcatgcctacgcagtggaggacaattgcacctattgttggtcgaacaccatctcagtgccttgagcgttatgagaaacttcttgatgctgcctgtgcaaaggatgagaattatgagcctaatgatgatccaaggaagttacggcctggtgagattgacccgaaccccgagtcaaaacctgcacgtcctgatcctgttgatatggatgaagatgaaaaggagatgctttctgaggcaagggctcgcttagctaacaccaggggtaaaaaggcaaagcggaaggcaagagagaaacaacttgaagaggcaaggcgacttgcctcactgcagaaaaggagagaattaaaggcggctggtattgatacacggcagaggaagagaaagagaaagggtatcgattataatgctgagattccttttgaaaagaggccgcctccaggtttttatgatactgttggtgaggacaggccacttgagcatgtacagttcccaaccactattgaggagcttgaaggtaagagaagagtagacatagaggcacaattaagaaaacaagacattgccaggaacaagattctccagaggcaggatgctcctgctgcaattatgcaggcaaatagactcaacgatccagaagctgtcacaaagaggtccaaattaatgcttccaccaccccaaatctctgatcatgagctagaagagatagcaaagatgggtaatgctggtgatccttctttagttgaggaacttggcgaaggtagtactgccacaagagcattgctttctagttattcccaaactccaagacttggaatgacaccattgcggacgccacaacgaactccagctgggaagggtgatgctattatgatggaggcagaaaatctagcgcgtctaagggagtctcagacccctcttttaggaggggataacccggagcttcacccatcagatttctctggtgttacaccacgtaagaaggaaatgcagactccaaatccaatggcaacacctttggcaagccctggccctggtgctactccaagaattggaatgacaccctccagagatggaagttcttttggtttaactccaaaaagtactcctttccgagatgagcttcgcataaatgaagaggtggatatgcaagatactgctaaacttgagcttcgtaggcaagctgaattgagaaaaagcctacgatctgggtttgcttctattccacagcctaagaatgagtaccagatagttatgccacctatcacggaggaggagaaggaagaagctgaagagaaaattgaggatatgtcagacaggcttgcacgagagagggctgaggaacaagcaaggcaggaagccttgctcagaaagagatccaaagttttgcagaggagcttgccaaggccaccggcagcttctatagaaattctccgacaaactctaattaagggtggtgaaagcagaagcaggagcaccttcgtgcctcctacatcacttgaacaagctgacgaactaataaatgaggagcttcttcggctccttgagcatgataatgctaaatatcctctagatgagaaaactcaaaaggataaaaagaaaggaagcaagcgccaggcgaatgggactccttctgtacctgagattgaagattttgatgaagacgaattaaaagaggccaattctatgcttgaggaggaggttcaataccttcgtgtcgccatgggacatgaaagtgaatctttggaagattttgtgaaagcacatgatgcatgccaagaggaccttatgttttttccaaataacaacagctatggtcttgccagcgttgctggaaattctgataagatagctgctttgcaatatgagtttgaaattgtgaagaagagaatggatgatgaagctaagtaggcttcgcggcttgagcagaaaatcaagcttctgacacaaggataccaggtacgagctggtaaactctggtcacaggttcaagatacattcaagcagatggacacttcagcaacagagcttgaatgctttcaagagctgcagaagcaggaacagatggctgcatcttatcgtataagaaatttgactgaagaagtaaacaaacagaaagcattagaacggactctccaaagccgctatggtgatctgttaactagttacaagaggatccaagagcagcttgaggagcataagaggcaactgatgatacaggaggaaatggaagcacagaagcgtgctcaggaggaggaggaaatggaagcacagaagcgtacgcaggcagaggaagaaaaagaagcggcgaaagctgaagaggaagcaagaaagatggatagggctgctgatgaagaagcggcaggaagcaaacaagtcaatgaggatcagatggatgttgacaactctaatgctgatggtgatgaattcgtaggtccgattcccccaggaccaggtactcaaggtgacgacaatgtggtggcggtcgaagagaactctagctcgcagagcggtgatactgctaccacggaagatggatcttgtggcatgatcgacgcatcaaaatcaggaggtcaggatcacatcgacagcaaggatgaacttcccactgttggtgccagtctagatgatggaagtgctgctgcatcttctgatcaagatgtctcaactgaggtgaatgccactgtccctgaatagaatgtcatttcttgtacttcatcttcgagggcggcacagagaaagctaagagggacggataccttgagagaaaaaaaagaagaggcaaattgaatgtccaaagctgtgcactgaatttttattcgctgcttgattgttagtgaacgacaaaatgcgggactaagcttgttgtacaatgttaattttgtcaattcccatcgaggactctcagctcttagaattgctacgaaagaatgttagttcgatgtactatctgagaaattgaacttgaaaaaagaaaaaagaaacaatgccgat

SEQ ID NO: 5344 - DNA, 1074 bp, Oryza sativa
  Predicted polypeptide sequence is orthologous to G222
atgggaagagagtcggcggcggcgtgctcgccgaagccgaagctgaggagggggctgtggtcgccggaggaggacgagaagctgttcaaccacatcagccgctatggcgtcggctgctggagctccgtcccaaagctcgccggattggagaggtgtggcaagagttgcaggctgagatggatcaactacctgaggcctgatctcaagagaggcagcttctcccagcaggaggaggagctcatcatcagcctccataaaatccttggcaacaggtggtcccagattgcggcgcagctgcccggccggacggacaacgagatcaagaacttctggaactcgtgcctcaagaagaagctccggcagcgcggcatcgatccggccacccacaagccgctcaacgacggcggcgccggcgccggagaagagcaccacgacgacggcgacaagcagcagctaatggacgacgtcgacgactgcttcgccatcggcggcggcgggagcagcgactccctggcgccgccgcactcgccggccgtcagcttcgacccgctgtccgtgaccaacgtgccgacgacgatgatgcagtcgtcgtcgtctccctacggcgccgccggcggcgagcactcgtcgttccggtcggacaccctctgcgactacggcgggagcggcggcggcgtcgacgtcgtgtccgacgccggcacgtacagcgcctacaccggcgacagctccagcaacagcaacagcacggcgtggacatgcggcagcgtcgtcgtcggcggcgcgggcgagctgccgccgccgccgctgctgccgcacatggacatgttcggccgggtcgacgccgagccgccgccgtacccgccgttcgacgtccaggccaggttcagcccctggcaccaccaccaccaccaccaccacgagccgacgctgccgacgccgccgcaaaggctggacggcggcggcggcgccgcggcgagcttcccgatccggtcgctgtcgcgggacatgccggagtcctgcttcgacctcggccgcggcgcgctcgacgacgagttcggcgtcgacttcctctga

SEQ ID NO: 5345 - DNA, 1514 bp, Oryza sativa
  Predicted polypeptide sequence is orthologous to G222
gacacagagaagaggagtactaggtagagagacgcttggctccgtggctcgttggttgattgcttaaaggccacttgatcgctgctcgatctgctgcctccctcgcgcgcgcgcaccgtacgtgtgtgtgtgcagtagttctcggcacgcttccccatatataccccctggatcgggcgcccagccggccgcctcgatcgacagagagatcgatagacagatacacgccggcaagggcaacgaacccagcggcaggtagctgctcgcgtgtcgggcgggaatgggacggcacgcgtgctctgccgccggtgtccagcagaagctgcgcaaggggctctggtctcccgaggaagacgagaagctctacaatcacatctaccgctacggcgtcggttgctggagctccgttcccaagctcgcagggctccagaggtgcggcaagagctgcaggctgcggtggatcaactacctgcgccccgacctgaagcggggcagcttctcgcagcaggaggaggacgccatcgtcggcctgcatgagatcctaggcaacaggtggtcgcaaatcgcgtcgcacttgccggggaggacggacaacgagatcaagaacttctggaacagctgcctcaagaagaagctgaggcagcgcggcatcgaccccagcacccaccagcccatctccacggctgctgctgctgcggcggcggcattggacacgtcgacgcaggaccagaagccgccggccaccgccgacggcttcgccctgaagcagcagcagcaggtgttcgacccgttcccggtgatcgacagcttcggcagcgggttcgacgccacgggcatgccattgtacggccacctcggcggcaaggacgcggccgggttcgtggactacagcagcgtgcttgacgtgtcggagaacctgggctacggcgagagctccagcaacagcagcaactggaactgcggcgtgggcgcgccggaggtgaacaatgcgctcgagagcgagccgctgcattgggccaccgagagcaaggtcgagcctttcgtgggctacggcgagggggacgccatggagcacaagttcgggctgccctgccatgggcagcaagagcagggcatgacacatttcgacttcgacgtcagccggagcatggtggtcggcgacttcaacttcgagtacttccgatgaggttcttgtgaattaagccattatcgtatatacaatattcttccaaggcattttacacagagggcatgaccaaccgggagagtagagactgtactctgttaattttcactagtccatactccttaattaacacctttttatgatttctgcatgggtaaaaatataaataaagggtatagaaatgtgaacactgtgtagttaattactactatgagattttgtaagaataattaagtttcttacacttgtactctgtaagttgctgccactgggaggactgtgtaacgtgtattcctctcctgaagaaggaacaatcaaggttctcact

SEQ ID NO: 5346 - DNA, 2638 bp, Oryza sativa
  Predicted polypeptide sequence is orthologous to G224, G1466
gggagaaattccccaagccgccgccactaaccctagcttccgccagcacgggtgcagatcaagttccaaatcaacctgattggtcctcaactttgagggtaacatgatgcgagacagcaagaggacgaggtccgcaccacccagagaaccactggaaatgacagaggacatgaccccaagaagcaagaggaggaaatttgtaccattcggagaaggtgcggtgctacctgaggagatgctgacggaggtgttcctacgactgcccattaaatccatccttcgtttccgggctgcctgccactccagcaaatttcaactccactgcggtgtacacgtgctcgccatcgaagcccattgatgacctactgttcacactcgatgatgcgcgtggaaactatgtggaagtggcaccttcaccatgccatggcctcaccctcctgtataatgctgttgcgccagcttactacgtcttcaatgcaactacacgggcaatcacacggttgccaccttaccaagatgtgattcatgccactgctggcgttgggtttgatgcccggacgaaggagttcaaggtggtgaggctttttcgaggaaaatcgcatgagatccattctgtaaagtgtgagatattcattcttgggggtgaggaaggggatcattggaggcctaccgctggtggagtacctttcaggttctgtagttttgctctttctgctatccgcaatgcagtggcgaacaaacttcagccagtttttgttaacggatttctccactggttgatcaacccctcgtttttactcaaagcaccaagagctgctatcatatcattttctctcactgatgaaaccttcagatggatccgatcaccaccctttgaggtatccagagtgcacttggctgagcttgatgatcagttgtgtatggtccgagaccttcgtaatggcttgcctactggtagcatgtttgaaatttggaggctgaatgactataactctggtgattggtcgcttgattaccgaattggtttgacagggaatttgccaagagatttacttgagccacgaattgtgaaagttattggttcctttggtagctacagatcaagcaagaagataatcatcgctacatctaagcacaaggtgtgtgcctatgatccagtttctagaactcttgaaaccattgtctcaatcatggtgacctgcagtgcctatcaaaacgagaaatctgatattagattcagttcatttacaaagagttttaccccagtgcataggacgaggaaagagatagggttctctactcccttgtctaaggctactaaggagatcctactccgattaccagctgaatcaatcttgaaattggaacttgtttgtaagcaatggcgtggattgataaagaatgaaggttttgttcatgcatactttgagcataagaacatggacaggaggccaaagatcatgcttgtgggtaagggctctgaaaaatcagttttcaactttattcccttgagtaaatggctccaagaggcaaatctaggcacaatgtttctggacaaaaaggtggtttgctccaagccttgccatgggttgaatctggtgagcattgagatgaaagactatctgttcaacccgtgtacaggttaccgcatgatctactagaacagagaccatcagctgtaccaggaatggtccaatttgtctagtgatcgctgcaaagactacaatccttttgtagttggcaataagaatgttggtatggggttttgccaggtgactcagagtcatgccgttgtgggaattttctattactggaaaaactacgaatctcatcagtattacttaacatgcattatatggagttgtagctcccaaggccagccactccccgatccacctctgcctgtgaatgacatgccacctgtttctctggatggtgtgctgtactggatgagtgaaccaaggttgggtcagagttatgagcgggccattgtcttttttaacattgccgctaagatttttgatgttatcccttgcccttcatgcattgcaatctgggacagcagaaatccatgtcacgcatttgtggtcgagcttcagggaatgttgtgtgctgtcctttcaaatccagttgcagataagttagatatatggaagtgggatcatggtctgtggagtatagcatatgcaatcaatttaaaattctggccagattattcccttgcgacaaatgttgtagtgcctctcgcagttgacccaatagatggaaaggttctactgaatactgggaggaagcttggtttatataatccatgtgagcaaacaatcgaaaacttgcacttgatcaggcgtcgcagcaacagaaccctggagttaacagaaatttccacattgccagatgccaagatgttcctaagaagttctctcagtggaaactattattggctccgtgcgagaagtttgctaacccttcaagtgcttcatcagggaagaatccattttactccagagaccaatctaaggagctaaatagtgtgagtcaaaaaattatgcctctggttcctatgttgtacgaggagggtttagcttactatcctacaactactaaattgagagtattgtgcgattgaagtgttgcc

SEQ ID NO: 5347 - DNA, 1645 bp, Oryza sativa
  Predicted polypeptide sequence is orthologous to G224, G1466
agacacatcccggcgagagacgagagacggcgccaccaccgccgccgccgccgccgtgctggactccggctggccaccgcgctccgctcgaggcgtccgcgatggcgtccccagagccgtgcgccgccgccgccgcaccgggaagcgggttcggagccgtggacggcgtcctgcccccggagctgctgctcgaggtcctgctgcgcctccccgccaagccgatctgccgcctccgcgccgtctgccgctcgtggctgtccttcaccacggaccggctcttcctcgccgcctacgccgccgtccaccctcacccgctcctcgccgtcttggttgacagcttccccagtcgatgctgcgttgatctcgtggacctgtccggcaacgtcgtcgaggagatcctcggcgtgggcggcgagtgcagggtgctgacggcgagctacgaccgtgtcctcgtcgccggggagcaccaccgcgtcagcgtgctcgaccccgccacaggatccgtctccgccttgcccttcggcattgcagaggatatggtgcgtcgcaacgggatgaggccagcctggtttgcatttggtcagacgaattccacaggagagtacaaactactccggattctagaggacttggaggatggatatgaggctgatccagtgtgtgaggttttcgcaatcggcgacatgaatggacggtggaggaagatggagagtccaccggggtatcttgatccgagctgcaccaatggagttgtcttcgaaggggctgcttacttcttcttggatcactggcaaatggatccctcctactattttgctacgggctgcataccttccttcgaccttgcgacggagcagtggagcacggctctccaagggccagtaaacagaattcttgaggaagcgaatggcacactcaactatgctgaccttaccgatcgtcttatgttagcccaacttgaaggaactttgtgtacagcacatttcaatgatcaaatttctgcggtggacttatggtttctagttgattttgagaatggtatgtggtccaaagaatataggataaatgttgaatttgcttttgatggttttggagatggtgtgcaacctttgcttgtgacggatgagggaaatgtggtactttgggtgcagataggatcaaaagggatggtctggatttataatccagtaaccaacacttcctcagagatagttcagacaaaggctagtatctttactggagtaggtgtatatactggaaatcaattatgtccacagagtatgtgacaagaaatggaagaagtgccaaaagaagaggagcaaaaccgatgtcaggactggtgtgattgcatactggagaatttgaggccgctcctgaaaactataacactcttggacaggctactgtcgtgcaagctactggggtgttatttttcttggttctgcagatggttcagttatgcagctagtgaatagtttttggacctgtgggttgttccatggtattttctacctaaaactggaatccacagtatgctgcttttaattattgtttgtgaatctctaaagaaatccctgtccccgtgttggctttctttcaaagacggatcataatgatatcggttccaaaaaaatgttttcggttc

SEQ ID NO: 5348 - DNA, 1262 bp, Oryza sativa
  Predicted polypeptide sequence is orthologous to G225, G226, G682, G1816, G2718, G3930
agagaagggccctagaaaacataaggtcataacaagggtctgaggatcttagctagcacaagatctcaactcggcatttcattggagtttttcacgcctaatggatagcagcagtggtagccagggaaagaattccaaaaccagtgatggttgtgaaacaaaaggtttgcatatcttgaatttctgtttgtttcctgttagccttttcacctttgcttctcttaacaataggtatatagctttttcatttcctaattcctatcatcatgttcaataaggaaacaaatgaagaagtgtcatttagttaatacctagcgacatttaacctgtatattgtcatattctgcatcttgatgctttacttgattatgtcaatggagaaaacaaagagaaacgagaagtcaggaagtaatagtcagagcatactcgcaaagtagcaaggaactttgtaactacataaactgcaagaaagtatacatgcaaacttgataatcagttgcctatcatcagtcctgatagctaataggaacagattaacataatgaataaggcatattccagctttgtttacttccaggcttccagcataagaataaatccccaccagggcagattgcaaattctaatggaggctagtagtttgcaaaatatttgagatggttggctactgagttattttgcttattttggtgaccagtttttttaataaattttgcagaagttaataacactgcacagaattttgttcatttcacggaagaagaggaagatctcgttttcagaatgcacaggcttgttgggaacaggtatcctaatacacatattacatatctgtaatgtgcatcaagtgaaaatgaagacaaattgtatttttacattattagcttgtactatgattgtttcagaagtttggcaaattcatgaaacccatatgtctgtttcaaaaaaatacattatttgcagttccctaactttgctccttgtatggagttatgcaggtgggaacttatagctggaagaatccctggaagaacagcaaaagaggtagaaatgttctgggcagtaaagcaccagaatacataaggggggaaaaagggtgtatgccctaaaagtagcgtacaatttagaagcaaacttttttagaaaaggatttaggccctaaaagtaggctataatttagataaattgtgttgcctcagtcttatgcctgatgcaaaaggggaggaaaaactgaatgcaaaattaatgtgtttattccatag

SEQ ID NO: 5349 - DNA, 410 bp, Oryza sativa
  misc_feature (241)..(241): n is a, c, g, or t
  Predicted polypeptide sequence is orthologous to G226
tacgcagttcgatgcaaacgatgctcattttgacccgaaaagcgacaaaaacaaccctaagtggttcatggtagatgtgaaatacgaacgcgatttgaaacggtttatcccgttgtctgagctaaaacattattatatggagcacaagaaagacggacaaaaaggcccacttgctaatttgtcgctctttactcgttcacggctttctgtgcagtcgattagccagaaagaatgggatttnatcatcgaacttgagaataaacctccgattaaatagctttacttatcctttaatgatatattttgtacttaagattcaatgtttctgaatttatattaaatattttttatctttatttaatttttttcaaataaataaataatacaatttgtaaaaaaaaaaaataaag

SEQ ID NO: 5350 - DNA, 1217 bp, Oryza sativa
  Predicted polypeptide sequence is orthologous to G229
ccagatcgctcagtctcacaccgcacagagacagagaagagctctagagagaacgagagagagagacagagagagagagagagagggagaatggggaggagagcttgctgcgcaaaggaagggatgaagagaggggcatggacgagcaaggaggacgacgtgcttgcctcctacatcaagtcccatggcgaaggcaagtggcgcgaggtcccccaacgagctggtttgaggcggtgcggcaagagctgcaggctccggtggctcaactatctccggcctaacatcaagcgcggcaacatcgacgacgacgaggaggagctcatcgtcaggctccacaccctcctcggcaacaggtggtctctcattgcaggcaggctgccgggccgaacagacaatgaaatcaagaactactggaacagcacgctcagccgcaagatcggcaccgccgccaccgccgccgccggcagccgcggtggcagcacgccggacaccgccagagcgacggacgcggcgtcgtccagctccgtcgtgccgccgggccagcagcagcagccagcctcccgcgccgacaccgacacagcaacggcagcggcggcggcggcggcgacgacgaccaccgtgtgggcgcccaaggccgtgcggtgcacgcgcgggttcttcttccacgaccgtgaaacggcgccgctcgccgcggcggcgccggcgccggcaggggaattaggagacggcgatgacgtcgactgcgactactactgcagcggcagcagctcggcggcgacgacgacgtcgtcgagctcattaccggcggtcgtcgagccgtgcttctccgccggcgacgactggatggacgacgtgagagccttggcgtcgtttcttgacaccgacgacgcctggaacttgtgtgcgtgacattagttcgtcgtccgtacgtacctacgtatatgcatgtgtgcgtctcatagaatgaatataaaataatattttctccatctattttaagtgcagttgcgggtttccgtatataaaattaacgattttgctatatatttgtcgataaattttctcctaaaaatttgacagatgtaattacagtacaatcgtagtataattacactgtaactttcatgtaattacactgtaactatagtgtaacttgtatgtaactttcaaaaatctctttgtaatatgttatttcggtaaaaaaaaaaaaaaaaaaa

SEQ ID NO: 5351 - DNA, 795 bp, Oryza sativa
  misc_feature (102)..(102): n is a, c, g, or t
  Predicted polypeptide sequence is orthologous to G229
gacaaagctgggtaccgggccccccctcgagtttttttttccttttaagttagacttgcagtgtaagctctggacagcttccctacttacgatgttaatacnctttgtccacaaattacaagacgacattactgaactgtcagctatgggtcaagataagatgagtttcacattgcctactatatttaccaattatatttgagcagctgaaccaaggctctataaacagtaatccatcagcagagactatgggttgctattgatggggtaaaagtaagaaccattagccagatttctgcgctatcagactataaggatccaggctcacctccagataagaacttatgggcccaagcttcaaggtactccctacccatgttcatgaaaaagcttcgatgcacttcaaactctggtttacaaaggcaaattccaactgagagtctatcagcaggtgtcagtgggatttctttcagcatgttccatagaggagcatttgggtccgatgatgtcggtgctgctcgtattggttttgcaggggtgtcatggatcccagctaaggtactctttaccatatccgccttcctgccatcatgtggcacgggtgcctgcggttttgggtttggggttgtttttgttctgctgactactttgcacttcttcaatccaggcttgagagcagccattgtgctctcagcaaaggatccagatggctgggcagatggtgcactagtgtcagacatcacttcacaaggcactgcatcactacttgctgccacctcatgacagtcatcttca

SEQ ID NO: 5352 - DNA, 1372 bp, Oryza sativa
  Predicted polypeptide sequence is orthologous to G229
ttgcatccctatagttgttgtgccgggccaacccaccgtgcctagggtgcagcccaggcatggcccggttgttggatctggctagtacgggcacgaccccagtcgggtcatgccatgtttgggctgggccaaaatggcgtgccttgggccgggccatgggcctcgggccatatggccatctatacttaaaacttgtttactgctgtagatctgcaatacgtagcgaaccaaaacttttgtgttgttcttttctttttcaaatttggtcgaaattgcttcaattttaaaaacttggtaagacttgtatggaactatggatgcagatggtcgctgatagccgggaggctgccggggcgaacagacaatgaaatcaagaactactggaacagcaccctcagcaagcgggtcgccatgcaacggaccgccgccgccaccagcatgccggcggcggccaccaccagcagcaatgccgacgccgccggcgctgctgcacgacgccggcgatcgccggagccccgcacggtcgtcgtcagcccaatccggaccaaggcgctgcggtgcaacaacaacagcagcagcgggatagtggtggtgcagcaggcaggcgcctgcagccacggcggccgtccgccggagagcggcgcgccgggagacgcggcggctgataaggtggccacgccgcaggcggtgcagcagcagcagcagcaagagctggccggagcggaggatgacgacgacctgccggtgccggccgtctgtatcgaccttgacttggacgacatcgagctgggaggactcgacggcttcctgatcagcccgtggcgcggcggcggccacgacgacggtaacgccgccgccggagcggtgccgaatctgccgatgccgattggctatgagctcggcggcgccggtggcggtggcgaggctggagctgttgacctggaggcgttgctggggcagctggaagcagaggaagacgacgacggtgaccaccaccaccaccaccaccaccaccaccaccagtaggaggaggaggtgccttcttcgcttggggacgaagacgacgactacttggagttcgcgccatggctcctctgatagcggcatccatccatggatcattgtggaatcgaatcagtcgagctgagagttgagagttgagaaagatcgatgattgctttgctggtcgtgtgttcctgcgagtcggatcatcggcacgaagagagatctcatcgattaagtaggcgcggaaggcgtacgttgaagcttagctgctgaagaattactgacgtagtcagatgaccatttccttatatattgtacagattataatggagcagattaaataaatctaaacacaccgcatttgatc

SEQ ID NO: 5353 - DNA, 954 bp, Oryza sativa
  Predicted polypeptide sequence is orthologous to G229
atggggagggcgccgtgctgcgagaaggtggggttgaggagggggaggtggacgaaggaggaggacgagaagctggcgaggtacatacgggagaacggggaaggggcgtggaggtcgatgcccaagaatgccggcctgctgcgctgcggcaagagctgcaggcttcggtggatcaactacctccgggccgacctcaagagggggaacatctcgccccaggaggaggacatcatcctcaacctccacgccacactcggcaacaggtggtccctgatcgccggccacttgcccgggcggacggacaatgagatcaagaactactggaactcgcacctgagccggaagggatacgagttcctccgcggcggcggcggcggcgccgtcgtcgacgtcgacctcagcaagttgcccggcggcgggaagcggcgcggcggccggacgggccgcagcagcagcgggaaggagaagacgaggacgaaggagaaggacaaggcccccgctccagaagctgcgcacaatgacgacggcggcggcggcggcggcggcggcattgacaacgtctcggcagctagccacagccacagggaggagcaggcacaggcgagcgccagtggtctcacatcagatgggctcgaggagggcccactgggcctaagcgaggagatggtgagtgggcccgtgggaccggtgagcccaaagcctgaggtgggccaggatgggtcttctgcagagagtggctgctgtgggcctagtggatccagtggcccaaccgaggctgtgggccaggacatgggcgacaagtccatggactgggacctggtgggcctggacgatggcttcgccaacgatgacatgtggggctcactctcctgggactacggggagttggtgggcccggatggagttcatcagggcgaggtgctatccgacttgttcttcttgggcaacctgtag

SEQ ID NO: 5354 - DNA, 4669 bp, Oryza sativa
  Predicted polypeptide sequence is orthologous to G231, G2007
ggtcttcctcctcactcacctcgcgtcccttgcccccacggggtcggtgatcacagcgccaagacgagagcaaaattctcatccgggagggacgcatcggggaggggacaggtcacaggttgaggttgcaatcggggggcgctcgtgcgcggggcagcattttgggttcactgtcgcgtccatccccatgctgttccccccttcaggcgcagcagccgcgtggaaggtcgctcgctggtggccacgggggaatcccctgatgcgaggtcgtcgtcatggagacatccgctgctggtcagttctgttcctcaccaaggcggagcaagctggaccaacccgattaattggctcgtgtagaattaacttgacaatttgactgacatggatgatagccatagtggtgtcccatttaagccaaattattggttaggacagggccaagtaaggttttgggtgttttatgagtgagatctgacctggctgggtttagatcatcctcttttagttcgaacgcccaacaggcaacaacaaaggcgtgatgtagcagcatataggaactactaataagcaaactaacaagttcagatgataacggcgattggctaattttggacccacggtatgtagtcattgcttgagaaatcgaacttactcggccccaaaatcctggacattagtttaagatcttatggtctaagcgtcgtggaatgacatacgatgcttgattgaaaaggaagatatgaatccactcggtcttgctagctaccaatgatttcctagatcccaatatcctgtggcagtgaaattaattggtcatatatacatacatatatatatttctactgtatcatcgtacaacttgcaggggtagttagaactcgtggtaaattattccattgtctcatcatcgtagcttgttgttttgaaagagttagcctagttagattagaacctttctggatataacttctcaccattcatggtcatatttcagaatcaaaccccatgaaggcataggagtagtgcgccaacttctgtatgattcctgcagagacaaatgaattgaattgttccaatagaatacgctctgtctgtcaaagaaaaatactcatgaataatttagtaggcactagaagttacattttcctggcagttcaatattccagttgattgctgcagtctgtgcctttacgtgaacttgcgataagtcactaagtctgtgcctttatagggatgtcttactgagggaacctgtattcaagatgcaagaagctaggagtggagaactagatgaaacttgaccttttcctacctaatccattacgctataatcaaactcagattggattacgcgttttccagctgcaaagttgataatccaggttgttattcagtggatttagctgattggaaatgtcggacctgtttcaattatatttgttgaatttttctaactgatcatgaactgaatccgtttggtccgatattaacctgaagctttaggaaattgctgtacttagctgctcgatattgtattttaatcttattactcttgttggtaagtacataagcactagatagtagttgctgctatgttatccatatgagcatatacattgactggcagaaccttctagagttgtagggattaaacccctgacaattgagagcatgaacgtaatatggtttgaaattcaaaagataggactgaacatatttttatataacatggttcaggaaattagttacatgaagacacctcgttaaagtacagtttttcctttcaaatgaccgctgaaaataaaacagtaaaatacgtatgttaaaagacacgaatattagggaaggacataatgtcaaataattagaagaggtgaagcttcgaacccaggtcgtctagcccaccatcttgtgacgctagccggaagaccccggggtgtttttcaaaaaaaaaaaaaaaactgtgttaaagtacagtttttcctgtcaagtgaccactgaaaatagaacagtattatcaattgattattgcctttcattcatgcaatcaacatagatgtggggttgcaaggaattaaacatatttgaaatgcacaccttgcttgtctatgtcttagatcttgtggtgtaagtcttggaagacaggatggaattgacctaccacctagaagaatctcattcttatagtgccatcagtactgaaagtaatgtttccttctcattattcttttttgtaaatttgattgtgcaccacatgtaaaaatgcatgatgattttggccggttattcatgctcttaagtttgttgtctttacccttcaaaagagtatgcagtaggatcgtcaatcttaaattcaaaatggaaaatctcgttcagatttccagtgcttcattatctctgcgaatcactagtttgtgttaaaattgctaatttattatatataattctatattattaaagggtgtctcactctgccactctctgtttgcttcttctgttccttgggtgaaattttgaattttagtcattagtctggacaagtggaaactctcatgtctctatttttttcccacaaacactcatctgtctatttgatttacatttggtatattcatattttcactatgctcaagtacctttctcatactaagaggtccactgttattcattgactacggatcttgacaaagcaaatttatacactgtatagtctacgcaggctaatccagcaaaacccatattatatggtggcaaaataacactgtttctttctcactccagatcagttctattagctgaaagaatctattaaaacgtccatcaatgcaaatagcattctagcagtccagcatttcattgccaacatcagataccttattaccattagtatctaaataggttcgtatcctacacaagattacatattcctgggatttgccaagatatgatttagactagctcatgatctgccacattagttgacacatttggcacaaaatatttgttgagagttaattcccacttcaattttctgaagcgcagaacactgatttgacgttactttttttgttacagagaacggtcatttcattaccttgtcggagaatcagttatatacctgcagatggttacttttgtctgttgacgtcattcctgagcagaaataagcacatggatgtctggcattggttggattgccaattttaggatgtcaattagtactacagtatgcaggttctatggaggtgttcgctaagtatggctgatatgtcaccttgtttctccgtggttcttcgcaccttccaacttcgcatcaagtaaatttgaacaacggttggccggctgtcttgcctgttaattacagcaagtcaatcagtcagtaactacaggccggaggaaggtgacactctgacggatcgtatcggtatggctgacacgagacgtctggctgcagctgtggttcgtcgagtcttctttcccgggccagaggtcgccgtcgtacaaagcatgtacccgttccggccatctggacacacggctgagcgaggttgcttgctcatggcgaccgtctacgacgtcgacgacgatgccacttgctccgaggaggttggctgggctgcatgctgagcgctgcgagttgcaggcttgcattgcatctaccactttgcatgcctgttctgccggggccgtggttttttgtggctgacggaatggttgatgggatcattgcgtaagggcgcaaccacggcaaggtgggcgggcaggcagacatgcaaccgtggggaacggaagtggcaaagccttcagcgacaccggactgtagcttttgtgtggtggaggagagcgtcgatcgaggaacagtctccaggccgggcggggtgcatgcagcactgcaagtggtggtggtgtttagccttgtgggcgcagctaagtcagcgagctgcctccgtcgccgccgtcgccatcaccggagattaaaaagagcttggagaaggagggcctacctatatatacgcccttgcacccgcaggctccggttgcagccgcgagcggatcgggctcgccgaggtcgacttccccggaggcgatcaccggcagaggaggaggagcagtacgtgtgtatatataaaggatggggaggcagccgtgctgcgacaagctgggggtgaagagggggccgtggacggcggaggaggacaagaagctgatgagcttcatcctgaccaacggccattgctgctggcgcgccgtgccgaagctcgccgggctgctccgctgcggcaagagctgccgcctccggtggacaaactacctccgccccgacctcaagcgcggcctcctcaccgacgccgaggagcagctcgtcatcgacctccacgccaagctcggcaacagatggtccaagattgctgccaagctaccgggcaggacggacaacgagatcaagaaccactggaacacgcacatcaagaagaagctcatcaagatgggcatcgacccggtgacgcacgagcccctcgaccggaagcaggagagcccggccaccacctcgcagtccaccgtcacggcggagtcgtccaagtccggcgaggcgaccaggcagcaaagccggcagcttgacgacgccgtcgtcagggacatgtccgtgtctgccggtggcgacagcccg

SEQ ID NO: 5355 - DNA, 1326 bp, Oryza sativa
  Predicted polypeptide sequence is orthologous to G233, G241
gcagtcgcgtctcacccccatttgccgcacgttgcccaactcctcctcctcctcgtcatcgtctccgttccgatccgcgcccataaatacgcgccaccccgcccccaacctcgccgtccttgtcccccccaagaaccccccgtgcgccaccaccaccaccaccaccaccaccaccaccaccgaggaattctcgctgtcgccgccgccgacgacgacgaggagaaggagtatcgctcacaatcttccgggccgatggggagggcgccgtgctgcgagaaggaggggctgaggagaggggcgtggagccccgaggaggacgaccgcctcgtcgcctacatccgccgccacggccaccccaactggcgcgcgctccccaagcaagccgggcttctccgctgcgggaagagctgcaggctgcggtggatcaactacctccggccggacatcaagcgggggaacttcaccgccgacgaggaggacctcatcgtccgcctccacaactccctcggcaacaggtggtcagccatcgccgcccagatgccgggtcgcactgacaacgagatcaagaacgtgtggcacactcacctcaagaagaggctggacgacgaacggaagctcgccgccgccggcggtggcggtggccgccggccgcatacgcgcaagcagcccaaggcggcaaagagcgccgccgccgtcaagcgcgaggcgacgccgtccgtcagcgtcgacaccagtagcggcgtgacgtgctccacggtgaccgagtcgtcgccgtcgtcggccgacggcgaccaccggcggcagcagcagcaaacgcagcatgccgctgtcaaggaggagagcttcagctcgggcggcgagctgccggcggcggcggcggcgcccacggcagcggccgacatggacgagagcttctggtcgtcgacggaggtgaccgggatgatggccggcctcggcgacatggacgaggagctggccatcgccggcacgtcgtcggcggcggcggcgaggagcgacgacatggagttctggctcaagatgctcctcgagtccggcgacatgagggatttggccgtcttgtaatctatttaatttaatcatggcagaattaagcttgattaaattaattaactaccgggaagaattgatagtatctcttctctgttgtttttttttaccttcttttttcatcttttttttcccagtttccagtgagaaaacgatgggaaattcaggtgatattttcacctttgttagaaaaaggaatactgtagtagtagcaaaaatttctttggttcgttatcagctggcttcagaattagatgc

SEQ ID NO: 5356 - DNA, 1038 bp, Oryza sativa
  Predicted polypeptide sequence is orthologous to G233, G241
gcatcacacagacgacgcagcatcagcaacacacacacacaccgagcaatcaatccatcacacacaaacacaaacaaacgcacagggcgcgagagctcgaacgagaggaggaaaggtcggcaatggggagggcgccgtgctgcgagaagatggggctgaagagggggccgtggacggcggaggaggacaggatcctggtggcgcacatcgagcggcacgggcacagcaactggcgcgcgctgccgaggcaggccggccttctccgctgcggcaagagctgccgcctccggtggatcaactacctccgccccgacatcaagcgcggcaacttcacccgcgaggaggaggacgccatcatccacctccacgaccttctcggcaaccgatggtccgcgattgcagcgaggctgccggggaggacggacaacgagatcaagaatgtgtggcacactcacctcaagaagcggctggagccgaagccgtcgtccggccgggaagccgccgcgcccaagcgaaaggcgaccaagaaggctgcggcggtggcggtggcgatcgacgttccgaccaccgtgccggtgtcgccggagcagtcgctctcgaccacgacgacgtcggccgccaccaccgaggagtactcgtactcgatggcctcctccgcggatcacaacaccacggacagtttcacctcggaggaggagttccagatcgacgacagcttctggtcggagacgctggcaatgacggtggacagcaccgactccgggatggagatgagcggcggcgatcctctcggcgcgggcggtgcctcgccgtcgtcgagcaacgacgacgacatggacgacttctggctcaagctgttcatccaggccggtggcatgcagaatttgccccagatttaatttaggcagagaattggcctcttgggtcgatctcttgttcatttttcttaccaccactattctttgaatctttggagctgtgtaaatctttacaaagcggagagattgatgggaaacgaaagaaggcaatattatcttt

SEQ ID NO: 5357 - DNA, 1836 bp, Oryza sativa
  Predicted polypeptide sequence is orthologous to G233, G241
gactctgcagcctcggagcagccgcctcccttccaagaacacacaacgcaagaggagcagagcagttcagatcagagcagggaaggagcaagcacaatggggagggctccgtgctgcgagaagatggggctcaagaagggtccatggacgccggaggaggacaaggtcctcgtcgcccacatccagcgccacggccacggcaactggcgcgccctgcccaagcaagccggtgagtgacagcggctcgtgttcggttcaggtcgtgtacctttggcggcgccggtgaagcaaagctaaaatgggttttgatgtcgcagggctgctgcgttgcggcaagagctgccggctccggtggatcaactacctgcggccggacatcaagcggggcaacttctccaaggaggaggaggacaccatcatccatctccacgagctgcttggcaacaggtacacacgctgctctgctcctccttaattgcagacttatctgatctgatccccccaaatttcgctgctcctggtttggagcaatgattgttgcttgcttatgtgcttcaaatgctatgagagggaggtttattccttttttatttatttagttattattagttatttattaccattgtggaggggcatatactgatatgttatcctcctgggccacctgctctcgatgcaaatagagagaaaatatattgctagtcgtaggccacttttctgtagctaattacatcactgatgatgcgcgagatgtgctaaaagattccatcttgtttggctcttccggtgaccccccttgaattcagcgctgcaaaaacatgcgctttgcattaaacaaccgcatgtgatcccgacgagggaatcaaatcacgcgatgatagcaaagctctaaatcaaaatgaagtcatctgaaatagccaaacaattttttttttttgacaaaatgaaacatgaacttgggcactgatccgctctgaattctgtgctacgcaggtggtccgcaattgccgccaggttgcccgggaggacggacaacgagatcaagaacgtgtggcacacccacctcaagaagcgcctcgatgcgccggctcagggcggtcatgtcgcggcgagcggcggcaagaagcacaagaagccgaagagcgcgaagaagccagccgccgccgccgccgcgccgccggcgtcgcccgagcggtccgcctcgtcgtcggtgacggagtcctcgatggcctcgtcggtggcggaggagcacggcaacgccgggatcagctcggcgtccgcgtccgtgtgcgccaaggaggagagctccttcacctcggcttccgaggagttccagatcgacgacagcttctggtcggagacgctgtcgatgccgctggacgggtacgacgtgtccatggagcccggcgacgcgttcgtcgcgccgccatccgccgacgacatggactactggctcggagtgttcatggagtccggcgaagcgcaagacttgccgcagatctagagaaagagagagaattttaccgtttcttcggttaattgatttgttttttctctctctgccgccatcttgcaccggagggacatagctaacagacaagagtgtccatgagcgaatcatcaagcaggaagaacgcgaatcatgcgatgcgatgcgatgagatgcacccagtagctttgatagttaattttctttttttacctccttcctgtatgtatagaaacagaagagatcagtgatcgaaacctgagatcctttctcacaatgtgcaaactggatcatcagaaaacgggctctgcgtttctcatttgattaattaaattcaacttgcacgc

SEQ ID NO: 5358 - DNA, 1367 bp, Oryza sativa
  Predicted polypeptide sequence is orthologous to G234
ctaaccaagtttaggccctaatcaacgctttgctctgcacacctcgcaagagatcagagcccctgaaagctagaagaggagatagaggataacccacacgccatggggagagcgccgtgctgcgacaaggcgagcgtgaagaaggggccatggtcaccggaggaggacgcgaagctcaaatcctacatcgagcagaacggcaccggcggcaactggatcgccctgccccagaagatcggtttgaaaaggtgcggcaagagctgccgcctccggtggctgaactacctccggccgaacatcaagcacggcgggttctcggaggaggaagacaggatcatcctcagcctctacatcagcataggaagcaggtggtcgataatagcagcgcagctgccggggcggacggacaatgacatcaagaactattggaacacgaggctcaagaagaagctctttggcaagcagtcgcgcaaggatcagaggcagcagcagcacctggcgcgccaggcggcagcagctgccagcgacttgcagatcaaacaagaagcgagcaggggtgcaaacgaagccgatggcttggctgccggtgccaattacacttggcatcaccaccacgccatggccgtgcctgtgcacccgatgtcggcaccaatggtggtggaaggaggccgtgtgggagacgatgtcgatgagtcgatccggaagcttctgttcaagctcggagggaacccattcgcggcctcgccggcaccgccatgcatacctccaccaccaatgtacgaggaagccccaagcttcgtgccaccattggcgcacggcgtgccgctcaacgaaggcggcatgcagtgctccagcgtgctgccggcgctggagctggacgagaacttccacttcaaccatgtcaagctggacgggctcgagtgcctcttcgggatgggagatcaccaaaacatgagatggaatgaggtgagcccgttggtttgccctaataacgctgtggcgtccagctcccaagggatgcagcagtactgcctagttgaagaaccagctgacctcgggatgcagtagcaatttggttgtgtttccgtgtacatgcatgattgtgtggtgtaaatctgtagcattcatggggaaattaatggggaaagatgagatcaaacttctttgaactaagagcaataaggtcgagctctcaccactcctagatgagagataggtgcatgcctgattttccaggtgtcttcatgtgagtctagtctttaaatggtattttcctctactctcttactgccctacagaaacattttacattagactgtacgtgttgcatttatctgtcgcttaatttggtgtgttttggcgtattt

SEQ ID NO: 5359 - DNA, 1726 bp, Oryza sativa
  Predicted polypeptide sequence is orthologous to G237, G1309
acaactcatggcttcgaagtccaaactcaacactacaagccagtaagtttaactactacacatgcacggcacgatttacacctctgaaaaagagggggaaaaaaaagaaactgacgaatttacacttcggcgacgaactgtacggaagaaagagcgtacgctcccgcctagttgatgccgaggaactcgctcatggagagcaggtcgcagagccctcctcctccctgcatgtgatcggccgcgtcgtcgaagtcccagcagaagccgccgtcgcccagcccgtgcagggagtccacggcgccgccgcacgggacgtcgacctgcaccgacgacgagccctggtagctcaggcccggcgccgtcccggcgaggctagtcccgtagtccatgtcgaaccagtcggcgaacatgaccttggggatcacgggcgcgtgcggccggacggcggcgagccccgccgcgggctcggtgaggctgctcgagtcgtcggccgacgacgactcgaccggcccggaagactcggagctcgccggccggtcagcggcgacgcgttcttggccggtctcgctgcggttcgggctgccggtgacgacgtcggccggctcggcggattttctggccgcagcctccgcgccttcgactcgcttcttgagcgtgcaggttcatgacggtttcttcttcctctcgggaaaacatgccgtgcttcagccccggcctcaggtaattgatccatctcagcctgcaactcttgccgttacgctgcagccctgcatgaaaggcaaattcagaagagaattcagctcaccagacaaggtacatttgacgaaaaaacacaaaagctcaaacaggcttcatctatcgtcctgaagctgaacaacactttgcaaatagtaggaaacaaaaaaaatcccttctccccttcccttaaatcaaggtgcatttgaaaaaaaaaagaaaaaaacgagagcagcaacaagcaaacaggggggttttgaagcaggacacaggtgcaatgcattcaggcgtacagcagttgcaaaattcgcggtgaattccccggcgaaatcgtcgcaggcggagctcggaaccgtggtcttaccggccttcacggggacggcgctccagcagccgtggccgtagcggaggatgaagtcgcggagcttctggtcctcctccggcgaccacaggcccttccggtagtgcaccttgggcttctggcacgccttgcaccccatcaatggcggacgagaagagagcaagaggagactctagagtctagactctagagagacaatgccaaaccgcgagcagcacgaggggaaaagaaagcagaagaagactttggcttggtaaggaggaggaggaggcggcttgcttggacggccgtgattgctttgcggcctgcactgttgtgtcggtctgcgttggcgtgagagatgggcgcaggggctttataggcctcgcccaatcatcaccgttggccctgtggcccctcacgggaataagcaagtggttaggtcgccgattgtttttccttcttttagttccgaggaaaaaataaatggttttttttatctgtccgaccaaaaccatatatgtacatggcactagtatcattacatcggacggagtacataccttcgctttctgtaattctcagaggctgcagtagtctgaaagcagatgcaatttttagcgaaataaaattacaaggtttggcacttgc

SEQ ID NO: 5360 - DNA, 954 bp, Oryza sativa
  Predicted polypeptide sequence is orthologous to G237, G1309
atggggtgcaagtcgtgcgagaagcccaggccgaactaccggaagggcctgtggtcaccggaggaggaccagaagctccgcgactacattctccgccatggccacggctgctggagcgcgctccctgcgaatgccgggctccagaggaacgggaagagctgccggctgcggtggatcaactacctgcggccggggctgaagcacggcgtgttctcgccggaggaggaggagacggtgatgagcctccacgccgcgctcggcaacaagtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtga

SEQ ID NO: 5361 - DNA, 411 bp, Oryza sativa
  Predicted polypeptide sequence is orthologous to G237, G1309
ggttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccgggctccagaggaacgggaagagctgccggctgcggtggatcaactacctgcggccggggctgaagcacggcgtgttctcgccggaggaggaggagacggtgatgagcctccacgccgcgctcggcaacaagtggtctaggatagcac

SEQ ID NO: 5362 - DNA, 2294 bp, Oryza sativa
  Predicted polypeptide sequence is orthologous to G249, G1322
gaccaatccatctctcttctctctctctctctctctacaacttctcagctaagctaagccaagctagagccatctagctacttttgctgctttctctctcctcctgcaacacacgacctagctgagagctgagctgagttgcgccggccatggcagcatcgcagaggagcaggagcacggcggcgcagctcgacgtcgacgaccaggcggcggccgatcagctgatgacgatgatgcggcggccagcggcggtactacaggatgaggccgccgccgaggaggaggcctccgcggcggcagcggacctgcagctggagctccggcgagggccgtggaccgtcgacgaggacctcaccctcgtcaactacatcgccgaccacggcgagggacgctggaactccctcgcccgcgccgccggtaatctaatcaaatcaagttgtagtcaatcgattcgatgtcgatttgattcgaattatatatggaatcgatgaaaatcgatttgatgtttgtgatcgatcgatcgatgaagggttgaagaggacggggaagagctgcaggctgcggtggctgaactacctccggcccgacgtgaagcgcggcaacttcaccgccgacgagcagctgctcatcctcgacctccactcccgatggggcaaccggtaattaattaattattaactcacccattattccgctcgctagttaattattacccgcttcgctcataaatatttgacgtttaggacatgatctgttgaaccaattcgaaaccttttatggttcgattgacacaacaaaaaaaaccctccaaataaattggaggaaattaaattaggaggcttggaaaagaggcatgtaattataattgattaattaaaatagtttatttgtgggcatgtaaatcactatatcaggtgtaatttaatttgtaggctcattagctagctcttgatggtatatatatggccatcaattgtggaccatacatggtatgtgtgcacacgtcgcatgtcacgtgctgtatttaatatgtacacatatacatgtggccacacacacttggatgccacacaaaaacatactttgacaatattagctttagatatgacacaatagttcaagatactagcacagttcatattgtacaagtcttctatcgctacagaggaatattaattattatgcatgcattattggttttaattaattgatttgcaaacatatatatggagaaaaagatagatacaatgatatatacatcaagctaaagcttctagctaggccggctagctaagcatgtacaaccaagatgcctctcactttcacataaacagagtgcatgaaagctgcacgggttttaaagctgcacgtctctcttccttccctccctctctctctttctctctctctacatatatctccactagtctagtgccacacaacttagcttatattgtactctttttcttgtgtgttccctaccatcaatttttttctaattacatttcgatcccattgggggtgtgttgattatctgcaggtggtcaaagatagcgcagcatttgccagggaggaccgacaacgagatcaagaactactggaggacccgagtgcaaaagcatgccaagcagctgaactgcgatgccaacagtgctaggttcaaggatgctatgagatatctatggatgcctcgcctcgccgatgcaagccagctcggtgatcaccatgggtataatagtaccactgccatgggcgatgctcatgggatgccagtgatgacatcgtcgtcgtcggactcgttcgcgacatcagagtcatacgatgggggcctttatgcaaatgtgcaggacaatgagatggtgaatggtggggactactggatgcagggagcaaataaagggttttgtagtaattatgagtcagagcaacttcatcctcatgagcatagccagtttcaggatccagatcttgttggttgggttcaaggcttttctgagggcatttccgagaatttttggagcttggaggacatttggaagatgtagtgaattttgcattaatttgtattgtggctatatatacacatacgtacaggagtatacattttataatattgattgataactcgtggaacaaagattagagtcagcttattctaacttcaaaagttactacgagagaaaaaaagtaaatttcttctttgattttcctttttttttgtatggatgtcgattgacacatatgtatatgttgtcccaacaatgtaaaacatataagaagacgtgattgttacc

SEQ ID NO: 5363 - DNA, 675 bp, Oryza sativa
  Predicted polypeptide sequence is orthologous to G249, G1322
atgtgcggccgcgccggcgagccggcggtgcgcaagggcccgtggacgctggaggaggacctcatcctcgtcagctacatctcgcaaaacggcgaaggatcctgggacaacctcgcgcgctctgccgggctgaaccggaacgggaagagctgcaggctgcggtggctcaactacctgaggcccggtgtgcggcggggcagcatcacgccggaggaggacatggtcatccgggagctccactcccggtgggggaacaggtggtccaagatcgccaagcacctccccggccggaccgacaacgagatcaagaactactggaggaccaagatacacaggaagccgcgcggcaggagccagctgctgcaggagccgtgcgaggacgccatgggcatgggcatgtccaccaccaccagcgaggcggcgtcgacgtcggcgtcgagcggccagagccaggccagccccggcgtctgggatgagtacatgcaggcgagcagcttccctcacccggagcttgtctccttcgccgccgaccaccacctcgaaatggccggcgtgggcgaggtcgccgccgccgccgccgcgcagttcgtcccgactgagttcggtttcaatgacggcttctggaacttcgtggacaacttctgggagacgatgccggtttcagacgtggtgtga

SEQ ID NO: 5364 - DNA, 447 bp, Oryza sativa
  Predicted polypeptide sequence is orthologous to G249, G1322
atggaagatcgaggcgggccgcagcggttcagcgagccgatgtcgagaattaggcccacaagaacgtatggaaactggaccgtcgatattgggccctcaaagattatttcggccgctcctgctccatgcagacgagaagacttgggctgttacctacggcccaacgctggacggacaagcaaaacagttgaacacaacataagaaaactaatcctgcacatgcaattgcttctgctcctgggcactgctgcccagcacttgcaacgatcgacattcaatatactgtttaacttctggcgcaattcacttgatgtgcccataaagacgatcgagcgaagcttcgccgtgagaaagacatccgagctgtccaacgtcgacaaacggacggcccagatcgagttgtatgtggtgctcgctcttctgtcacatcatcgccatcccccttga

SEQ ID NO: 5365 - DNA, 1464 bp, Oryza sativa
  Predicted polypeptide sequence is orthologous to G256, G666, G668, G932
agtttcagtttcagagagaggagtcagtggctgtatgctgccatggctctcaaggtggctagatagacagacatgttgcccatcaacttaagaagcaactagctgctgctgctgctaagggagagctataggcttagctgtggtaggctatagatattactattaggtagctactagcctataggcagacatggggagacctccatgctgcgacaatggcgtcggcgtcaagaaagggccatggacgccagaggaggacatcatcctcgtctcctacatccagcagcatggccccgggaactggcgctccgtgcccgagaacaccggattgatgaggtgcagcaagagctgcaggctgcggtggacgaactacttgagaccggggatcaagcgtggcaacttcacccctcatgaggaggggatcatcatccacctccaggcattgcttggcaacaagtgggcagcaatagcctcctacctcccccaaagaacagacaacgacatcaagaactactggaacacacacctcaagaagaaggtgaagaggctgcaacaacaacaacaatcacaccctgatcatcatcaccaccattccttccaaaccaccccttcttcctccaatgcagcagcagtagcaacaaccagcccaaactactacaaccctaacaacagcaacagcaacagcagcaattacctccataacaacaaccacaatcttgaatccatgcaatccatggccactgcacctagcaatgaggccaccaccatccccaagctcttccagttccagacatggatgaagccatcaccagcaacaacatcatcagcagcaacagctgctgcaggtagctgctacaagcaggccatggccatgcaggagctccaagaggagcaagagggctctgctgctgctgctgcaatggcttcttccattgatggcgtctccaaggaccaggattatcacatgtgtgctgtgatcagtggtgatgacaagtcgtcgtcgtcggagatgatgacggctgcggcaatggccggccatggcgaggcggccacgacgaccttctcgctgctcgagaactggctgctcgacgacatgccggggcaggcggccatgagcgccgccatggatgggttcttggagatctctgctggatactgctgtgcagaccctatcatgttctgaactttctgaacttctgatgatcatctcagccttaatttcccatatgagtctctctttgctataggtttcttaatttcactgagttaatttgcacttgtactagctgtttgatgctctctctctctcgatgatcttgtgtttccggtaataaaccgttggtttaatttcctcaagaaaaagcaatccacctggaaataatctggttggtttggagaaatattgtcagttctcaaggatgtaataaaaggattaaagctgccataattcgttgcctgatatgc

SEQ ID NO: 5366 - DNA, 2407 bp, Oryza sativa
  Predicted polypeptide sequence is orthologous to G256, G666, G668, G932
gagatatctctgaaatctccacttctgacagacggtccaccgccggaccgcgacgatgcaccaccgcaccgcccgaccagcgccgaggcactaccgcactgctgcccacggccaggcgcgggtccagccgcctccgaccgccaccacagcgcctccactgcctgcagggacgccaccgctacccgcccggctacctccgttgccgccgccaacacgcgagtctcctcctccctgatcgagatcgagtcgacacacatacaccaccaaccaccggccggccgccgcgcgccggtgagcaggatggggaggccgccgtgctgcgacaaggttggggtgaagagaggggccatggacgccggaggaggacctgatgctggtctcctacatccaggagcacggcgccggcaactggcgcgccgtgccgaccaacaccgggctgatgcgttgcagcaagagctgccggctccggtggacgaactacctccggccggggatcaagcgggggaacttcaccgagcaggaggagaagctcatcgtccacctccaggctctcctcggcaaccgttctctaccataatcgtggtccacaacatagccatgctttctgaatactttcaatggataatcaacgaagctctacactacaaatttctgcaatgacaggtactattattttttgtctgaattttgctttgcttgctacctttattttacctgcagacaatttatatttggcctgtgataatactctattgtagtgtatgtactaaaaggtgtttttattctatttaattaggagggatcatatggaggttagtttatcaacattctaaagtatcaatattgatgctcatgattttgttaactattgtttatcactgattctctttcatgcccaataggtgatttcaccaatgaaagatggaacatttattgattgggatattgttgacaatatatggaatcatgctttcaagcagcggctattgatcaatcctgaggagcatcctatgttgatagttgaaccatctacaaacacagggcagcaaagagagaagtatgtccatatatattctgtatttaaattaattgtgttgcttacttgtatagaaaaacatcgcgtataagaactagctgatttatagcacaattttcttctatggctcttatcagttatgactgaactgtattggtaccaggatttactgcatgatcagacatcctaggtagtatattgtagataaaattcaattacatgggaaattttcaggctgtagttgctctgtttgttgctaacgaataattcagtcctatattcgtcttctagggttttacattcttcctctcgggtcctatattcattttctgggctcctgtatttgttctccgagtctttctctcgattcctatattcgtcctctagggtcctatatctaaatttaacaattctcaaatcctttttatcatttttgtatcgtgggttgtcaaaataagcaactatagtatttctacgtaaaacacccataaagggtatttcaatcgaaatcccaaaaacaggatattggttctttcgcttgctcttgatgatactgtttcttcgcattttggctaacaaatctgaattattttgaagaatagaaggatagacaaaattcaaatgaccattggacatgattcgatccggcgttgaataatcaagaatttccctatcttttttaacaaaagtatccattcagtcgttctttttatcatgccatttttgttatttatcagtttttttggaacaaaaacatggtattttcttagttgatgctttatgcaggtatctactgactttaaagatcatgaaggcataatgcatatatcagggctttgacatggtcttcgtgcaagaataaaatgccattttgtgtttgtcaacaagtgttatttattttttaatcaacaattgtttgtcttacttcaggttcactgatctaatgttttagtcttgcacctatcacttgctaataatgttgtaaccttgccttgcacctatcacttgctaataatgttgtaaccttgctcctgtcacttgatagtatttcaaataatttccaatattatttgtgcagattatataaggtcgctttaagattaccttgttcagattcttcggccggccctattctttacattatgcattggactattgagcctggttgtttttggaggaccagggagcatggctggagtatcatctggaggataacctgatgtggattattcacttggctttgtcttgacaaataatatatgagttattgcttgtaagagaggtcaagagaggtcttattttctgatcttatcctagattgtattaaggacaattcatgtggattaaggagaattcagaaacaaaatttgg

SEQ ID NO: 5367 - DNA, 2327 bp, Oryza sativa
  Predicted polypeptide sequence is orthologous to G256, G666, G668, G932
ggctcgctccgcgcctctctctccccgctcgcgtcctcgctctgcgcctcctctcctcgcgacggtccaccgccggaccagcgacctcgcctcctcgctccgcctcaatgccggaccagcgccgaggcactaccgcactgctgcccacggccaggcacggtccagccgcctctgaccggcaccacagcgcctccgctgctcgcagggacgccgccgctacccgcccggctacctccgttgccgccgccaacacgctagtctcctcctccctgatcgagatcgagtcgacacatacaccaccaaccaccggccggccgccgcgcaccggcgagcaggatggggaggccgccgtgctgcgacaaggttgggtgaagaaggggccatggacgccggaggaggacctgatgctggcctcctacatccaggagcacggctccggcaactggcgcgccgtgccgaccaacaccggggtgatgcgttgcagcaagagctgccggctccggtggacgaactacctccggccggggatcaagcgggggaacttcactgagcaggaggagaagctcatcgtccacctccaggctctcctcggcaaccgttctctaccataatcgtggtccacaacatagccgtgctttctgaatactttcaatggatagtcaacgaagctctacactacaaatttctgcaataacatgtgatttcaccaatgaaagatggaacatttattgattgggatattgttgacaatatatggaatcatgctttcaggtgagttgctttatctatttgatgcagatctgagtaattttgtgccaaaagtgcacgcccaaaaagctggccacacttgtggcaaaacttgtctgaaaaataaatctatgacatgagaggcactggagtaaccaggtttggcacgctgcttatgtggttcgccaaacacttgcccgttgccgcaaaaggccgaacgtgcctaacttgtttctggggaagtttgggatgaaccaaactctatctttaacatagtttctttagaatcagcaacaaagttaatcttctatgcctctatggaatcttttggatgtcagcatggttactgctttatgcccaccatcttttcaccttacatatttatttatgctcttcaaatatactaatagtgaaatcccttcttatgtgtacaaccggataaagttgattaaatactaggatttcctttgtatggcatggagatgcaactactgaagttttttgctttgttagcttttatcctgaggagcatcctatgttgatagttgaaccatctacaaacacagggcagcaaagagagaagtatgtccatatgttctgtatttaaattaattgtgttgcttatgtggtcctatatctaaatttaacaattctcaaaacctttttatcttttttgtatcgtgggttgtcaaaataagcaactatagtatttctacgtaaaacacccataaagggtatttcaatcgaaatcccaaaacaggatattggttctttcgcttgctcttgatgatactgtaatggaatggcaaacctatttcttcgcattttggctaacaaatctgaattattttgaagaatagaaggatagacaaaattccaatgaccattggacatgattcgatctggcgttgaataatcaagaatttccctatcttttttaacaaaagtatccattaaggtgtttcttttatcatgccatttttgttatttatcagtttttttggaacaaaaacaatgtattttcttagttgatgctttatgcaggtatctattgactttaaagatcatgaaggcataatgcatatatcaaggctttgacatggtcttcgtgcaagaataaaatgccattttgtgttcgtcaacaagtgttatttatttttaatcaacaattgtttgtcttacttcaggttcactgatctaatgttttagtcttgcacctgtcacttgctaataatgttgtaaccttgctcctgtcacttgatagtatttcaaataatttccaatattatttgtgcagattatataaggtcgctttaagattaccatgttcagattcttctgccggccctgttatttacattatgcattggactattgagcctggttgtttttggaggaccagggagcatggctggagtatcatctagaggataacctgatgtggattatgcacttggctttgtcttgacaaataatatatgcggtattgcttgtaagagaggtcttgttttctgatcttatcctggattgtattaaggacaattcatgtggattaaggagaattcagaaacaaaatttgg

SEQ ID NO: 5368 - DNA, 1223 bp, Oryza sativa
  Predicted polypeptide sequence is orthologous to G256, G666, G668, G932
ccacgcgtccgctcctctcttgcaacatcaaactcatccatccatccatcgatctgagaaatccagctttccagttcttggatctccatcgaccatggtgaggccgccgtgctgcgacaaggacggcgtcaagaagggcccgtggacgccggaggaggacctcgtcctcgtctcctacgtccaggagcacggccccggcaactggcgcgccgtcccgaccagaacagggctgatgcggtgcagcaagagctgtaggctccggtggaccaactacctgaggcccgggatcaagcggggaaacttcaccgaccaggaggagaagctcatcgtccacctccaggcgctcctcggcaaccgctgggcggccatcgcgtcgtacctccccgagcgcacggacaacgacatcaagaactactggaacacccacctcaagcgcaagctgcagggcggcggcgccggcggtgacggagacggtggcgccgccggcgacgcggtctccccgaagcccgccgcgcagaggcccgcgtcgtcgtccaaggggcagtgggagcggcgcctgcagaccgacatcgacatggcgcgccgcgcgctccgcgaggcgctcacgtcgctcgacgacgtcaagccaccgcatcagcccgacgccgccaacgccgccgcggggggaggcggcgccaccaccggagcagcagcgtccgccggcgccgatagccccgccgcgtcgagcacgtcgggggcgtcgcagtgctccccgtcatccgccggctacgtcctcaccaccgagaacatctcccggatgctcgacgggtgggcccggaagaagggcggcggcggcggcaggcgcgccgccggcagcgggccggccacccccggcgccaccgagagcgcgtccggctcgtcggaagcctccgaggtgtcctacggcggcacggccttgtccgcagcggcggcgcccgcgtccgccttcgagtacgagacaaagccgaccgtcaccgccgccgccgccgccgacgccggcgacgagacgcagctctccgccatcgagtcgtggctgttcgccgacgccgacggcatcgagagtggcagcttgctcgacgcggccatggattacaccttctaatccacaccaccaccaaaccatgcaagaatcgtaggcagcgagagtgagcagcgcgagttcatcactagcccaacctgaaaaaagaaaaatcgaaaaaaaaaaa

SEQ ID NO: 5369 - DNA, 933 bp, Oryza sativa
  Predicted polypeptide sequence is orthologous to G256, G666, G668, G932
atggggaggccgccgtgctgcgtgaaggcggaggtgaagaaggggccgtggacgccggaggaggacctcatgctcgtcgcctacgtccaggagcacggcccgggcaactggcgcgccgtgcccaccaacaccgggctgatgcggtgcagcaagagctgccggctccggtggaccaactacctccggccggggatcaagcgggggaacttcaccgaccaggaggagaagctcatcgtccacctccaggccctcctcggcaacaggtgggcggcgatcgcgtcctacttgccggagaggacggacaacgacatcaagaactactggaacacgcacctcaagaagaagctcaagaagatgagcgccaccggcggcggcggcgacgacggcgagggaggtggcgccggcgaggtgaagaccagggcggctgcgccgaaggggcagtgggagcggcgcctgcagacggacatccacaccgcgcgccaggcgctccgcgacgcgctctcgctggacccctcgccgccggccaagccgctggactcgtcgtcgggcgccacggcgccgccgtcgtcgcaggcggcgacgtcgtacgcatccagcgccgagaacatcgcgcggctcctggagggctggatgcgccccggcggcggcggcggcaagacgacgacgacgccgtcctccgggtcgaggtcgtcggcggcgtcggtgctgtccggggaggccagccacagcggcggcgccacggcgccgacgcccgacggctcgacggtcaccagcaagacgaaggacgaggagaccgccggcgcgccgccgccgccgccgccgccggcgttctccatgctggagagctggctgctcgacgacggcatgggccacggcgaggtggggctcatggacgtggtggtgccattgggggacccgagtgagttcttttag

SEQ ID NO: 5370 - DNA, 1203 bp, Oryza sativa
  Predicted polypeptide sequence is orthologous to G258
atggggcaccactgctgcagcaagcagaaggtgaagcgagggctgtggtcgccggaggaggacgagaagctcgtccggtacatctccgagcacggccacagctgctggagctccgtccccaagcacgccgggttgcagcggtgcggcaagagctgccggctccggtggatcaactacctccggcccgacctcaagcgcggcaccttctccgagcaggaggagcgcaccatcatcgacgtccaccgcatcctcggcaaccggtgggcgcagatcgccaagcacctgccagggcgcacggacaacgaggtgaagaatttctggaactcgtgcatcaagaagaagctcatcgcgcaggggctcgaccccaagacgcacaacctcctgccggcgtcgaagacgctcctccatggcggtggcggtggcggcgctgcaaaccctagcggcaacggcctcgcgcagttccagtctaacaacggcgcggcggcggcgggcaccacgccgttcaccatcagctctccggccaaggcggccgcctacgatgtcgcgccgccggcgttgtacgacgtcgtcctccctgctaaccccgccggtggaatgctgatggcgcatgatcaccaccatcatcaccaggtcgccgcggcggcggcgccggtgggatacccctacgccgaccacggcggcaacggcggaggcgtgctgatgagcttcagggatcagaacgccggcgtccacggcgccgcctccatggacttcatgaacggctcctcctcgtcctcttccatggagcagctcggcggcggcggcggcatgtcgtcgaacggcaacggcagcttcagcgcgagcatggcggcgttcatggacgaggaggcggcaatgtgggccaccgccgtcgcgccgccgggcatgggcggcctcgccgggatggatcaggtggcgcagcagcagcagcagcagcaagtgctggtgcaggatgcggccgtgggcgttgcgccgacgacgctgatgatgcacggcggcggcgccgccaccgccggtgcaatggtggtggacaagagcgtggagatggtggacgtctcgtcggcggtgtacggcggcgcgacggcgacggcgttcgatctagacctgatggtggagtcgtgcgggatgttctgcggcggcggcggcgccggcaacgccatggagcagctgcagtgggactgctaa

SEQ ID NO: 5371 - DNA, 1983 bp, Oryza sativa
  Predicted polypeptide sequence is orthologous to G261
cgccctgcacccgttgccaccaccaccgccttctccgccgcgccgcctcctctcgcgtctcccgctcgtgcagggcgcgcgtcgtcgggcgagctgctgccgtctccgtggccgtggctgatcagaactagttggcgttcgatcggaaagtcgctgtcttttggcgactcggtgagaatttgcgccgcggttcaatgtgaaaaattttggcccgtggcgagttggatttggcgccgagtccattcaggtggttaagacttgttcgtgggagagcgaagctgcgcgcgttaagaccgggctccgttcttgcatcgtgcagagcagctgctggtttgagaattgagaggcgcggttgacatggagagttccaacctgggcggcggcggcggcggaggcggcggcggtgggccgccgccgttcttgatcaagacgtacgagatggtggaggacgcggcgaccaaccacgtcgtgtcgtgtggccccggcggcgccagcttcgtcgtgtggaacccgctcgacttctcccgtgacctgttgcccaagtacttcaagcacaacaacttctccagcttcatcaggcagctcaacacctacggtttccgaaaaatcgatcctgagagatgggagttcgcaaacgaggatttcataagagggcacacgcaccttctgaagaacatccatcgacgcaagcccgtgcacagccactccctccagaaccagataaacggaccactcgccgaatcggagaggcgcgagctcgaagaagagatcaaccggctcaagtacgagaagagcatcctcgtcgcggacctccagaggcagaaccagcagcagtacgtgatcaactggcagatgcaggcgatggaaggcaggctagtggcgatggagcaacggcagaagaacatcgtggcctccctgtgcgagatgctgcagagacgcggtggcgccgtgtcgagctcgctgctggagtccgaccatttcagcaagaagaggagggtcccgaagatggatctcttcgtcgacgattgcgcggcgggcgaagaacagaaggtgttccagttccagggaattgggacggatgcaccggccatgcctcccgtgcttcctgtgaccaatggtgaggcttttgacagggttgagctgagcctggtctccctggagaaactcttccagagagcaaatgatgcttgcacagctgctgaagaaatgtactcccatggtcatggtggtactgaacccagcactgctatatgtcctgaagagatgaacactgctccaatggagacaggcatcgatcttcagttaccagctagcctccatcccagctcacccaacacagggaatgcccatctccatttatccactgaactcacagagtctccaggttttgtgcagagtccagagctgccaatggcagagattcgtgaagatatccatgtgacaagatacccaacacaagctgatgtaaattctgagattgcctcctccactgatacttcacaagatggcacgtcagaaactgaagcttcgcatggaccgaccaacgatgtgttttgggagcggttcctcacagagactccacggtcatgtttggatgagtcagaaagacaagagtctcccaaggacgatgtaaaagcagaattaggctgcaatggcttccatcaccgggagaaggttgatcagatcaccgagcaaatggggcaccttgcttcagccgagcagactctgcatacctgatgcagtaataccatttgcgcggattcatagttcgtgtgtaaattagcgaagatgtaaattatagcttagatcggattagaggcttgcgtgttactttacagatttcaaccttttattagattacaataggtctttcacaatttatgattctgttctatccgctgactactgtgcataaattttttttagtagaccatatccatttttgtactccattgcccttctaagattcctcgttaaaatctc

SEQ ID NO: 5372 - DNA, 3008 bp, Oryza sativa
  Predicted polypeptide sequence is orthologous to G261
accatcgcatcttcgcttcgcatcgcatcgctcacatgcgctgccttcgtcacgctccttagcaatctcgcccgccatcatgtccaatcatcccgcttggcacgaccagcagccacagtacccaccccctccaccgcaaccaacgcgacatcactcgggcatggatgcctaccaaggaccatcgccctcgtcctctacacagcagccatcaccgtacaacagcgcgccccaacacactgcatcctatccgcacgcgcatcttccacccccagcagccagacataccccgcagcagcagcagcagcagcagcagcagcagcagcagcagcagcagcagcagcagcagcagcagcagcagcagcagcagcagcatccacaacaaccgcaatgggcgtccggcacgagtcaagactttggcggtcctagccccgccaactcggcgccgcgttccaacagcggatacacaggcttcgaccctccgtccgcgtccaacaacagcccgatgcgccaacatggaggctcgcacagctccgcttatacctcacactcgccctacgcaccctcacagtcgcacgctcccgacgccgccatgcatccccagcgctcctccatgccctcgcactacgactaccaaaacaactatccgcatccgcaccatccgcaaaacccacagatgccaccacaacaccatccgcatccgcatccgcatccgcatccgcatccgcatccgcatccgcatccgcatccgtctcaacaacaacaccaccaacaggcgcactggaacactggcccgctcccttcggtgcttcagccccagtccgcaccgctctcctcgacgcccagcagcaatcgcgggcccagcgctccgccgcctccgcagcaccacaccatggaccgtgcctaccccaacatcaagcacgacgacgacatggacgacgacgacactggcaactacgacgactttgaccccaagggcaaggcgcgcgccgctgccgatgccatgcaggccgccaacaagggcaccagcgatttcgtcaagaagctcttcagcatgctcgacgacaaggcgtacgacagtgtcgtcgcctggtcgccatccggcgagagcttcatcgtcaaggacatgaacgactttacaaaacacgtcctcccgcgcaactttcgccactccaactttgccagcttcgtgcgccagctcaacaagtacgacttccacaaggtcaagaatcccgaggacggcgccgccaccgtcggcgagcacgtgtgggagtttcagcatccagactttgtgcgtggccgcgacgacctgctcgaaaacgtcaaacgcaagatccccgcaaagaagaagcccgccaagcccggcctggtcgatgccgaccgcgacgacagccccgccatgcccgcgcccgtgcagatggaagcaccggaacgggcagagtcgaatgcagaactcagggcgcaggtggcccatctcaccgccgcgcaggaccagatgcagaaccacatcctcgcactcacaaaacagtaccagggcgtcatcggcgaaatgctcaccttccagcgcaacacgatccagcaggaccagctcatgcagaacctcatccaatacctcatcaacctcgaccaggaccgccgcgtggatggcgcacccgccccaccctccgcatccagcttcctcgcccacatgggcgccaatcagggcttcctcgccacacccgctcccgccagtgcgggcccgcatacggtgggggtgcccgcgcccgtgagcggtgccgacgctgggccatccagccatgctggggcggcgccgccgctgtcgcccaagagcgtcgcgtctccgctcgacgccacaggcagcacgcccgagatctcggcgcagctggcgtcgctgcgacagagcaatccgctggcgcccatgatgctgcatccgccccacctcgatgcggacccggccgatagctcgttggtgaatgcagcggcgagcgcggcgcgcaacccgagtctgtcgtcgttcgaaaaggcgggtctgcgcgtgtttaccgtgggaacgctgcagccgcgcgactcgcctggcgatcccacacccgccccgccacaggagcttgcgccggccgggctgcgcaacgggtcggcggggtcgtcgttcgacgtgcatgccaatggcaaaggcaaggaggctgctgacgacaagaagcgcacgcctacgcccggcgagggtcacccgagcaagcatctgcgcgtgcgccgatccacactggttcccggctgggcggtgcccccgcgtgtcctgctggtggatgatgacgaggtgtgtcggcgtctctcgagcaagttcctgcaggtgttcgggtgcagtatcgactatgcggtggatggcatgtcggcggtgaacaagatgaatctcgaaaagtacgatctggtgcttatggacattgtcatgcccaacctcgacggcatgccggcgacgtcgttgatccgacagtttgatccgcgcacgcccatcatcagcatgacgagcaacagtgggccttcggagctggtcaactacatgtcgagcggtatgacgggtatcctgcccaagccgtttaccaaggaggggctgttgaatatgctcgagaagcatctgttgcatctcaaggcggcgaggggtacggggcaggaatggcccaagggtgtttcacctgcgccggcggcgacgcccagtgggacagcgcagacgggtgcggatgatgggacgcttaacccgttggcggggatgggctttacggatgaagagtacgtcgccatgctgcagaacttgatcgctgcgggtactcaggatgacgaggcgtttggcatcgacctcaaggacggcaagaggatggcagacgagagtggcggcgagaacaagagacagcgctttgtcgattcgtagcatggttgtaccatcccacacaagtgtatagtagtctgggaccgtgcacatgtgcacacgcaagtgggaacacggataccattgtcagaatgcg

SEQ ID NO: 5373 - DNA, 1735 bp, Oryza sativa
  Predicted polypeptide sequence is orthologous to G261
aatccgagagggatttttcctcgcaaccaaccaaaccaaccaaacccccaaccaagcgagcaagccgccttcgccgggggggcccccaccctgacggcaaccctagccctccgatcaccggcgctgagactgatcccgccgccgtaggaggaggaggaggaggtggtggtggtggtggtgatggaggggggcggcgggggcgggtcgctgccgccgttcctgagcaagacgtacgagatggtggacgacccgtcgacggacgcggtggtggggtggacgcccgccggcaccagcttcgtcgtcgccaaccagcccgagttctgccgggatctgctccccaagtacttcaagcacaacaacttctccagcttcgtgcgacagctcaacacctatggctttaggaaagtagatccagaacaatgggaatttgcaaatgaggatttcataaaaggacagcggcaccggttgaaaaatatacatagacgcaaacctatattcagccattcatcacacagtcagggtgctggaccattaacagataatgaaaggaaagactatgaggaagaaatcgagaggctcaaatccgataatgcagcactgtcctcagagcttcaaaataatacgttgaagaaacttaatatggagaaacgaatgcaggctttggaagagaagctatttgttgtggaagatcagcagaggagtctgatatcatacgtcagagagattgtaaaggcaccaggatttctttctagctttgtacagcaacaagatcatcacaggaagaagaggagactgccaataccaatctccttccatgaggatgcaaatactcaggagaaccagatcatgccttgtgacttgaccaactcaccagctcagacattttacagagaatcatttgacaagatggaatcatccttgaactcattagaaaatttccttcgagaagcaagtgaagaatttggtaatgatatttcatatgatgatggtgtcccaggcccttcttcaactgttgttctcacagagctccattcacctggtgaaagtgatccccgtgtttcatcacctccaacaaggatgcgtacttcgtcagctggtgcaggagattcgcactcctctcgtgatgtagcagagtctaccagctgtgcagaaagtcctcctattcctcaaatgcattctcgtgtagatacacgagcgaaggtttctgaaatagatgttaattcagaacctgctgttacagaaactggtccatcaagagatcaacctgctgaagagcctcctgctgtcacacctggtgcaaacgatggcttctggcagcagtttcttaccgagcagcctggatcatcagatgcacatcaggaggctcaatcagaacggcgagatggaggaaacaaggtggatgagatgaaatcaggagatcgacaacatctttggtggggcaaaaggaacgttgagcagataacagaaaaacttggacttctcacctcaacggagaaaacctgacataattttgtttttctttttgtagatgaaaaactattaattcaggaacgctgacattggtgccttcctcagtgagatatgttgactaacatctatttcgcagtgtaccgtattttttccatcatgtaccgtaatgtatcatagtgccatacattcatctttggtccattgacactttctgatatcattgtgcgtgatttctaaaatattctcaagtttggttaaatgttac

SEQ ID NO: 5374 - DNA, 1567 bp, Oryza sativa
  Predicted polypeptide sequence is orthologous to G263
ggtaggtccggaggaggaagcggcgagagaagctcagctaggcagggcgacgggcagaaacgcgaccacggcaacaaaccccgccgcgcgcgcccaccgtgccggttacatgggagtagaggcgggcggcggctgcggtgggagggcggtagtcaccggattctacgtctggggctgggagttcctcaccgccctcctgctcttctcggccaccacctcctactagctatacacacccatctcaccataacacacatacatagatagatagatagatagatacatacacacaaacataagtagctaggtagagaaagagatcatagcgttaggtgatcgatcgatggctgctgctgaggcggcggcggcggtggggaagcagcagcagaagggcggcgggggaaggggaggaggcggcggtgggccggcgccgttcctgacgaagacgaaccagatggtggaggagagcgcgacggacgaggtgatctcgtggggaagggaggggcggtcgttcgtggtgtggaagccggtggagttcgcccgcgacctcctcccgctccacttcaagcactgcaacttctcctccttcgtccgccagctcaacacctacggtttccggagggtggtgcccgatcggtgggagttcgccaacggcaacttccggcgaggagagcaaggcctcctctccggcatccgccgccgcaaggcgacgacgcctcagtcctccaaatcctgcggcagcggcgtcaacgtcgcgttccctccgccgctgccccctctgcccccggagccgtcggcgaccacgtccagcggcaacgaccgcagctcctcctccgcgtcctcgccgccgcgggcggacatcaccagcgagaacgagcagctcaggaaggacaaccaaacgctgacgatggagctggcgcgggctcggcggcactgcgaggagcttctgggcttcctgtcgcgcttcctcgacgtccggcagctcgatctccggctgctcatgcaggaagacatgcgagcggcggccggcggcgtcggcggcgagcagcgcgtgcaagagcacgcccgggaggagaagtgcgtggagctgttcggcgtgctcctcgacgacacccatggcgccgccacgaggaagagggcgcggtgcgaggaggcggctgccagcgagcggccgatcaagatgatcaggatcggcgagccgtgggtcagcgttccatcgtcggggccggcgcggtgtggcggcgacaactgaagtccaaacttgtgcatgccacggccatgacctgatcgaccaggcgaacggcaagcagaaggcatgcatggtgaggttggtggcaagaatggtccgatcaaccaagtcattaggtaaaacgagacgaattaagcacgccaaatacgtgcggccctgtgttaatcacgggttgctaccatgctagtagtaaggtaggaacagtacgaggagtcaaggctgaccgaagcgaagcagccggctcttgtgtctggacgttgtttcagttaacactgaaagcttcaccttactatggattatacattttttagataatgg

SEQ ID NO: 5375 - DNA, 1846 bp, Oryza sativa
  Predicted polypeptide sequence is orthologous to G264
gtacctacaacgaccacgacgactcctctcctccctttctctctcttcacccgcagcacgcgcgccgccgtctccggcgatggaagttgccgccggcgcccgcggcggcggggccggcggaggagggggaggccccgcgccgttcctgctcaagacgtacgagatggtggacgacccgtcgacggacgcggtggtgtcgtggagcgacgcctccgacgcgagcttcgtcgtctggaaccacccggagttcgccgcccgcctgctgcccgcctacttcaagcacagcaacttctccagtttcatccgccagctcaacacctacggattccgtaaaatagatccagagcgatgggaatttgccaatgagtacttcatcaagggacaaaagcacctgctgaagaatatccacaggcgtaagcctatccacagccacagccatccaccaggtgctctgcccgataatgagcgtgcaatatttgaggatgagatcgaacggctttcacgagagaaatccaacctccaggctgacctctggaaatccaagcagcagcagtcgggaacgatgaaccagattgaagatcttgagcgacgagtgcttggcatggagcagcgacagaccaagatgattgccttcttgcagcaagctagtaagaaccctcagtttgtcaacaagcttgttaagatggcagaagcatcttcgattttcacggatgctttcaataagaagagaaggttacctggtttggattacagtatcgagaacacagaaaccacaagctcttatgatgaccatagcagcacttctaagcaagaaacaggcaatcttttaaatcagcacttctctgataagcttaggttggggctttgtcctgccatgacagagagcaatatcatcacgctaagcacgcaaagctcaaacgaagataacagaagccctcatggtaaacatccagagtgtgacatgatggggagggaatgtctcccgttggtgccgcagatgatggaactctccgataccggcacatctatctgcccctccaagagctcttgctttgcaccacctataagtgatgaaggcctcttaacatgccatctgagtctaactcttgcatcatgctcgatggatgttgacaaaagccaaggcctcaatgcaaatgggaccactatagacaacccaactgaggcagcaacagctaccatggaaaaggatgacaccattgacagaagcttcgatgacaaccaaaagaaatcagctgattctcgtacagcagatgccacaacaccacgagcggatgcacgagtagccagtgaggctcctgcagccccggctgcagtggtgaatgacaagttctgggagcagttcctaacagagcgacctggctgctctgaaactgaagaagcaagctctggcctaagaacagatacttccagggagcaaatggagaacaggcaggcatatgatcactcacggaatgacagagaagacgtggaacaactgaaactctgaatttactatagaattatacaatttacaagaagggatacaggcgtacagtgtaagatgtttagaatcaggaacctgctgttaaacatgacagatcaatgggtgtacaacatcacacaggtgtacatattttttttccctgaatgtttcggagggttaagattaatagttcgattaaccacaccagttgttgtaaaatcgatgtgtctgtctgtctggcatggtttctcatcttgttggtagtgatttatgttatgcagtgtcaagctgccacagcggagaatcaaaattagcatgtacattacccttaaatatccttttcgtaaaaatatttttacgatc

SEQ ID NO: 5376 - DNA, 1846 bp, Oryza sativa
  Predicted polypeptide sequence is orthologous to G264
caacctacaacgaccacgacgactcctctcctccctttctctctcttcacccgcagcacgcgcgccgccgtctccggcgatggaagttgccgccggcgcccgcggcggcggggccggcggaggagggggaggccccgcgccgttcctgctcaagacgtacgagatggtggacgacccgtcgacggacgcggtggtgtcgtggagcgacgcctccgacgcgagcttcgtcgtctggaaccacccggagttcgccgcccgcctgctgcccgcctacttcaagcacagcaacttctccagtttcatccgccagctcaacacctacggattccgtaaaatagatccagagcgatgggaatttgccaatgagtacttcatcaagggacaaaagcacctgctgaagaatatccacaggcgtaagcctatccacagccacagccatccaccaggtgctctgcccgataatgagcgtgcaatatttgaggatgagatcgaacggctttcacgagagaaatccaacctccaggctgacctctggaaatccaagcagcagcagtcgggaacgatgaaccagattgaagatcttgagcgacgagtgcttggcatggagcagcgacagaccaagatgattgccttcttgcagcaagctagtaagaaccctcagtttgtcaacaagcttgttaagatggcagaagcatcttcgattttcacggatgctttcaataagaagagaaggttacctggtttggattacagtatcgagaacacagaaaccacaagcttttatgatgaccatagcagcacttctaagcaagaaacaggcaatcttttaaatcagcacttctctgataagcttaggttgggactttgtcctgccatgacagagagcaatatcatcacgctaagcacgcaaagctcaaacgaagataacagaagccctcatggtaaacatccagagtgtgacatgatggggagggaatgtctcccgttggtgccgcagatgatggaactctccgataccggcacatctatctgcccctccaagagctcttgctttgcaccacctataagtgatgaaggcctcttaacatgccatctgagtctaactcttgcatcatgctcgatggatgttgacaaaagccaaggcctcaatgcaaatgggaccactatagacaacccaactgaggcagcaacagctaccatggaaaaggatgacaccattgacagaagcttcgatgacaaccaaaagaaatcagctgattctcgtacagcagatgccacaacaccacgagcggatgcacgagtagccagtgaggctcctgcagccccggctgcagtggtgaatgacaagttctgggagcagttcctaacagagcgacctggctgctctgaaactgaagaagcaagctctggcctaagaacagatacttccagggagcaaatggagaacaggcaggcatatgatcactcacggaatgacagagaagacgtggaacaactgaaactctgaatttactatagaattatacaatttacaagaagggatacaggcgtacagtgtaagatgtttagaatcaggaacctgctgttaaacatgacagatcaatgggtgtacaacatcacacaggtgtacatattttttttccctgaatgtttcggagggttaagattaatagttcgattaaccacaccagttgttgtaaaatcgatgtgtctgtctgtctggcatggtttctcatcttgttggtagtgatttatgttatgcagtgtcaagctgccacagcggagaatcaaaattagcatgtacattacccttaaatatccttttcgtaaaaatatttttacgatc

SEQ ID NO: 5377 - DNA, 2437 bp, Oryza sativa
  Predicted polypeptide sequence is orthologous to G268
gagtccccggcagtgcacgatcccatccctcccgcatcggcaaggcaccgccgcgccgaccgctctccgcaccgcgacgcgacgcgacgcgaggcgaggcgaggcgagcatgaagcccctgggcgcgcacggcgccgacctgctctgcggcccgcgcgtcctccgcgctgcggccctcgccttcgcctgcgccgccgccttcctcgtcggctaccactggtccgactcctccccgcgcctgctcttcttctcctccaccgcctcctcctcctcctcgccgctcctctccaccggctccccttccgtcgccgtctcccccaacgccaacctctccttcgacccctccctgatccccacccctgccgcctccacgccgcctgcttctcctactgccaatgcctcgcccccaccttcgctgccgccgcctcctcctcccctccgcccccctccccctcccgcccgcctcggcatcgtcggcgaggacggcgcgatgcgcgacgacttcgacgtcgtcgtcggcggcgccaacgacaccgatctggccgccaccgacgaggccctgccgcaggagccgaccgacgcgggccccgccgtcgggagcagggttcggattgggaggttcccggtttgtcctgagagcatgagggagtacataccctgcctcgacaacgaggaagagatcaggaggctgccctcgacggagcgtggcgagcggttcgagcggcactgccctgccaaggacaagggtctgagctgcctcgtgccggcacccaaggggtataaggcacccattccttggcctcggagcagagatgaggtatggtttagcaatgtacctcacacgcggttggttgatgacaaaggagggcagaattggattagtaaagctaaggataaatttagatttcctggaggaggaactcaatttatccatggagcaaatcaatacctggatcagatttctcaaatggtaccagatattgcatttggctctcacactagagttgccctggatgttggctgtggagtagcaagttttggtgcatacttactttcacgtgatgtgttgacattatccatagctcccaaagacgttcatgagaatcagatacagtttgctcttgagcgtggtgtgcctgcaatggcagcagcatttgcgacacaccgattactatatcccagtcaagcatttgacttaatccattgttcacgctgccgaataaattggacccacgatgatggaatcctgcttctggaggttaatagaatgctcagagccggcggttattttgcttgggcagcacagcctgtttataagcatgaagaggctcagcaagaagcatggaaagagatggaagacttcactgcaagactctgttgggagcttgtgaagaaagagggatatattgctatgtggaggaaaccattaaataactcatgctacatgaaccgtgaccctggggtcaaacctgcactttgtgatcctgatgataatccagatgatgtctggtatgtcaatctgaaagcatgtatcagccggcttcctgaaaacggtgatgggctgactccctttccatggcctgcacgtttaatggagccaccaaaaaggcttgaaggtgttgaaatggatgcacactcatcaaagaaggagcttttcaaagcagaaaccaaattttgggatgacattgttgaaggttatattcgtgtttttaagtggagaaagttcaaactccggaatgtattggacatgagggctggatttggagggtttgcagctgcattgattaatcgtaaacttgattgctgggtgatgaatgttgttcctgttagtgagccaaacacactgcctgtaatctatgaccggggacttcttggagtggctcatgactggtgtgaaccatttgatacatatccaaggacatatgatctgctccatgcgtttagcctattctcgaaggaacagaaaagatgtaacatctcaagtatcttgctggagatggatcgaatactcagaccaggcggtagggcttacattcgtgacctaaaacaagttgtacaggatgtcaaagagataacaaccgccatgggatggcgatccatcatgcgtgacaccgcagaaggcccgtatgctagcaggaaggttttgatgtgcgacaagccgatggtgcgttagccgatcaggctggtccagagcaatgatgcgagccctggttttgttttccggagccttttgaactgactaccacagctactacggactggagattgacatctgtttcaatacatagggataggtgaatgccaaagttgtaactaatcaatttgattcgtcattcgtttgtacaacgactgatgtagcccctaacgattggcttgtttttgttgtatcatccacacaacagtaattatgaataggagttaggaaggtttttgagcg

SEQ ID NO: 5378 - DNA, 853 bp, Oryza sativa
  Predicted polypeptide sequence is orthologous to G270
ctttttttatagttgtataacttgtatacgtagtatttctcccgtgggtccaattaatggtccatatgttaggtctcgactttgattttcaagcaccaatgcccacggagtgcacagtatatatcaattatatgcatgcagaaacttacaggattgcatggacggggtgcagcattcagcattctcatgcctgctaattgctgttccagcaatccttttttagggcagtgccattgctgctccagtaatcggacatcaccattcatacatgtttgtaacacgtcgtgcagaaagtacgaaattacctcttaagattatacagcattgatatcatggaactttggccttccaattatcatgggcataccacaacctgttgattcccttcaaggagcaacctctatcttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcttgagttttcaaagttctatcaacaccctttattaagagtagcttaacgatatcagttctctgtgtttgcacagctagatgcaaaggtgtccatccataatcatctggccgattaatgtcaacattgtacagcaagagagtctttatggtctgactgcatgctgtttggacggcataatgcattagggttgcaccatctttatcgtggatgaatggatttg

SEQ ID NO: 5379 - DNA, 786 bp, Oryza sativa
  Predicted polypeptide sequence is orthologous to G270
tttttaccacttcacatgtggggagaaaacttttatctgttctgccgatgcagtgagaatttacactaacaatcgggacgtgaaggagaaacaaaataattcttgattaatatttgtatccaagatgctaggaatatctaagattaatggggtagaaagagaaaataatactactggaaatgtaaaagtatgcaggtcacgctaaacttatatttggcattaataatttgggtatcttgagttttttatggctaacctcttaagattatacagcattgatatcatggaactttggccttccaattatcatgggcataccacaacctgttgattcccttcaaggagcaacctctatcttgaaccagaagtgattagatcatgcactggagaaaacagagttgcctcccaacagctcagtatctttcaataaactttaataaatttgacagtgtcatataccatccaagtgctgaactgggtcatgttgctttggtagacgaaagctcttgagtaatttgataagttcatacgtccttgcatgatgacccaaccggaggcataactccaaaggggtaaatccatcttgagttttcaaagttctatcagcaccctttattaagagtagcttaacgatatcagttctctgtgtttgcacagctagatgcaaaggtgtccatccataatcatctggccgattaatgtcaacattgtacagcaagagagtctttatggtctgactgcatgctgtttggactgcataatgcattaaggttgcaccatctttat

SEQ ID NO: 5380 - DNA, 1392 bp, Oryza sativa
  Predicted polypeptide sequence is orthologous to G270
atgcctccttccctctccctccaccaccacctcctcctcttccccttcccttcccatgtccaaaccctaaacccgctctccgcctctcctcgcctccacccacatagcaaatctctcctccccaggcgccgcccgctcgttacctctccctcctccttcgccgtcgccgccgtcgatgaattcgacgaggatttcgccatcggcgactgcgtcgtgttcgaggacgacgccttcgaggagcccgatgtcgacctcccctctccggcgccatcgaccacctcgcgccccaggcggaagccggccgcggaggccggcggcggaggggggagtagcctggtgccggagaggtggagggacgcggcggaggagataaacctgacgaagaaggagaagcgccgcatcgcgcacggcttgcgcttcgggagccgcctcgagcggcgggcgccccccgccgtggccgcgcccgatgagtaccgcgcgtaccgcgaggggaggctggacgcggagctcggacgcgtcgcgcgcgactacgccgagccgatcgagaggtcacccgtaccggatagagtggaggctccgccgcctcctgagcctggtgctcgtgtggcacctaggaatccgaggttggggctgggtgtgagaagcctcgacgacatcacggagctgtttaacagtacggagtatgtgccaggcgagatggaggatggcaacaatccgaaaagccgacggaagctgttcacagatgaggagaaggttcttctgaacaagagagtacctgatcttgaagctgctacttctagcaagtggcttccacttcacacaattgcagcatcaggagatttctatctgttggacaatcttctaaaacataatattaatgtgaatgcccttgataaggatggtttaccagctattcataaagcaattctttccaagaagcatgccattatcaactatctcctaaggaattcagcaaatccattcatccacgataaagatggtgcaaccctaatgcattatgcagtccaaacagcatgcagtcagaccataaagactctcttgctgtacaatgttgacattaatcggccagatgattatggatggacacctttgcatctagctgtgcaaacacagagaactgatatcgttaagctactcttaataaagggtgctgatagaactttgaaaactcaagatggatttacccctttggagttatgcctccggttgggtcatcatgcaaggacgtatgaacttatcaaattactcaagagctttcgtctaccaaagcaacatgacccagttcagcacttggatgatagaggttgctccttgaagggaatcaacaggttgtggtatgcccatgataattggaaggccaaagttccatga

SEQ ID NO: 5381 - DNA, 2371 bp, Oryza sativa
  Predicted polypeptide sequence is orthologous to G274
gggcgaaatattttccgcggcgccgcgcgtaccgttcgtccgtcgtcggtggagtggaggctgccgaactgtaaagctcacgggttgggcgaatctccactcctcactcgccccccactgaaatcgccaaaaacccaactgaaaaacccccccaccggaatcctcacgcacacacctcgccgcggaagctgtggcgtccgcgtaggagcagctgtttcttttttggatccaatccaatcggataagcagccatggctgtgaaggcgagttctgcagataacaggaccagaagcaccgtgtcactatgcatagtgattggcatgtgctgcttcttctacatccttggggcatggcagaagagcggatttggaaagggggacagcattgcgctggagatcacgaagcgaacggactgcacaatcttgcctaaccttagcttcgacacgcacctcgctaagcaggcaaggcctcgcgatctcgtttcgccggcgaagaagtttaagccgtgcccggatcgctacacggattataccccttgccaagatcagaacagagcgatgaagttccctcgggagaatatgaattacagggagcggcattgcccaccgcagaaagagaagctgcactgcctgataccgccacctaagggatatgttgctccattcccatggccgaaaagtcgggactatgttcctttcgcgaattgtccctataagagcttgacagtcgagaaagcgatccagaattgggttcagttcgaaggcaacgtcttcagattccctggtggaggaacacaattccctcaaggagctgataagtacatcgatcaacttgcatcagttgttccaatcgccaatggaactgtcaggactgcattggacactggctgtggggtggctagttggggagcttacttattaaagagaaatgtcttggcgatgtcatttgcgccaagagattcacacgaggcacaagtgcagtttgctctggagaggggtgtcccagctgttatcggtgttcttgggacgataaaactcccttacccatcaagagcctttgacatggcccattgttccaggtgtttgattccatggggagcaaatggtggaatatacatgatggaagttgatagggttctaagacctggtggatactgggtgctttcagggcctccgattaattggaaagtgaactacaagggttggcagcgtacaaagaaagatcttgaggcggagcagaatgaaatagaggaaattgctgaccttctttgttgggaaaaagtcaaagagattggtgagatggcaatatggaggaaaagattaaacactgagtcttgtccctctaggcaagatgaatcaagtgtgcagatgtgtgactcaacaaatgcagatgatgtctggtacaagaagatgaagccttgtgtgacacctattcctgatgtaaatgatccaagtgaagttgctggaggtgcaatcaagcccttcccaagcaggctcaatgcagttcctccaaggattgctaatggcctgattccaggtgtttcatctcaggcctaccagaaagacatcaaaatgtggaagaagcatgtcaaggcttatagcagtgtgaacaagtacctcctcactggaagatacagaaacattatggacatgaatgcaggttttggaggatttgctgctgccattgagtccccaaaatcttgggtgatgaatgccgtgcctacgatttcaaagatgtcaactctaggggctatttacgagcgaggattgattggcatataccacgactggtgcgaagctttctctacttacccaagaacgtatgatcttatccacgctagtggccttttcaccctgtacaaaaacaagtgcaacatggaagacatcctactggagatggaccgcgtcctgaggccagaaggcgccgtcataatgagggacgatgtcgatatcctgacgaaggtgaacaggctcgccctcggcatgaaatggaacacgaggctggtcgatcacgaggacggccccatggtgcgtgagaaggtgctgtatgctgtgaagcagtactgggtaggcggaaaccagactgcagcagctgcagcatgaagcaggcgtaaatcctaacacaaaagatggaagaactctgcaatccatcctgaactgacttccaggaaaggtaagatacgggagtcatttagtgagaggccaggtgatcttgtcggagtggcgatgaagaagcaacccgggctttcttggttgctctgatgatcggctggcgtatattgttgtaacaattttgtaatttcatttgtcactctctagtgttaactggttacgatgcttaattcaaggtttgcttgtcagttgtcacggtg

SEQ ID NO: 5382 - DNA, 2722 bp, Oryza sativa
  Predicted polypeptide sequence is orthologous to G274
ggcgggtgtagtatggccaccatggcggcatatggccccctttcacacgcacatcctcctctcctttatttatgaaaggggggttgggttagctgggaagaggaaggaagccgctgctgacatgtgacaccgtgtttggcatcacaccacttcactccactggctcagtggctgcctcactcactcaccaattcaccattgctagtgcaagagctcgcataaataggcagagctgctgctcctctcctctccctctcagcctctggaggaggaagagaagaggaggggtctctgcttcatctttcttcctgagctggcttctttactacagcagccatggctaaagagtatcctgcctcccccaaagctcagcagctgcaagaatccaagaagcagcggctcacctacatcctcgtggtgagcgcgctctgcgtcgccttctacgtcctcggtgcgtggcagaacaccacagtgcccaagccggcggcgagctcggcgatcaccaaggttggctgcgacccggcggcggcggggcagtcctccgccgtgccgtcgttcgggtcggcctcgcaggagtcactcgacttcgaggcgcaccaccagctcagcctcgacgacacgggcgccgaggcggcggtgcagccgttcccggcgtgcccgctcaacttcagcgagtacacgccgtgcgaagacaggaagcgcggccggcggttcgagcgcgcgatgctggtgtaccgggagcggcattgccccggcaaggacgaggagatccggtgcctcatcccggcaccgcccaagtacaggacgccgttcaagtggccgcagagcagggacttcgcctggttcaacaacatcccccacaaggagctcagcatcgagaaggccgtgcagaactggatccaggtggacggccagaggttccggttccccggtggcggcaccatgttcccgcgaggcgccgacgcctacattgacgacattggcaagctcatctcgttgacggacgggaagatcaggacggcgatcgacacaggttgcggggttgctagctggggtgcttacttgctgaagaggaacatccttgcaatgtcgtttgcaccgagggacacccatgaagctcaggtgcaattcgcgctggagcggggtgtgccggccatcatcggcgtgatgggaaagcaacggctgccttacccatctaggtcatttgatatggcacattgttcacgctgcttgattccttggcatgagtttgatggaatatacctagctgaagtcgacagaattctaaggcccgggggatactggattctctcgggtcctccgatcaattggaagacacactacaaggggtgggagaggactaaggaagacctcaaggaagagcaagacaatattgaggatgtcgcgaggagcctttgctggaacaaggtggttgagaagggggatctctccatctggcaaaagcctaagaaccaccttgaatgtgccaacatcaagaagaagtataagacaccccatatatgcaagagtgacaatcctgatgctgcctggtacaagcagatggaagcatgtgttactccattgcctgaagtaagcaaccagggtgagatcgcaggtggagctttggagagatggccacagagggcattcgcggtccctccaagggtgaagaggggtatgattccagggatagatgcgagtaaatttgaggaggacaagaagttgtgggaaaagagggtggcgtactacaagcgcaccctacccatagccgatgggagatacaaaaatgtcatggacatgatcgcaaacttgggcggatttgctgcttctttagtgaagtaccctgtgtgggtgatgaacgtcgttcccgtaaattcagaccgggacacgcttggagcaatttatgagcgaggattcattggcacgtaccaggactggtgtgaagctttctcgacgtatcccagaacctacgacctgttgcatgctgataatttgtttagcatctatcaggacaggtgtgacataaccaacatcctcttggagatggacaggatcctgaggcccgagggcacggcgatcatccgcgacacggtcgacgtcctcaccaaggtccaggcgatagcgaagcggatgcggtgggagagccgcatcttggaccatgaggacgggcccttcaacccggagaaggtccttgtggcggtcaagacatactggactgctgatgaatcagagcagcactagcacactgcacacagcacagaacacaggctcggctacctctctgaagactgaagaagtctgaacccccgattgttttcagagctgtgatgatggcatcggagttttgccatttcggtgtaacataacagaagatatcatctggtcacttgttttcttcctcctttcgctaattctttctatatcaaaggaaaagttatggatggtttttggggtgagattgggcatggttggatgatacatgagtttgttagcaaggggaagaaatgcaaatcttgcataggttcctgccccagtttcacgcatggagcagacagcagaggataggttttttagcttgtaatatgatggcgtccaagtatccaacagacactgttaatctatattgaggttaactaagataggtatttatctagtttatctgtgttagctcttggaattatcagtttattagttaattaagttcttgatgctccttaaaacg

SEQ ID NO: 5383 - DNA, 2438 bp, Oryza sativa
  Predicted polypeptide sequence is orthologous to G274
ggcgtcctctcttcttccgccgtggactcatcgtctccaacgccacacgacacgacgcgacgcgacgcgacgcgagaaaaagtcaaaagcagcagcagcggcggagcaaccaagcctacctccaccaaaatcttctccccccctctcctctcctctccacccgccggtgacccgagcccccccaccgcctcacgccgccgccgccgccgccgcggggagttccattccaccgggtcgccttccggccgtctcctgcagagaggttcatgaggggctcgaggatgaatccaggtgaccgtagaacgcggagcacgatgtccatcgtaattgtgatgagtttgtgctgcttcttttatatactaggagcttggcagaaaagtgggaccggaaggggggatagtattgcattgagggtgacaaaagagaccgactgtacaatcttgccaaacttgcactttgagacccatcatagcttaggtggtgttaatcctttggtcatgaccgataaagtctttgagccatgccatattcgatacagtgactatactccttgtcaggatcagaaccgagcaatgaactttcctagagaaaatatgaactaccgagagaggcattgtcctacagagactaagaaactgcgctgtctaatcccagcacccaaaggctatgtcaccccttttccttggcccaagagccgtgactatgttccatatgcaaatgcaccatataagaatttgacagttgagaaggctgttcagaactgggtccagtttgagggagatgtgtttagatttccaggaggggggacaatgtttcccaatggagcaaatgcctacattgatgagcttgcatccgtcattccatttactgatggcaccattaggactgcacttgatactggatgcggggttgccagctggggtgcttacctaatggacagaaatgtattaaccatgtcatttgcacctcgagactcacatgaagctcaggttcaatttgcattggagcgaggtgttcctgcagtaattggagtgcttggaactataaaactaccatacccctctggatcttttgatatggcccattgctcacgctgcttaatctcctggaagtcaaatgatgcgatgtacatgtttgaagtagatcgggttctgaggcctggtggctattggatattgtctggtcctcccatcaattggaagacaaatcaccaagcatggaaaagatccaaggaagacttagaggcagaacaaaatgtaatcgaaaaaattgctgaaatgttgtgctggggtaagattcatgagaagggagatactgttatttggcgcaaaaaggcagattcaaatgaatgtcataataaggatgaccatcctagcaagatgtgcaaaattcaagatgcagatgatgtctggtataagaaaatggaaggttgtataacacctttcccggaagaagcacagctacggaaattcccagagagactatttgctgcccctcccagaattctacagggtcgcaccccaggtgttacagaagaaatttttgaggaggataataagttgtggaagaagtatgtcagtacttacaagaggataaacaagctgataggttctttgaggtataggaatattatggacatgaacgcagggcttggaagttttgcggcaattattgattctccaatatcttgggtaatgaatgttgtgcccacaatatctgagaagaacactcttggtatcatttacgagcgaggtcttattggcatataccatgattggtgtgaagccttctctacatatcctaggacatacgacttgatacatgccaatggtctcttcagcttataccagaataagtgcaacatggaagacattcttctggagatggataggattttacgtcctgagggcgcagtcatactgcgggacaatgttgaggtgctgaacaaggttaggaggacagtgatggggatgcggtggaaatccaagttgcttgatcatgaagatgggcctcatatacctgagaagattttggtttcagtgaaaaagtattgggttggcaatgaagaagaaaacagttcatagataccctttttttatgttgtacctgttcatagatccggttcatacttcataggtacaggcctcaccattcccaatcaagatgacatacaggtagagtattttttatgtcctgcatattggttgtgcatatacagaagcagggcattaagggcaaacgttggtgatttgccaacacattttgtaggtaaagaggaagatagtttgtgctgagatgaacgtacccattgtattacagatccacacaggaacattttccgagtgaacaagtgttgccccatgtattttgtttgtgctgcttgtacaacatggaacattagcagtacatgtacaagtaacaaggagacaaggagttgt

SEQ ID NO: 5384 - DNA, 3063 bp, Oryza sativa
  Predicted polypeptide sequence is orthologous to G274
gagaaaggcgaatcgccccaatcccacaagaggcgaggggagagaggagagcgcgcagcgggagcagcagaagccgccagccagccatggcggtgggcgcgaccgccacgaagctgcacatgccgtccgcgggcggccgccgcccgtccctgttccacctcgcggccgtcgcggtgctctgcacggtgtcctacctcatcggcatctggcaccacggcggcttctccgcctccccggccggcggcgtcgcctcctccgtctccatcgccaccaccgcctccgtctcctgcgtctcccccaccccgacgctccttggcggcggcggcggcggcggcgactcctcgtcgtccgcgccgctcgacttcgcggcgcaccataccgcggaggggatggaggtggcgtcgggccaggtgcaccgcacgtacgaggcgtgcccggccaagtactccgagtacacgccgtgcgaggacgtcgagcgctcgctgcggttcccgcgggaccggctcgtgtaccgggagcggcactgcccgtcggagggcgagcggctccggtgcctcgtgccggcgccccaggggtaccgcaacccgttcccgtggccgaccagccgcgacgtcgcgtggttcgccaacgtgccgcacaaggagctcaccgtcgagaaggcggtgcagaactggatccgcgtcgaaggcgaaaagttccggttccccggcggcggcaccatgttcccccacggcgccggcgcgtacatcgacgacatcggcaagatcatccccctccacgatggatccatccgcaccgccctcgacaccggttgtggggtagcgagctggggcgcatacttgctgtcacgcaacatcctggccatgtccttcgcgccacgtgactctcacgaggcacaggttcaatttgcactggaacgtggtgtgccggcgatgatcggtgttctttcatccaaccggctcacctatccagctcgtgcctttgacatggcacattgctcccgctgcctcattccctggcagctctacgatgggctgtacttggctgaggtggatcgcattctgcggccaggagggtattggattttgtctggacctccaatcaactggaagaagcactggaaggggtggcagagaaccaaggaggacctgaatgcagagcagcaagcgattgaggcagtggccaagagtctttgctggaagaagatcacgctcaaggaggttggtgacattgccatctggcagaaacctactaaccacattcactgcaaggcctcccgcaaagtcgtcaagtccccacccttctgctcaaataaaaatccagatgctgcatggtacgataagatggaggcttgcataactcctctcccagaggttagtgacataaaagagattgcgggtggccagttgaagaaatggccagagaggctcactgcagtgccacccagaattgccagtggtagcattgagggtgtcactgatgaaatgttcgtggaagacaccaaactatggcagaagagggtcgggcactacaagtccgtgataagtcaatttggacagaaaggacggtaccgcaacttgcttgatatgaatgcgcgctttggcggcttcgctgcggcattggtggatgaccctgtgtgggtcatgaatatggtcccaactgttggcaattcaacaactcttggggttatatacgagcgtgggctcatcggaagctaccaagactggtgtgagggcatgtccacgtaccctcggacctacgacctcattcatgccgattcagtgttcacgctatacaaggacagatgccagatggacaacattctgctggaaatggacagaatactgaggcctgagggtacagtgattataagagatgatgttgatatgttggtgaaaataaagagcattaccgacggtatgagatggaacagccaaatcgttgatcacgaagatggcccgctcgtccgggagaagctcctccttgttgtaaagacatactggacactcggggaagaaaaggaatagcaataacgtgaaataaagtgttagaaaaaattgacatattgggcaaatatcgtaatcggcttaccatttgccttgtggatttgaagtttctttttccatttcattctttgggtggaatagttcacatatggagttcagccctcgatgtttaggtgtaaaagaggtgctgagaaggaaaccctgcaaagttttttacattaaaggacaaccaaagtattccaggtctggtttctacggtcagtagcattcttcatgcgctgtcatcaggcattttagtacggagtaccagtgtaccaccatagtacgcctactctccctagaacagtagaactaccgtggaatgtttacatggctagacgcaaattgtctgaactgcctttacgtttgctcgcacatgctactggagtgctgaactcaactactatgcctgtgaggtttgactctggattcagctgaaaatttggtggcccacactgagcgtaccatatgcattcgtctacactaactccagatcttgcaagtaatggactaacggctaattaaagagttcatcaccattggcatgcatgcaatgcgacggcaacagaacgcactggtccccgacaggaggagcagaagaaacaattcacttttgggcgatcggtgcatgtattgaaatgatgaggacacttgacagaccacgaggtccccctgtcacaaggattcatctgagatatcccccattatccaccggaagaacagtgatgcataccaccttacagctaaccaaagtgtcaatctcacctaacgctgcaataacagagctcttaacagtggcatctctgtatacaataggagggctactggttactggttagctcgcaacagtggttacttgttagctgttgagctagcaatggcaatcagtctatataggatgctagtggtagtggttaagaatcttctgtcaaggacatgcacggagaaaaaataattgacatttagtttgtggtaatgccataggccagagcaaataatacagtaaattttcatgtcc

SEQ ID NO: 5385 - DNA, 2289 bp, Oryza sativa
  Predicted polypeptide sequence is orthologous to G274
ggggcagcgtgacagtgtgtcccccccgcctcgccacctaaaaccccacaccacagagcgcagtgcacgactgcacggcccgcgccatagacagcacacgctccggggagctgaagcggagctgaggctgtctgtcggcatgggggtccgcccggcggccaccaagctgaacatctcccccgccgccgcgcggcgcccctcctccttcctgcccatcgccaccgtggcgctcctctgctccgcgtcctacttcctcggcgcgtggcagcacggtggcttctcctccccctccgcctccccatcctccgtctccgtcgccaccgctgtcgcctgcaccaccaccaccaccgccaccacccgctccgccacgcggccgcggaagcggacgcccgcggggcaggggcaggcgctcgacttctcggcgcaccacgcggcggccgcggacggcgccgtgctcagctcgtccggggattcggcggcgacgcggaggtaccaggcgtgcccggccaggtactcggagtacaccccgtgcgaggacgtgaagcggtcgctgcggtacccgcgggagtggctggtgtaccgggagcggcactgccccacggggcgggagcggctgcgctgcctcgtgccggcgccttccgggtaccgcaacccgttcccgtggcccgccagccgcgacgtcgcgtggttcgccaatgtgccgcacaaggagctcaccgtcgagaaggcggtgcagaactggattcgcgtcgacggcgacaagttcaggttcccaggcggcgggaccatgttcccccacggcgccgacgcgtacatcgacgacattgggaagctcatcccgctccacgacggctccgtccgcaccgcgctcgacaccggctgcggggtggcgagctggggcgcgtatctgctgtcccgcgacatcctggccatgtccttcgcgccgcgggactcccacgaggcgcaggtgcagttcgcgctggagcgcggcgtgccggccatgatcggcgtgctcgcctccaaccgcctcacctacccggcccgcgccttcgacatggcgcactgctcccgctgcctcatcccctggcacctctacgatgggttgtatctgatcgaggttgaccgtgttctgcggccgggagggtactggatcctgtccgggccgccgatcaactggaagaagtactggaaagggtgggagaggaccaaggaggacctgaacgccgagcagcaggctatcgaagccgtcgccaggagcctctgctggaagaagatcaaggaggctggcgacatcgctgtctggcagaagcctgccaaccacgccagctgcaaggcctcccgcaagtccccgcctttctgctcccacaaaaaccccgacgcggcatggtatgacaagatggaggcctgcgtgacgccgctcccggaggtctcagacgccagcgaggtcgctggtggcgcgctgaagaaatggccgcagcggctcaccgccgtgccgcccaggatatctagaggtagcatcaagggcgtgacatcgaaagcgtttgtgcaggacaccgagctgtggaggaagcggattcagcactacaagggggtgatcaatcagttcgagcagaaaggacgataccgcaatgtgctcgacatgaacgccggcctcggcggtttcgccgcggcattggccagcgaccccttgtgggtcatgaacatggtccctaccgttggtaactcctccacgcttggggtggtctacgagcgtgggctcattggaagctaccaggactggtgcgagggcatgtccacttatccacggacgtacgatctcatccatgcggactcggtcttcaccttgtacaagaacaggtgcgagatggatatcatcctgctggagatggacaggatcctgaggcccgagggcacggtgatcatcagagacgacgtggacatgctggtgaaggtgaagagcgccgcggacgggatgaggtgggacagccagatcgtcgaccatgaagatggcccgctcgtccgggagaagatcctcctggtcgtcaagacgtactggacagccaaggagcaagaccaatagcagcagtagtgtgaagaattgaattactgcaagccagcagcaacaacattgttgagaagttcccgtaatcgggtcgccatttctagctcgtttcttcagttaaggtttttttatgttcttttggactgtagcactatagaagatttgtactgcctggtaggtgtaatacagggcagaatatgggaaggggtggatattacaaagatttt

SEQ ID NO: 5386 - DNA, 1857 bp, Oryza sativa
  Predicted polypeptide sequence is orthologous to G274
atgctgctgcgtaccatgaagctcccgctccccgccatggccgccgtcgtggcgctctgcgccgcctcctacctcctcgccgtgtggacgcaccctgccccgccgctccccgcctcctccctcgccgccgtcccgtgcaacacgcggcagccaccggcgcccgcggcctcgaagaacgacaccgccctcgacttctcgatccaccacggcgcgtccgaggaggacgcggccgaggcgggggcgccgccatcgcgccgcgtcccggcgtgcgacgcggggtactcggagcacaccccgtgcgaggggcagcggtggtcgctgcgccagccgcggcggcggttcgcgtacagggagaggcactgccccccgccggccgagcggcggcggtgcctcgtcccggcgccgcggggctaccgcgcgccgctccggtggccgcggagccgcgacgcggcgtggtacgcgaacgcgccgcacgaggagctggtgacggagaagggcgtgcagaactggatcaggcgggacggcgacgtgctccgcttccccggcggcgggaccatgttcccgcacggcgccgaccggtacatcgacgacatcgccgcggcggccggcatcacgctgggcggcggcggcgcggtcaggacggcgctggacaccggctgcggggtcgcgagctggggagcgtacctgctgtcgcgcgacgtgctgacgatgtcgttcgcgcccaaggacacgcacgaggcgcaggtgctcttcgccctggagcgcggcgtcccggccatgctcggcatcatggccaccaagcgccttccttacccggctcgcgccttcgacatggcgcactgctcccgctgcctcatcccctggagcaagtacaacgggctctacatgattgaggtggaccgggttctccggcccggcgggtactgggtcctgtcagggccgccggtgaactgggagagacatttcaaggggtggaagaggacgccggaggacttgagctccgagcaatcggccattgaggccattgccaagagcctttgctggaccaaggtgcagcagatgggtgacattgctgtttggcagaaacaaatcaaccatgtcagctgcaaggctagcagaaatgagcttggtggtcttggtttctgcaattccaaccaagatcctgatgctggctggtatgtgaacatggaagagtgcatcactcccctaccggaggtgtccgggcccggagacgtcgccggaggggaggtcaagagatggccggagaggcttacatcgccgccgccgaggatcgccggcggcagccttggaagcagcgtcacggtggacacctttatcaaggattctgagatgtggaggagacgagtcgatcgctacaagggcgtcagcggcgggctggccgagaaaggccggtaccggaatctgctggacatgaacgccggcctcggcggcttcgcggcggcgctcgtcgacgatcctgtctgggtgatgaacgtcgtgccgacggccgccgttgccaacacgctcggcgtgatctacgagcgagggctcatcggaacgtaccaagattggtgtgaggcgatgtcaacttatcctaggacgtatgatctgatccatgcgtactccctgttcacaatgtacaaagacagatgtgaaatggaggacattttgctggagatggaccgtgtgctgaggccagaaggcacggtaatattcagagacgatgttgatgtcctggtgaagatcaagaacatcgcagacgggatgagatgggagagcaggatcgttgatcatgaggatgggccgatgcagagggagaagatccttgtgtctgtcaagtcttactggacagcctaa

SEQ ID NO: 5387 - DNA, 2310 bp, Oryza sativa
  Predicted polypeptide sequence is orthologous to G274
gatgaatccaagatccgcttctttctcctgcggttgctctgcgctctcagcaccaaccaaatccccctccaattcctcatctttcttgaccaattcttgaaatcaatcagacgcaataatcaaccactattcttattatagttggatcataattaatcaaggtttgaggtggatccatggcgatcaagggcggcggcgggtcggcggagaacagggggcggagcccgctcgccatggtggtcgccgtcggcctctgctgcttcttctacctgctcggcgcgtggcagcgcagcggctacggcaagggcgacagcatcgccatggccgtgaaccggcagacggcggcctgcggcggcgtggggctgagcttcgagacgcaccacggcggcgccggcgtggagaacgagaccatggcggcgccggcgccggagttcgcggcgtgcgcggcggcgatggcggaccacacgccgtgccacgaccaggagcgcgcgatgaggttcccgagggagaacatggtgtaccgggagcggcactgccccggcgacggcgagctggctgcggtgcctggtgccggcgccgccggggtacgtgacgccgttcccgtggccgcggagccgcgactacgtgccgttcgcgaacgcgccgtacaagagcctcaccgtggagaaggcggtgcagaactgggtgcgacacgagggccgcctcctccgcttccccggcggcggcacccagttccccggcggcgccgacaagtacatcgaccagctcgccaccgtcgtccccttcgccgacggctccgtccgcaccgtcctcgacaccggctgcggcgtggcgagcctgggcgcgtacctggacgcgaggggggtgatcgccatgtcgttcgcgccgcgggactcgcacgaggcgcaggtgcagttcgcgctggagcgcggcgtcccggcgttcatcggcgtcctcggctccatcaagctccccttccctccccgctccttcgacatggcgcactgctcccgctgcctcatcccctggtccgccaacggtgggatgtacatgatggagatcgaccgggtgctccgggcggatggctactgggtgctctccggcccgccgatcaactggcggaccaaccacaaggcgtgggagcgcacggaggcggacctcgctgccgagcagcagctgatcgaggagtacgccgcgatgctgtgctgggagaaactcgccgagatgggcgaggccgccgtgtggcgcaagcgccccgacgccgctgttgtgtcttgccccacggccacgccggcgccgccgaggacgtgcgacgccgccgccgccagccccgacgacgtctggtacaagaagatggagccgtgcatcacgccgccccaagcggccggcgaggtgatgctgcggccgttcccggagaggctgacggcggtgccaccgagggtggccgccggcgaggtgccggggctcaccggcgagtcgtacgcggaggagaacgcgcggtgggagaggcatgtggcggcgtacaggaaggtgaactaccggctcgacgccggcccggtaccggaacatcatggatatgaatgccggcgtcggcgggttcgccgccgccgtcttctcgcccaagtcgtgggtcatgaacgtcgtccccaccgccgccgagctctccacccttggcgtcgtctacgagaggggcctcatcggcatcttccatgactggtgtgaggcattctccacttacccaagaacatatgacctcatacatggcaatggtgtcttcactctctacaaggacaagtgcaagatggaggacatcctgctggagatggatcggatcctgcggccggagggcacggtgatcctccgggacgacattgaggtcctcctcaaggttcagaggatcgcgagcgggatgcggtggaagatgatcatggcgaaccacgaggacagcccccacataccggagaaggtgctctacgccgtcaagcggtactggaccgccgacgacaagagctcggagccggagccagagccggagaagatgaagaagaaggcggggagctcttcacaagagaggagctccgaggaggaggaggagagtacagcaagttcttcagaagagaagggttcagaggagtaagaggtgctgatcatgtgtgattattttcagttgttggggagttcaattcttttcagtgtgataggggagatcaggagttgtgttctttcgatttgatgattgtcttaggatgaacaatatgatgttcggtagcaggacttagcatttccatagattcaagaagcatatacttt

SEQ ID NO: 5388 - DNA, 2538 bp, Oryza sativa
  Predicted polypeptide sequence is orthologous to G274
tcgatcctggggggtctgagctaatgcgcgccgccccgatctcccgatccggtccgcgcgcgctcgatccccgcgcctgatttctcctccccgcccgtcgccgaggagagctccgtccagtgaggtatggcgcggagttcaactgagagcaggaccaggaccactgtatctgtagttgttttatttggcctttgttccttcttctatctcttgggtgtgtggcagagaagtggtttcggaagaggagacagcatagcagctgtggtgaacgaacagactaaatgcgtggttcttccaaacctgaattttgaaacccatcatagtgcttcagaccttcctaatgatactgggagtactgaggttaaaactttcgagccatgtgatgcacagtacacagattacactccctgtgaggagcaaaagcgtgcaatgaccttccctagggataatatgatatatcgggagaggcattgcccacctgaaaaggataagctctattgtctggttccagcaccaaagggttatgctgctccttttcattggccaaagagccgtgattatgttcattatgcaaatatccctcacaagagcctcacggttgagaaggctatccagaattgggttcactacgagggtaaagtgttcaggtttcctggtggtggaacacagtttcctcagggtgcagacaagtatatagaccatcttgcttctgttatcccaatagccaatgggaaagtgagaacagcactcgacactggttgtggggttgctagtctaggtgcttacctgttgaagaaaaatgttttgaccatgtcatttgcaccaagggataatcatgaggctcaagtacagtttgcactggagagaggtgttcccgcatatataggtgttctcggatcaatgaaactgtcattcccatcacgtgtctttgacatggcccactgctcaaggtgtttaattccatggagtggaaatgatggaatgtacatgatggaagttgatagggtactaaggcctggagggtattgggtactctcaggcccaccaattggctgaagattcactataagggatggcaatgaacaaaggatgatcttcaaagtgagcagagaagaatagaacaatttgcagaacttctttgttggaataagatttctgagaaggatggtattgctatatggagaaagagaataaacgacaaatcctgccccatgaaacaagaaaatccaaaagttgacaagtgtgagttggcatatgacaatgatgtatggtataagaaaatggaggtctgtgtaactccccttcccgaggttaaaaccatgacagaggttgctggtggtcaattagagccatttccccagagactcgatgcagtacctcccaggattacccatggttttgtacctgggttctcagtccagtcatatcaagatgacaataaactttggcagaaacatattaacgcttacaaaaagatcaataacttgcttgatactggaagataccgtaacataatggacatgaatgctggccttggtagttttgctgctgcattggagtccacgaagctgtgggtcatgaatgttgttccaaccattgcagatacttctacattaggtgtaatctacgagcggggattaataggaatgtatcatgattggtgtgaaggattttctacatatccaaggacatatgatctcatacatgctaacgctgtgttcagcttatatgagaataagtgtaaatttgaagatatactattggaaatggaccggatcttacgaccagagggcgcagttataatccgtgacaaggttgatgttcttgtaaaggtggagaaaatagctaacgccatgaggtggcagacaagattgactgatcatgagagtggccctcatgtgcctgagaagatactctttgcggttaaacaatactgggttgttgaaagcaagagcagctaattacatatgctgggttgtttttttccactgagctcccaacaagacctaagacatgacttaattacatatgaagggtatgcatcatctacctcctctgtaaacttatagccactgtagtcaggaatgaactcttggcagcttgagttttccgaaaagttagcacccttgcaatgtggccttgccagttcttttcaaggtaaattgcactgcaggtataaatctttttcaaaaccggctgcctcagtcttgacaatctcaaccacaggtttcatcttttgatgtaaatggcttggatttgaaagttcatgtatgcaaggcttgtcatgaccgtatttcttttagccagttttgtctagccttagctggtgcgacaatttgagaatgctcaaactggcctctaatcttgcttgtttggtgcatttgtgttctaaggaggtgtcgcactgtaatgaaactgagatccataagattctagtattctgatcgtctgaaccgaggtgaccaataatcaaatttagctacgtatgtaatagttttttttctgttggtaacagacgaacgatttatttttagtgct

SEQ ID NO: 5389 - DNA, 2322 bp, Oryza sativa
  Predicted polypeptide sequence is orthologous to G274
gggagtacccttcattcccttgcggcgtaaaagaaagagaaaaatctcccggggcgtctcgtcgtctcctccgctcctcgcgcaggacgagtcgcggctgccgatctccatctgcgccaggggaatcctggtgtaatggcaaaagagcagagtggatcccctaagcccaggcagccagtgttccaaaggatgcgagtaacgttaaccataggtgttattggcctctgtgttgcatcatacattcttggtgcttggcaaggcacttcaactactagtatacacccatccataatctacactaaaagccaatgtggtgaatccattttgcgcacctccagcaattcgtctggacggtcatcatcagacgctcgtcttgatttccaagcccaccatcaggtgagcttcaatgaatcttcacttgtcgccgaaaaattcccaccttgtcagctgaaatacagcgagtataccccttgccaagatccaaggagagccaggaaattcccaaagacaatgatgcagtacagggagagacactgccctcggaaagaagagcttttccggtgcttgattcctgcaccaccaaagtataagaatcccttcaagtggccacaatgtcgggattttgcttggtacgataacattcctcatcgggagcttagtatcgagaaagctgtccagaactggattcaagttgaggggaaacggtttagattccctggaggcggcacaatgttcccacatggtgctgatgcctatatcgatgacatcaacgctctcatatcattaacggacggcaacatcagaactgcgcttgatactggatgtggggtggcaagttggggcgcttatcttattaagaggaacatcatcactatgtcatttgcacctagagattcacatgaggcacaagtgcagtttgcattggagcggggagtgccggccatgattggagtgatatccacggaaagaatcccataccctgctagatcatttgacatggcacactgctctagatgtttgatcccatggaataagtttgatggtatctatctaattgaagtagacagagtaattagaccaggaggctactggatcctctctgggcctccaatccattggaagaagtacttcaagggctgggaaagaacagaagaagacctgaagcaagagcaagatgagattgaggatttggcaaagcgtctctgctggaagaaggtggtagagaaagatgatcttgctatatggcagaaacctatcaaccacatagagtgtgttaatagtcggaagatctatgaagcccctcagatttgcaagagcaatgatgttgactctgcttggtacaagaagatggagacatgcatatcacctcttccggatgtgaatagtgaagacgaggttgctggtggagctcttgagaaatggccaaaaagagcatttgctgtgcctccaagaataagtcgtggatcagtttcaggcctcaccacggagaaattccaagaagataataaggtgtgggcagagagagcggattactacaagaaattgattcctccactaaccaaggggcgatataggaacgtgatggatatgaatgcagggatggggggattcgcagctgcattgatgaagtatccactttgggtgatgaacgtggtaccttcaggctctgctcatgacacccttggtattatctatgagaggggattcattggaacctaccaagactggtgtgaggctttctcaacgtatccgaggacatatgacttcatccatgctgataaaatattcagcttttatcaggacaggtgtgacgtaacatacattctcctggagatggaccggattctaaggcctgaagggacagtgattttcagggacacggtggaggtgttagtgaagatacaatcaattacagaaggcatgcggtggaagagccaaataatggatcacgaatctggtccattcaaccctgagaagatacttgtggctgtcaagacttactggactggacaacccactcaaaagcagtagtggcttttcttttcagcagcagatgttcccttttggtttttccaattttcgtttagctccaggttcaggttgtgtgtaaatatgaggcgatgtgattgggatagtatcaccacgatcttgtggccttggttcattggctgcattgcattcttgtgagttgtgatgcttacatttctataataggcagataaaatgttctttttcttcagtaaaaagaacagggcaagcctgaccttgttattttccttgccaaagtttattgacaaaaaaaaagggtgctatggtacaacg

SEQ ID NO: 5390 - DNA, 410 bp, Oryza sativa
  Predicted polypeptide sequence is orthologous to G274
tttttaaccagagaaaatgattcatcgtaggtaattcgagccctcaaacagatttcataaagcttgagtatcttacttttttttgtacagggtgaaaaggccactagcgtggataagatcatactttcttgggcctgagatgaaacacctggaatcagcccattaacaatccttggaggaactgcattgagcctgcttgggaagggcttgattccacctccagcaacttcacttggatcatttacatcaggaatagttgtcacacaaggcttcatcttcttgtacctagtattacagtggtaagaaaaaaaaataggatgagaaagagattatacaatgtttaaaccagatcagtatgtttgtaatctattagtggacgtaattctacaaatgttatactatcataaatc

SEQ ID NO: 5391 - DNA, 3015 bp, Oryza sativa
  Predicted polypeptide sequence is orthologous to G275, G837
actttcttctgaacaaacaagatcaatcgatacccaatggagatggatggctgcttgctgtcaccagaggacaccccttgattaacaacactccatctccctcagagaagaagaaattctgaattttgaacaagcatatatatatatatatatttgcagagaaagagagaagagatagctgcattgcatgagctgaagggaagaatggcgctgtttgatcggaatcagaagcagcggtcgtcgctgtgctcgacggcgaccgtcgtcgtgttcgtggcgctctgcctcgtcggcctctggatgatctcctcgccggagaccatcccggcggcggcggccaacgtcagcaagaagcccgacgtcgtcgccgtcaaggaggaggacagctcgctcgacgccaccaacaatgtcaaacagaacagcgccaacgtcgtcgccgagaccgccgccgccgacgaggccgccgccgcagacgaggacgacaaccccgcgaagccggccgccggcgagaaggcggcggcggcggcggcgtcgtccaaggaccagacgttcgacgacgagaacggcaggacggagggcggcgcgctcgtcaagccggagagcggcggcggcgacgaggcggcctccgacgtgaaggagatcggcagcctcgagcaggcggcgatcgacatgaaggacaccaccgagcactcggtgggtgacaccaccaaggagccaggcgtcgtccaggacaagagctccgaggagatcacgatggcggcgagcgacgcgagggagagcagcgatggcggcggcggcggcggcgcggccaagaacaagcagacgttcgacgacgagaacggcaagctcgacggcgtcaacctggtgaaggacgtcgagaacaagacgatgtcggaggagggcgccaagccattgccggaggagacgacgaccgtgagcagcaagaactcgatcgtcgcggcggccgccatgtccgacgagaagctcaccgacaacaatggcgagcaagcgcagccggtggaggcgctgccgaacgggcaggccgagctgctgacggagcgcgcggcgcagaatgggtcgttcacgacgcaggcggcggagtcgatcaaggagaagaagaagcgcgccgagaagaagaaaaagaagaagaagaaggtgaaggcggcgtcggtggcggcggcggcggaggaggagggcggcggcggcggcgcggcgtcgttgggctggaggctctgcaacacgagcgccggcgccgactacatcccgtgcctggacaacgaggccgccatcaagaagctcaagacgaccgcgcactacgagcaccgcgagcgccactgccccgcctcgccgccgacgtgcctcgtcccgtcgccggaggggtaccgggacccgatccggtggccgcggagccgcgacaagatctggtaccacaacgtgccgcactcggagctcgcggcgtacaaggggcaccagaactgggtgaaggtctccggcgagtacctcaccttccccggcggcggcacgcagttcaagcacggcgcgctccactacatcgagctgatccagtcgtcgttcccggaggtggcgtgggggcggcgcagccgcgtcgcgctcgacgtgggatgcggcgtggcgagcttcggcggttacctgttcgaccacgacgtgctgaccatgtccctggcgcccaaggacgagcacgaggcgcaggtgcagttcgcgctggagcgcggcatcccggcgatctccgccgtcatggggacgcggcggctgccgttcccgagcaacgtgttcgacgcggtgcactgcgcgcggtgccgggtgccgtggcacatcgagggcgggatgctgctgctggagctcaaccggctgctccggcccggcgggttcttcgtctggtcggccacgccggtgtaccaggagctgccggaggacgtcgagatctggggagagatggtgaagctgacgaaggcgatgtgctgggagatggtgtcgaagacgagcgacacgatggaccaggtggggctcgtcacgttccggaagccggcggacaacgcgtgctatatgaagcgccgccagaaggagccgccgctctgcgagccctccgacgaccccaatgctgcttggaacataactttgcgggcgtgcatgcactgggtgcctacggacccatcggtgcgggggtcgtggtggccggagcggtggccggagaggatggagaagacgccctactggctgaacagcagccaggtcggggtgtacggcaagccggcgccggaggacttcgtggcggaccaggagcactggcggaaggtggtccggaactcgtacctcaccggcatgggcatcgactggaagacggtgaggaacgtcatggacatgagagccgtctacggagggttcgcggcggcgctgcgggacatgagcgtgtgggtgatgaacgtggtgacgatcaactcgccggacacgctgccggtgatctacgagagggggctgttcggcatctaccatgactggtgtgagtcattcagcacctacccgagatcctacgacctcctccatgccgaccatctcttctccaagctcaaatccaggtgcgaggtgttgccggtgatcgtggaggtggaccggatcctccggccgaacgggaagctcatcgtgagggacgacaaggagacggtggacgagatcaagggggtggtgaggtcgctgcaatgggaggtcaggatgaccgtctccaagaacagggaagcgatgctctgcgcgaggaagacgacgtggcggcccacggaagccgaggcaagatgacctcgccgtcaccggccggcgatccatgtagtagagtcttttggtcggttgatccggtggtagctgcaatacttagcacgtacagggtgatctacactacactgggtgctgcagcattgcaataactgagctagatattactggagcttgtagctttttttttgggggggttttgttcttcagatttttttttatagttttatactg

SEQ ID NO: 5392 - DNA, 2988 bp, Oryza sativa
  Predicted polypeptide sequence is orthologous to G275, G837
ggttggttgtttccatgtttgttcagacaaggggagatttgcttgctagggaagatggaaataatcgatttttgcgtgcaatggaatgcatataattttttccttttttttggggcattgttcaattggtgtcactgatgggcagatccagtgtttccttgtttggatctactgatcgggtttaatcttttatacacttcgagtttctgatgatatgttgtggtttgctgtgctctaggtgtgagagttcttgatcgggtcggcataggggttttgttctgcagtacatgcgagagtgtgattgatggcatttggccgaggctcgaagatggacggcaggcggtcgtcgccgtcgtcgtcgctctgcacgacgaccaccgtcgtcgtgttcgtggcgctctgcctggtcggcgcctggatgatgacgtcatccaccatcttcccgctggagataacctcgaataagaaggcggcggtgaaggagcagccggcgagagttaactacggcgcgtccgaggaggcagcggcggcatccggcaacagtgctgaaggtgtggacaggtttggggacacggacaacaacgataatgcggttccggaggagccgaataacacggtcccttctgaagaagagaagttcagtgagaacacagtggagaagccagtggagagcagtgaagagaaggcgccaccgaaagaaaaggaggagagtaaggatacatttgatgatgcaaatgggaaaacagaacagtcgagcgccaaggaggatggggattctgaatcaggatctgggcagtcggatggttcaaagaatggcgacgacgaggagaagagtgaggagaagaaagatgatgagcaatctgatggtgagaggaaagatgatcaagaagagaaggctgaaggcagtggctcaaaggacacgactgaccagccacaaattgaggagacagtggatgaaagtggggagaagggtcagggtgcaaagtccaatgaggtattccctgatggggctcaatcagagcttctaaaggagtcaaacaccgagaacgggtcatttaaaacacaggatgcagagtcaaagaatgagaaggaatctcaagcagcatcaaattcttcagatgatgaaaccacatataactggaagttatgcaataacaatgctggaacagattacataccttgcctcgacaatgagaaggctatcaagaagcttcgaaccaccaaacattatgagcaccgtgagaggcattgccctgtggagcctcctacctgtgttgttccacttcctgaaggatataaacgcccagttgagtggcccacgagcagggacaaggtgtggtacagcaatgtcccccacactaagcttgctgagtacaaggggcaccaaaactgggttaaagtttctggggatcatctcctatttcccgggggtggcactcagttcaagaatggtgcacttcactacattgatactattcagcaggcattacctgatattgcatggggcaaacgaagccgtgtcattctagatgttggctgtggagttgctagctttggagggtacatgtttgagagagatgtactcacgatgtcatttgccccaaaagacgagcatgaagctcaagtacagtttgcacttgagagaggtattccagcaatatcagctgtcatgggcaccaaaaggctcccataccccagcagggtctttgatgtcattcattgcgctcgctgcagggtcccttggcacattgaaggtggcatgctattgctggaactgaaccgcctattacgccctggtggttacttcgtctggtctgccactcctgtttaccagaagctccctgaagatgtcgagatttggaatgccatgtcttctctaacaaaggccatgtgctggaaaatggttaacaagactaaggataagttaaatcaagttggtatggccatatatcagaagccaatggacaacagttgctatgagaaaagaccagaaaacagcccaccgttatgcaaggaaactgatgatgctgatgctgcatggaatgtacctttgcaagcatgtatgcacaaattgcctgctggccaatcagtccgagggtcaaaatggccagagacatggccacaaaggcttgagaagaccccctactggatagatgactctcatgttggaatctatggaaaaccaggaaacgaagattttgaggctgattatgctcattggaaacgagtcgtaagtaaatcttatgtgaatggcatgggaatcgactggtctaaagtaagaaacgtcatggacatgagagctgtatatggaggtttcgctgcagctttgagggaccaaaaagtctgggttatgaatattgtgccaacggattcagcagacacgctgcccattatttatgagcgtggcttgtttggtatgtaccatgactggtgtgaatctttcagcacttacccgagaacatacgaccttctgcatgcagaccatctcttctcaaagctaaaaaagagatgcaaattgttgccggtgtttgcggaggtcgacagaatattgaggccagaaggaaagctgattgtgagggataatgcagagacaataaacgaactgcaaggcatggtaaagtcgcttcagtgggaggttcgcatgacctacaccaagggtaacgagggtcttctatgtgtccaaaagtccatgtggcggcccaaggagatcgaggcaagcatgtgaaatatacagatgttcaagagaactgttactggttagtggtacattagactgaattttggctctagatatgcatactattcttgttgattctgaaaaggcataagccttgatgtaattgtagaatcattttttttctttcttgccaaacaaatgcactctatattctcttcttgctgtgctcttgctccattgctgtaaggttgtattggaacctggaagtgtcacaagtgtgacaagtgtcacaggcaaattatgttcaatcc

SEQ ID NO: 5393 - DNA, 2475 bp, Oryza sativa
  Predicted polypeptide sequence is orthologous to G275, G837
ggatttcactccgcttcttcttcttcttcctcctccttgattgagttgtttgctcgatcgatggattgattgtcactgtctgtttagcaatcaagctagctacgaacaggagtgtagtactaatctgcatcgatcagtgcctctaatcttcttcttcttctcttgtaaccagcagcagaagcaagcaatccccctctcctctctgagagagatggcgtttggcagccacacgcgcctggatgtgaggcgggcgcagcagcactcctcattctgctccccctcctccgccgccgccgtcttggtggcgctggccttggtcgccgtctggatggcctcttccacgctcgtcacccccgcggatttctcccccttccgccccacaaccacaaccacaaccacaaccgctcgacctcggaatcggatggatcctgtgactgttgaagaggacgccgacgaccctcctccactcacactcagacagactgagaccggacccggaggggataatggctcccactcccactccccctccctggagaccgctacagaggcagaccctcaagctgcacagtccaacagcaacaccaaggacactccccacaataagcagcagcagcagcagactgcgtcgcccacccccagcagctatgcttggaagctctgcaatactgaggctggtccagattacatcccatgcctcgacaatctccaagccatccgcaaccttcggacgaccaagcactatgaacaccgagaaaggcattgcccccaacaccctcctacctgccttgtccctcttccaaagggctacacaaatccaattaggtggcctaacagcagagatcagatatggtacaacaatgtcccgcatactaagctggtagaatacaagggtcatcagaactgggttaaggtctccggggagtacctcaccttccgggaggaggaactcagttcaaacatggcgcattgcactacattgatttcattcaggaggcaaagaaggatatagcatgggggaaacaaactcgtgtggttttagatgttggttgcggagttgccagctttggaggatatttatttgatagagatgttcttactatgtcgtttgcacctaaagatgagcatgaagcccaggtgcagtttgctcttgagagaggaatccctgctatgtcagcagttatgggtacaaaaaggcttccattccccggcagggtcttcgacgttgttcattgtgcacgctgtagggtaccatggcatattgaaggtggtaagctcttgctagaactggatagactgttgcgtcctggtggctactttgtgtggtctgccactcctgtgtaccagaagctgccagaagatgttgaaatatgggaagcaatgtctactctaacaaggtcgatgtgttgggaaatggtcaataaagtgaaggatagggtaaatagagtgggtatagcaattttcagaaagccaacggataatagctgttatgaggcaagatcagcagcaaaccctccaatctgtggagagtatgatgatcctgatgctgcctggaacatatcattgcagtcatgcgtgcataggttgcccactgatcctgccatccgtggttcacagtggccggtggaatggccattgaggttggagaaaccaccttactggctgaaaaactctgaggctggtgtctatgggaagcctgccactgaggattttcaagcagactatgagcactggaagcaggtcataagcaattcatatatgaatgacttgggcattgattggtcagctgttagaaatgttatggacatgaaagccgcatatggagggtttgcggcagctttgcgagatctgaagctgtgggttatgaatgttattccaattgattcacctgacacacttccaattatatatgagcgtgggttgtttggaatctaccatgattggtgtgagtcatttagcacctaccccagaacctatgatcttctgcacgcgaaccatcttttctccaagattaaaaagagtgacaggtgtaaactagtggcagtgatggtggaggtggatcgaatactgaggccaggaggcagggtaattgttagagatagtatggagacaatgcatgaagtggagtctatggcaaaatcgctacactgggaggtccgcaagtcttactcccaggacaatgaaggtttgctgtttgttgagaagacgatgtggcgaccaaatgaagttgaagctaagctatgacgtaccataccagcaccaccgttatgatagctctgacactgaaacccttggaagaggaaaacaaaagtagccaagtgggggatgcacagtaagctatatatatagtgggtttttgtaggggtatacttggattttgggagaagctgtaatgtgtttttttttttttgcgtgggatgatacattagcaactaatgcatggtgatgatccatgttgaggctggcaagtttaac

SEQ ID NO: 5394 - DNA, 700 bp, Oryza sativa
  Predicted polypeptide sequence is orthologous to G275, G837
acgaggagcactggaaccacgtcgtcaacagctcgtacctcgccggcgtcggcatcgactggagcaacgtcaggaacgtcatggacatgcgagccgtgtatggcgggttcgcggcggcattgaaggacatgaatgtgtgggtgatgaacgtggtgccagtggactcggcggacacgctgccgatcatctatgagcgagggctgtttggcatgtaccacgactggtgcgagtccttcagcacctaccctcgatcatacgacctcctccacgccgaccatctcttctccaagctcaagaaaaggtgcaagctgttgccggtgatggtcgaggtggaccggatcctgcggccggaggggaagctgatcgtgcgggacggccgcgacacggcggcggaggtggagagcatcctgaggtcgttgcactgggaggtgaggatgacggtgtccaagcagggagaggtgatgctctgcgccgagaagacgatgtggcggcccaaggaagtcgagaaggcggcgacgacggcgagctagtagggaagaagttgatgatcatggctagtagtgcttagcaccagaaaaagagttttggcaaatattgtggcacgttgtaataaaaaaatgatggtagatttgagtagaaattagacatgtcataattgagttttgtatacagttttacaaaagagagatggtaattcaaa

SEQ ID NO: 5395 - DNA, 2119 bp, Oryza sativa
  Predicted polypeptide sequence is orthologous to G278, G1290
cctcgcctcgcctcgccacgccgcgccgcgacgcgacgcgccgtggtcagctggtcgccggtgcgggtgcgggtgcgcaatggagccgccgaccagccacgtcaccaacgcgttctccgactcggacagcgcgtccgtggaggagggggacgccgacgcggacgccgacgtggaggcgctccgccgcctctccgacaacctcgccgcggcgttccgctcgcccgaggacttcgcgttcctcgccgacgcgcgcatcgccgtcccgggcggcggcggcggcggcggcgacctgcgggtgcaccgctgcgtgctctccgcgcggagccccttcctgcgcggcgtcttcgcgcgccgcgccgccgccgccgcaggcggcggcggcgaggatggcagcgagaggctggagctccgggagctcctcggcggcggcggcgaggaggtggaggtcgggtacgaggcgctgcggctggtgctcgactacctctacagcggccgcgtcggcgacctgcccaaggcggcgtgcctctgcgtcgacgaggactgcgcccacgtcgggtgccaccccgccgtcgcgttcatggcgcaggtcctcttcgccgcctccaccttccaggtcgccgagctcaccaacctcttccagcggcgtctccttgatgtccttgataaggttgaagtagataaccttctattgatcttatctgttgccaacttatgcaacaaatcttgcatgaaactgcttgaaagatgccttgatatggtagtccggtcaaaccttgacatgattactcttgagaagtcattgcctccagatgttatcaagcagattattgatgcacgcctaagcctcggattaatttcaccagaaaacaagggatttcctaacaaacatgtgaggaggatacacagagcccttgactctgacgatgtagagctagtcaggatgctgctcactgaaggacagacaaatcttgatgatgcgtttgcactgcactacgccgtcgaacattgtgactccaaaattacaaccgagcttttggatctcgcacttgcagatgttaatcatagaaacccaagaggttatactgttcttcacattgctgcgaggcgaagagagcctaaaatcattgtctcccttttaaccaagggggctcgaccagcagatgttacattcgatgggagaaaagcggttcaaatctcaaaaagactaacaaaacaaggggattactttggggttaccgaagaaggaaaaccttctccaaaagataggttatgtattgaaatactggagcaagctgaaagaagggacccacaactcggagaagcatcagtttctcttgcaatggcaggtgagagtctacgaggaaggttgctgtatcttgaaaaccgagttgctttggcaaggattatgtttccgatggaggcaagagtagcaatggatattgctcaagtggatggaactttggaatttaacctgggttctggtgcaaatccacctcctgaaagacaacggacaactgttgatctaaatgaaagtcctttcataatgaaagaagaacacttagctcggatgacagcactctccaaaacagtggagctcgggaaacgctttttcccgcgatgttcgaacgtgctcgacaagatcatggatgatgaaactgatccggtttccctcggaagagacacgtccgcggagaagaggaagaggtttcatgacctgcaggatgttcttcagaaggcattccacgaggacaaggaggagaatgacaggtcggggctctcgtcgtcgtcgtcatcgacatcgatcggggccattcgaccaaggagatgaacaccattgctcccaaatagttgccatattgatagctaactgtcctcctggagctactcacctgatggttgccttctgtcaattgccccccaaatatattctcaatggtttaggcttgtacagtattagttcttacagctattgccccgtcaattgtgaaacgcagaagtttcactagtgcttgtactcgaggtgtaatacaagtgcttgaattttgagttgtacttggaatttccagtggtttgctcgtaaaaatgagatgatttcttggcaaaaaaaaaaaaaaaaaaa

SEQ ID NO: 5396 - DNA, 1049 bp, Oryza sativa
  Predicted polypeptide sequence is orthologous to G280
gtctagtcgtcttcttccctggatccaaatcgaaaatttctctccccctgttcacaccacgcctcactcccatggcgaccgaggaggacgcgtcgaccatggcggcggccgaggcggaccccaagcccgccgccaccccgtcttacccggagatgatactggcggcgatcgaggcgctggacgacaggaacgggtcgaacaagacggcgatctcgcagcacatcgaggggaagtacgaggggctcctcccccccgcgcacccgtcgctcctcacagcgcacctcgcccgcatgaagcagaccggcgagctcgccttctccaagaacaactacttccgcggcgacgacccgtccctcccgcccaagcgcggccgcggcaggccgcccaagcccaaggacgccgccgccgccgccgccgcaccggcgcccgcgcccgcggcgccggcggcctcctcgccgcgcccccgtggccgcccgcctaagcccaaggaccccctcgccgaggcggtcgcgaaggccaccagtggcatgccccgcgcgcgcggccgcccgcccaagaaggccaaggtcgaacaggaagaccccattggcgctcccgccgcagcttcggctcccgccgcggcggctgaggccgcgccgcctgtcaagcgcggccgtgggcgcccgcccaaggtgagacccgccgcgccggtcggggagccagccgctgcttgattagctccgattctccgcatcgccgcgatggcgacgatggtaagctcctttaggttgtaacgtagtcttcagattatgtctcgtactgattggaggcgcggctcgggttgctgcttattgtaagttaatcggatggtgggaggtttaggtgtgctggatggatcatccgttgctgagagttgtgattgaattcgtgttatcgcgtgctgattattatggtaatgttggtgactttcgtgtcgtttgtgttaattctagattggtggctgcatttagtgttatcaaatgatgttgaattgttctatgccatgccggacaaaaaaataagtctgattt

SEQ ID NO: 5397 - DNA, 763 bp, Oryza sativa
  Predicted polypeptide sequence is orthologous to G280
tgacgctgcaggtacggtcggaattccgggtcgaccacagcgtcgcacaaccccttctctctcagatcgcgtgcggcggcccaaatccacacgcgcacagcgcagcaccaacgccggaaggagacagcgcccctcgcccccgccaccccaaccctacgagagggagggagccagccagccagccagccaggcatggccacctccacttccactggccaccgcgccgccgacctcgtcctcccctcctaccccgagatgatcgtggaggcgatcgcgtcgctggcggaggagaacgggtctagccaggccgccatcgcgcgccgcatcgaggcggcccgcggcggcggcggcctcctcccgccgtcgcaccccgcgctcgtcgcggcgcacctctcccggatgtcagccgccggggagctcgtcgccgtcgcgggtgggaagtacgcgctccgcccgactcctccgccggcgccgccggcggatccggcggcggcggcggcggtggcggaggaagacgacgacgacgacgagttcttcggcgatgatgactcggccgacgacttacggccggctactcggccaagcgaagccggggcggccccgaaggtgcgcccccgagagtacagacgatccgccacgaaggaacgaacagacacagaagagaagaacgagaaacagcacaaacacggacagaagaaaaacggcgaggcaccacaaacagaaacaaggagaaacaacaaaaaaaagaacaagaaagccacga

SEQ ID NO: 5398 - DNA, 1537 bp, Oryza sativa
  Predicted polypeptide sequence is orthologous to G291
gaaacccctcctcttctcttccccttcctcctgcgttctagggttttgcctcccagcggcgactcggcgagcgagaccaccggcaagctcgtcggcgatggagcccacctcgtcggcggcgatggcgaggcagacgtgggagctggagaacaacatcccggcggcggcctccgacccggacgccctggacgcgatctaccgctacgacgaggcggcgcaggcgcgggtgcagcaggagaagccctgggcgaacgacccccaccccttccgccgcgccaagatctccgccctcgcgctcctcaagatggtcgtccacgcccgcgccggcggcactatcgaggtcatgggcctcatgcagggcaagtgcgagggcgacgccatcgtcgtcatggacgccttcgcgctccccgtcgagggcaccgagaccagggtcaacgcccaggccgacgcctacgagtatatggtcgagtactccactatcaacaagcaggctggaaggttggagaatgtggttggctggtatcactcacaccctggttatggatgctggttatcaggcattgatgtgtctactcagatgcttaatcagcaatttcaagagccattcttggctgttgtgatagaccctacaaggactgtttctgctggtaaagtggaaattggagcttttaggacatatccaaaagattacaagccaccagatgaacctgtgtcagagtatcagacgataccactcaacaagatagaagattttggtgtccactgcaaacagtactatgctctggatataacttatttcaaatcatccctggattctcatctccttgatctactttggaataagtactgggtcaatacgttatcttcatcacctctcctgggcaacagggattatgttgctggccagatatttgatttagctgataaactagagcaagctgagggtcaactggcacacagtcgatatggcatgcttatgccatcgcaacgaaagaaagagcaagaggagtctccactggctaaggtaactcgggatagctcaaaaattactgctgaacaggtccatggtctcatgtcacaggtcattaaggatatcctcttcaactctgtgcacccgtcaaacaaggcaagcacaagcgcaccagattcatccgggcctgagcctatggttgaagcatgagtgttctacagaattccttcattagttagccttttgttgatgctggattcacatacactgggtgcctagttgtttcatgactaaaagctgtgtccagcataactacccgattcaaaatgcgttagctgcgttttatcgtcaaatcataactgatatgtaattatgagttgccttctgaatctttcggctgccattgtgaaggtgcgtggtctacgttaagataaccaattaccttggcccaacttaccatgttctctcaacaatgaatggtcccaacgtcgctaggcacagtgtatgttgatttggatgatctttctggtatttatcctccgattttggtttctatatttccagttc

SEQ ID NO: 5399 - DNA, 2500 bp, Oryza sativa
  Predicted polypeptide sequence is orthologous to G307, G308, G309
actagttgcttgcctcttcccacctcacctcgcattgcaatctcgcatcgcctcttccttctctttttccccttcttctccccttctcatccaacctcgcttcccaaccctggatccaaatcccaacctatcccaaagccgaaaccgaggagaggaaaaaggttacgcgcaattattactagctatagctaggtaggtttgggggaggcgagatcatgaagcgcgagtaccaagaagccggcgggagcagcggcggcgggagcagcgccgatatggggtcgtgcaaggacaaggtgatggcgggggcggcgggggaggaggaggacgtcgacgagctgctggcggcgctcgggtacaaggtgcggtcgtccgacatggccgacgtcgcgcagaagctggagcagctggagatggccatggggatgggcggcgtgagcgcccccggcgccgcggatgacgggttcgtgtcgcacctggccacggacaccgtgcactacaacccctcggacctctcctcctgggtcgagagcatgctttccgagctcaacgcgccgctgccccctatcccgccagcgccgccggctgcccgccatgcttccacctcgtccactgtcaccggcggcggtggtagcggcttctttgaactcccagccgctgccgactcgtcgagtagcacctacgccctcaggccgatctccttaccggtggtggcgacggctgacccgtcggctgctgactcggcgagggacaccaagcggatgcgcactggcggcggcagcacgtcgtcgtcctcatcgtcgtcttcctctctgggcggtggggcctcgcggggctctgtggtggaggctgctccgccggcgacgcaaggggccgcggcggcgaatgcgcccgccgtgccggttgtggtggttgacacgcaggaggctgggatccggctggtgcacgcgttgctggcgtgcgcggaggccgtgcagcaggagaacttcgcggccgcggaggcgctggtcaagcagatccccacgctggccgcgtcccagggcggcgccatgcgcaaggtcgctgcctacttcggcgaggccctcgcccgccgcgtgtaccgcttccgccccgcggacagcaccctcctcgacgccgccttcgccgaccttctgcacgcccacttctacgagtcctgcccctacctcaagttcgcccacttcaccgcaaatcaagccatcctcgaggctttcgccggctgccaccgcgtccacgtcgtcgacttcggcatcaagcaggggatgcaatggccagctctcctccaggccctcgcccttcgtcccggcggccccccatcgttccgcctcaccggcgtcggccccccgcagccggacgagaccgacgccttgcagcaggtgggttggaagcttgcccagttcgcgcacaccattcgcgtcgacttccagtaccggggactcgtcgccgccactctcgcggacttggagccgttcatgctgcagccggagggcgaggcggacgcgaacgaggagcctgaggtgatcgccgtcaactcggtgttcgagctgcaccggctgctcgcgcagcccggcgcgctggagaaggtcctgggcacggtgcacgcggtgcggccaaggatcgtcaccgtggtagagcaggaggccaaccacaactccggctcattcctcgaccggttcaccgagtcgctgcactactactccaccatgttcgattccctcgagggcggcagctccggccaggccgagctctctccgccggctgccgggggcggcggtggcacggaccaggtcatgtccgaggtgtacctcggccggcagatctgcaacgtcgtggcgtgcgagggcgcggagcgcacggagcgccacgagacgctggggcagtggcgcaaccgcctcggccgcgccggcttcgagcccgtgcacctgggctccaatgcctacaaacaggcgagcacgctcctcgcgcttttcgccggcggcgacggctaccgggtggaggagaaggagggctgcctcacgctgggctggcacacgcgcccgctcatcgccacctcggcatggcgcgtcgccgcggcgtgatcgcaaagtttttgggacgctgcaccacgtgtttgccgccgatcacggcgcgacccccccccccccccctctctctctccccggctcaccggcggcacaattgaagcttgacgtcaacgaacgctcaattgcagcgaccgatcgggcttacggttctcgccggcgtgaagagatcgacgactggactccgaccagaccgacggcttgttcgttctcctttcccaattaccccgttccttggtcctcctagcccatctattatgtttaaatgtcaattattatgtgtaatttctccaatcgctcatattaaataaggacgaaccgaactggatttcattagctccaatgagaattttgtatacaaggcaccgatctaaaaattgagctatatgttcatgagttaaaaa

SEQ ID NO: 5400 - DNA, 1727 bp, Oryza sativa
  Predicted polypeptide sequence is orthologous to G307, G308, G309
cattccaccaaaccaagccaagcaagcctcacaccctcgcccgcgtcgtcttcctcctagccgccgtcgcgcatggctcagttcggcggcttcggtggctggtccgccatggacgttgccgctgccgccgccgctgctctgggcaacgtcagcggcgcggtgtaccacgccgatcctgctgctgccgtgtacgcgtctctagtccctggcatggctgtggtccccgggcgtgctccgccgtccgccgtgcagatcgaggcggcgaggcggtggaaggagctggagaagatggccctgcggtcggtgaatctcatggtgacgtgcgccggcgccatccaggcgggcgactacgcggcggcggccgggagcctgtccgacgcgcgcgagatcttcgccaagatgcccaccacccgcaccgggatcggccgcgtcctcacccacttcgccgacgcgctcgccgagcgcctgttcccggcgttcccgcagtccgcgccgccgccgcccccgccacgcggggagcagcgcgagctcttccgcgggttctacgaggcggggccgtacctcaagttcgcccacctcgcggcgaaccaggccatcctcgaggcgttcgaggggtgcaacagcgtgcacgtgatcgacttcgccctcaccgatggcatccagtggccgtcgctcatccaggccttggccgtccgccccggcggcccgccgttcctccgcatcaccgggatcggcccccacgccgccggcaaccgcgacgagctccgcgacgtgggcctccgcctcgccgagttcgcgagatcttgcagcgtccccttcgccttccgcgggatcgccgcggaccagctcgacgggctccgcccgtggatgttccaggtcgcgcccggcgaggccgtcgccatcaactccgtgctccagctccaccgcctcctggtcgaccaggacgccgccgccgcggcgtcgttcccggcgcccatcgacggcgtgctcgactgggtcgcgtccatgaaccccagggtcttcacggtggtcgagcaggaggcggatcacaacaagtcgtcgctgctcgagaggttcactaactccctcttctactacgcctccatgttcgactcgctcgaggctatcagccgccatggcggcggcgacggggcgggcaacccgctcgccgaggcgtacctgcagggggagatcgccgacatcgtgagccgcgaggggagcagccgggtggagcgccacgagcagatgccgcggtgggtggagaggctgcggcgcggggggatgacgcagctgccgctcggcgccaccggcctctggcaggcggcgatgcagctccgcgagttctccggcgccggcttcggcgtccaggagaacggcggcttcctcacgctcacctggcatagccagaggctgtactcggcgtcggcgtggcgcgcgaccgcggggaagaagatgacgatgatggctagcggcgccgccgacgccatggaggagagtcagaacagcaacaccaacggcggcggcggcggaagcagtggtggtggccatggtgctctcaaccaaatcatgcagtgaagaagagggatgtttgggtttcgaagtttatgtgggggaaacaatgtgatcgattttgatgaaccagattaaaaagttgtaataatattgcatttagtctgagagagcaacatgttggttttcgaattaataataaaatgtcgtttctagct

SEQ ID NO: 5401 - DNA, 1482 bp, Oryza sativa
  Predicted polypeptide sequence is orthologous to G307, G308, G309
atggataccttcccgttccagtggcccatggatccagccgcgtcatccggcctcgacgctgggtttctgccgcctccagcggctgtggcgcccgacgacggcgtggggtactacgacccgcctgcgggggcggatgtggacgccgctgctctgccggagttcgccgcggccttcccgccgtgcgcgcctgatgctgccgctgctgtgttggccatgcggcgggaggaggaggaggtcgcgggcatccgcttggttcatcttctgatgagctgcgcgggcgccatcgaggctggtgaccacgcgctcgcgtccgcgcagctcgccgactcgcacgccgcgcttgcggccgtctcggccgcctccggcatcggccgcgttgccgtccacttcaccaccgcgctctcccggagattgttcccttcgcccgtcgctccgcctaccaccgacgccgagcacgccttcctctaccatcacttctacgaggcgtgtccctacctcaagttcgcgcacttcacggcgaaccaggccatcctcgaggccttccatgggtgcgaccacgtccatgtcatcgacttcagcctcatgcagggcctgcagtggccggccttgatccaagccctcgccctccgaccaggcggcccgccgttcctccggatcaccggcattggcccgccctcacctaccggccgcgacgagctgcgcgatgtcggcctccgactcgccgacctcgcgcgctccgtccgcgtccgcttctccttccgcggggtcgctgcgaacagcctcgacgaggtccgcccgtggatgctccagatcgcgcccggggaggccgtcgcgttcaactccgtgctgcagctccaccgcctcctcggcgacccggccgatcaggcgcccatcgacgccgttctcgactgtgtcgcctccgtccggcccaagatcttcacggtcatcgagcaagaggccgaccacaacaagacgggcttcctcgacaggttcacggaggcgctgttctactactccgcggtgttcgactcgctggacgcggcgagcgccagcggcggcgcgggcaacgcgatggcggaggcgtacctccagagggagatctgcgacatcgtgtgcggggagggcgccgcccggagggaacggcacgagccgctgtctcggtggcgggacaggctcacgcgcgccggcctgagcgccgtgccgctcggttcgaacgcgctgcggcaggcgaggatgctggtcgggctgttctccggcgaggggcacagcgtcgaggaggccgacgggtgcctcaccctcggctggcacgggcggccgctgttctcggcgtccgcctgggaagccgccggggacggcggcggcgacaataacaacaacagtaacagcaacgttagcggtagcagcggcagtgacagtaacaacagcggcagcagcaatggtaaaagcagtggggctcgggatggtagcagcgtgtgtttgtaa

SEQ ID NO: 5402 - DNA, 894 bp, Oryza sativa
  Predicted polypeptide sequence is orthologous to G307, G308, G309
atggagatggacaaattcagctcgtcgtatcagccgtcgtggccaccagcgcaggccaccgtcgacgtcgtcgggtcggtggagaccttctggtcgcctgcgctgaggcggtggcgccgtgctaagaccgcgtgcaggcggcaacgctgcaggccggcgcgccgggcgttccagcgcgtcgcgtcgttcttcgtgcaggagctcctggaccggcgagcatccgccggcgctgggccctgcgagcacggcgttctgcatcccgcagtcgtcgtgcgcgaggcgtacgcggaggggttagggatgtacctcgagttcagaggaatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgcgccattcttcctcggccggttcatggaggcgctgcactactacgccgcgctgttcgacgcgctcgacgcggcgctcccgcgctacgacgcgcggcgggcgcgcgtcgagcagttccacttcggcgcggagatccgcaacgtggtcgggtgcgagggcgcggcgcgcgtggagcggcacgagcgcgcggaccagtggcgccgccgcatgagccgcgcggggttccagtcggtgccgatcaagatggcggccaaggcgcgggagtggctggacgagaacgccggtggcgacgggtacacggtggcggacgagaaggtctgcctggttcttggctggaaggggaagccggtcatcgccgcctcgtgctggaaatgctag

SEQ ID NO: 5403 - DNA, 1599 bp, Oryza sativa
  Predicted polypeptide sequence is orthologous to G307, G308, G309
atgggcatgtcccctgagccatgcaactccatctcagactgttcccagcagcagagccatcatctgactctgacacagcaacaagattcaacgattatttgtactaatcaagaacttgattattactaccgattctacgacgtggacgaagcggcgtttgatggcaacgaggtagagctcgtctccaggttctccaaggtcaccaggatggaccacatgatcagctcgccgtatcagccgacgtggtcgccggcacaggccgccgtcgacgtcgtcgggtcgtcggagacgtcgcgcgtcaggaagaagaggttctgggacgttcttgagagttgcaagcagaaggtcgaggccatggaggctatggacacaccggcgacggcgacgttccgggtcggtgccggtgatggcggcggcggcggcgggggtggcgcaggaggaggaggaggaggagctgacgggatgcgtctcgtgcagctgctggtcgcctgcgccgaggcggtggcgtgccgcgaccgcgcgcaggcggcggcgctgctgcgcgagctgcaggccggcgcgcccgtgcacggcacggcgttccagcgcgtcgcgtcgtgcttcgtgcaggggctcgcggaccggctgccgctggcgcacccgccggcgctggggccagcgagcatggcgttctgcatcccgccgtcgtcgtgcgcggggcgcgacggcgcgcgcggcgaggcgctcgcgctggcctacgagctgtgcccgtacctgcggttcgcgcacttcgtggcgaacgcgtgcatgctggaagccttcgagggagagagcaacgtccacgtggtcgatctcggcatgacgctgggcctcgaccgtggccaccagtggcgcggcctcctcgacggcctcgccgcccgcgccagcggcaagccggcgcgcgtgcgggtcaccggcgtcggcgcgcgcatggacaccatgagagcgatcgggcgggagctcgaggcgtacgcggaggggttagggatgtacctcgagttcagaggcatcaaccgtggcctcgagagcctccacatcgacgacctcggcgtcgacgccgacgaggccgtcgccatcaacagtgtcctggagctccactccgtggtgaaggagagccgcggggcgctcaactcggtgctccagaccatccgcaagctgtcgcccagggcgttcgtgctcgtcgagcaggacgccggccacaacgggccattcttcctcggccggttcatggaggcgctgcactactacgccgcgctgttcgacgcgctcgacgcggcgctcccgcgctacgacgcgcggcgggcgcgcgtcgagcagttccacttcggcgcggagatccgcaacgtggtcgggtgcgagggcgcggcgcgcgtggagcggcacgagcgcgccgaccagtggcgccgccgcatgagccgcgcggggttccagtcggtgccgatcaagatggcggccaaggcgcgggagtggctggacgagaacgccggcggcggcgggtacacggtggcggaggagaaaggctgcctcgtgctcggctggaaggggaagccggtcatcgccgcctcgtgctggaaatgctag

SEQ ID NO: 5404 - DNA, 522 bp, Oryza sativa
  Predicted polypeptide sequence is orthologous to G308
atgttcgtctgcggcatgtgcatgtgcgtgctgcgcccgtatcggccggtacaagttaactctggcaaaaacgggttaggtttagcgtacgtgcctggtatctttttcttggcggtaatgatcatgacgtcgaggtccaacgtatttggcgccaacgacactagtgccgacatcctcgtccctctcagcggcggtggcaatgatactaacactgaggatctatttgctactgtatacaccttttgtactgaactactgaagggctctgaagtagcctggctgctctgtttcaaggctttccaggaaacaacaacccatggcgctgaagaaacactgctgcttgccgacctggaatgggagagcaggaatggtcttcgtcttattcatgttactctcggttgccggggggagcgcgcaacgaagtccgaagtcggcgatgcgtttggacatgtaggaatattcggctgtcgtacgcgactacccgttaatgcttactgtttcgataggaatcgagttgtttga

SEQ ID NO: 5405 - DNA, 2171 bp, Oryza sativa
  Predicted polypeptide sequence is orthologous to G312
ggttcatcactccctccccattttaccgttgaggtcggcgacctccgcggacggtacggcgggacactagcccgtcccgaggggcaatcccgtaattttcgcgcagtacagtgcctcccagcgcagtggcttcgccccacgccctactgttttaaatccccctgccgctctcctccgccgtcttcttcccccccttcctctccaccacccccgattcgtcgtccaccaccgttcgacgagtttctcgcagatcgggcgggggcgcgccgggatggcgtacatgtgcgcggacagcggcaacctcatggccatcgcgcagcaggtgatccagcagcagcagcagcagcaacagcagcagcagaggcaccaccaccaccaccatctgccgccgccgccgccgccgcagtcgatggcgccgcaccaccaccagcagaagcaccaccaccaccaccagcagatgccggcgatgccgcaggcgccgccctcgtcgcacggccagatcccgggccagctcgcgtacggtggcggcgcggcgtggcccgccggggagcacttcttcgcggacgcgttcggggcgtccgccggcgacgcggtgttctccgacctcgcggcggccgcggacttcgactctgatgggtggatggagagccttattggggacgcccccttccaggactccgacctggaacgcctcatcttcaccaccccgccgccgcccgtgccgtccccaccccccacgcatgccgccgccaccgccaccgccaccgccgccaccgccgctcctcgacctgaggctgcaccggctttgctcccccagcctgctgctgcgaccccggtggcgtgttcgtctccgagtccgagttccgcggacgcctcctgctccgctcccatcctccagtccctcctgtcctgctcccgcgcggcggcgaccgaccctggcctcgccgccgcggagctcgccagcgtccgcgccgccgcgactgacgccggggacccatctgagcgcttggccttctacttcgctgacgcgcttagtcgccgccttgcgtgcggcaccggagctccgccctccgcggagccggacgcgcggttcgcctccgacgagctcacgctctgctacaagacgctcaacgacgcctgcccctactccaagttcgcgcacctcaccgccaaccaggccatcctggaggccacaggcgcggcgaccaagatccacatagttgacttcgggatcgtgcagggcatccagtgggcggcgctgcttcaggcgctcgccacccggcccgaggggaagccaacgcggatacggatcaccggcgtcccctcgccgctcctggggccgcagcccgcggcgtccctcgccgccaccaatacccgtctccgtgacttcgccaagctcctcggggtggacttcgagttcgtcccattgctccggcctgtgcacgagctcaacaagtcggatttcttggttgaacctgacgaggccgtggccgtcaatttcatgctgcagctgtaccaccttcttggcgactcggacgagctagtgagaagagtgcttcgtcttgccaaatcgctcagtccagcagtggtcacacttggagagtacgaggtcagcctgaaccgagctgggttcgtcgaccggttcgccaatgcgttgagctattaccggtcattgttcgagtcgctggatgtggcaatgacccgggactcaccggagagggtgagggtggagcgttggatgttcggggagcgaattcagagggccgtcgggccggaggaaggcgcagaccggacggagaggatggccggcagcagcgagtggcagaccctgatggagtggtgcggcttcgagcccgtgccgctcagcaactatgccaggagccaggctgatcttttgctctggaactatgattccaagtacaagtattcacttgttgagttgccaccggcgttcttgtccttggcatgggagaaacggccattgcttactgtgtctgcttggaggtgagggtagtttttttgggagtatttgggggaatgtgtggcgttgtgatagaacctgggaggaaatagttaggagaaatcattttgcagcttttgttgtagtttcctccaaaactgtgtttaggatgattggtataattgggaaattttagctgaattatcttgct

SEQ ID NO: 5406 - DNA, 1545 bp, Oryza sativa
  Predicted polypeptide sequence is orthologous to G314, G2699
gaatttgattggctcttgatcagcctccggatcgtgtagcgcagtggtggctagcacgtaggtagcaacaaagccatggacatggagcatgagctcaggggcggcggcgtcggggcggcggcgcatgggcatggctccatctgcttctccggcgggccggtgctcgtcgacgggcgacgcatccagcagctgctcctccactgcgccgccgcgctcgagtccaacgacgtgacgctggcgcagcaggccatgtgggtgctcaacaacatcgcctcctcgcagggggaccccagccagcggctcacgtcgtggctgctccgcgcgctcgtcgcccgcgcgtgccgtctctgcgcggcggcgccggcgggcgccgccgtggagtttctggagagaggccgggcaccgccgtgggggagggccatgtcggtgacggagctcgccgactacgtcgacctcaccccgtggcaccggttcggcttcacggcgtccaacgccgccatcctccgcgccgtggccggcgcatccgccgtgcacgtcgtcgacctcagcgtcacgcactgcatgcagtggccgacgctcatcgacgtgctgtccaagcggcccggtggcgcgccggcgatccggatcaccgtgccgtccgtgcgccccgccgtcccgccgcttctcgccgtgtcgagctcggagctcggagcccggctcgccatcttcgccaagtccaaaggcgtgcagctggagttcaacgtcgtcgagagcgcgacgacgacgtctccgaagaagacgtcgacgacgctgtgccaagaactcgcgtccgtgctgtccgacccgccgtcgctggggctaagggacggcgaggcggtcgtcgtgaactgccagagctggctccggcacgtcgcgccggacacgagggacctcttcctcgacacggtccgggcgctgaacccctgcctgctcaccgtcaccgacgaggacgccgacctgggctccccgagcctcgcgtcgcgcatggcgggctgcttcgacttccactggatcctgctcgacgcgctcgacatgtcggcgcccaaggacagcccgcggcggctggagcaggaggcggccgtcgggcggaagatcgagagcgtcatcggcgaggaagacggcgccgagcgctcggagcccggcgcgaggctcgccgagaggatgagccggaaagggttcgccggcgtcgtgttcgacgaggaggcggcggcggaggtgcgacgattgctgagcgagcacgccacggggtggggcgtgaagcgggaagacgacatgctggtgctgacgtggaaggggcacgccgccgtgttcaccggcgcttggacgcccaactagttgagcctagcttagcaatctacagtatacatcaagtgattaaagcttaagctggtgttagactgtctattagctcagaagtgacaacggagaatcaactgaggaggaatttctggttggatttagtggatcgttttaaacttctacttccatgacaagatatttcagttgaattcttgatgttttactccc

SEQ ID NO: 5407 - DNA, 1419 bp, Oryza sativa
  Predicted polypeptide sequence is orthologous to G314, G2699
atgcagttcacgcacaccgcgccacctccaccgcctctgcaccctaatgggcatggactagggttagggttgtaccttgacgtcggcgcgacgaggggaggaggaggagcgcggccgtggtcgtcgtcgtcgtcgacgacgacgttgggtgggagcggctacttcccgtcgtcggcggcggcgtcgaagatctcgttggggaacctcaacagcacgggctgcatggagcagctgctggtgcactgcgccaacgccatcgaggccaacgacgccacgctgacgcagcagatcctgtgggtgctcaacaacatcgcgccggcggacggggactccaaccagcggctcacagcggcgttcctgtgcgcgctcgtgtcgcgggcgtccaggaccggggcgtgcaaggcggtgaccgcggcggtagcggacgccgtcgagtcggcggcgctccacgtgcaccggttcacggccgtcgagctcgccagcttcatcgacctcacgccgtggcaccggttcgggtacacggcggccaacgccgccatcgtcgaggccgtcgaggggttccccgtcgtgcacatcgtcgacctcagcacgacgcactgcatgcagatcccgacgctcatcgacatgctcgccggccgcgccgaggggcccccgatcctccgcctcaccgtcgccgacgtcgcgcccagcgcgccgccgccggcgctcgacatgccctacgaggagctgggcgcgaagctggtcaacttcgcgcggtcccgcaacatgtccatggacttccgggtggtgcccacctcgccggccgacgcgctcacgtccctcgtcgaccagctccgggtgcagcagctcgtctccgacggcggcgaggcgctggtcgtgaactgccacatgctcctccacaccgtcccggacgagacggccggctcggtcagcctgacgacggcgcagccgccggtgtccctccgtaccatgctcctcaaatctctccgggcgctcgacccgacgctggtggtggtggtggacgaggacgccgacttcaccgcgggcgacgtggtggggcggctgcgtgcggcgttcaacttcctgtggatcccgtacgacgccgtggacacgttcctccccaaggggagcgagcagcggcggtggtatgaggcggaggtggggtggaaggtggagaacgtgctggcgcaggaaggggtggagagggtggagcggcaggaggacaggacgaggtggggccagcggatgcgcgccgccgggttccgcgcggcggcgttcggcgaggaggccgccggcgaggtgaaggcgatgctgaacgaccacgcggccgggtgggggatgaagcgggaggacgacgacctcgtgctcacgtggaaggggcacaacgtcgtgttcgcctcggcatgggcgccgtcctga

SEQ ID NO: 5408 - DNA, 395 bp, Oryza sativa
  Predicted polypeptide sequence is orthologous to G314
ggttgcttcttccatctgctcttttgttgcgccctgattctgcaggcaccatgcgaatcgcggcaatgacaccaagagatagagagattcgcgggaatggcagccaccaccaccatccaccaccaacaaatcatcgcgccaacaacaaaaaaaacccaaaaaaaaaacaacaaaagaaattcaggcgtggcagttcgttaattcggataacaccaaccaacgagtccacgtcgtctcgtctcccaatcaatcaattgctgatcgtctgacttatataagagggagaggagaggaggagtgtggagtgtggagtctctgataataagtgtcgatttttgttgttccgggagaaattccgggagatttggggcggcggcggcgatgaggattcgggg

SEQ ID NO: 5409 - DNA, 2671 bp, Oryza sativa
  Predicted polypeptide sequence is orthologous to G324
tggccgccgccaccgccgcccgccacctcgccgccgaccagacgagccgccgtttgacccaacaccgagctcccgcgcggagttgatgtccatctccccttccgaatccaccagaggatcccagccgctcgcgccgcgccattccaaccctagccccggaccccgccatggcaacagctccgccccaccgcgccgccgcggccgacgctcccctacggctcccgtctcaccgccctcagccgccggcgggagcggcggcccgagctccgtctcggtggttccagctatcagagaatatgttgatacttcccaaaaggtagttggattcagaatctctagagaagagaatgatgattcatatacccaagaagttggcaatttttctgaatgccactcttctgaacatgggaattcaggtttttcagccaataatggcacctcaggccaggcaactcctcagagacctgaattgatggaatccctgaagattgatctatccactacaaattctagtgggaatggtactcaggtgactgctagaaagaatcagtctgtaaatgccaattatctgctgaatttccactatgatccaatttctcggccacagcctagaggccccagaacatatcctacaagaagacagaggaagatcagaccatacaacaaagatttgttcctacaagcaaattttaagtttgttgtgttggatactggaagctatgaaatagaattaatggatccagataagatgctccagtgggaagatattgtatgtgtaagatattatagcccttgtgaggtgcaatgccctatttgcttggagagcccattgtgcccacagattacatcatgtggtcatatatattgctttccatgcattttacgttatttacttatgggaaaagaagattacaaaggtgaaagctggaagaagtgcccactgtgtttcatgatgatctcaacaaaggagttgtatacaatctatattactcaagtccagcattttcatgttggtgacaatgtgacatttacacttttgagccgctcaaaaaattcactcactccttctattaagaacctcactgatgaatctactatagacgaagatccttgcagtgcattctccaagttcattttgacgtctgatgtggaactttctgttagagaggcaaaaacagatcttgttaattggttgcatatggcagatttaggccttgtgggtgacttggagaaacttccatacgtttctaccgctttggagcagctagaagaacggatgaaatattggagtgagtacagaaattttagtgtcagccctcccctaaaagacagcttctcacctgtaactagttccaaatcaaggaaccctaataatgcacaatcttcacgccagaacagtgaacacaagctatctcctctatcagatgaagatatgattgctggtgtttcggagctctgtatttcacctgaatcaaataaaatctttaataaaggaatgccatcgaaaacagaagagagatgtatggctcccatagattcaaatgagaatgatacttataatttttaccaggtatctgatggccaacacctaattcttcatccgctaaacatgaaatgccttataaaccattatggaagttctgatatgctcccaccaagaatacatggaaaaatcttggagctagaaactgtaacacaatccgaagctacaagaaagcgctatcgttatctaagtcacttctcattgacaacaacgttccagttctgtgaaattgacctgggtgatatgctgcctcctagctcattagctccattcatggatgaaatcaagaagcgagagaaacagaggaaacgaactgccaagaaggaagaaagcgatagagtgaaagccgaagttgctgctgctgcacaggcatctgcaatgctgtttgaacatacaagcttctctcccagtagtgggccacatggcgattttatgttctctctggatgactttgaagctcttggaaacaatgctggaccctccacgagtccaccagccagcgaaagaaagcttttctccgatgttgcacggcttggctttgcgtctgcccaagactcgcctcctctaagagttgaatctggggatttgactggcaaaagtgaaagcacgggggaacaagggccagccgcaacacccgcattatcctttgccagcatcatttcctccactagagcgtcagacaatagcctggacacgcacaaaccaaatgtagtcgggaagaaaggcaagaaacccaccaaagtgctcttgtccactggcggtggccgccgatactgaaggaagagtgacactggaatggaagcagttgccagttggctgtttcctataagcagtgtgtatagtgcataacctggacttcacatctgtaacactcccaagtcccaagtagcagctttttctcccatgtggtttgatctaaatcgcctgactgttttagaaggttttttactgtgtatctacatcctgacccatgctaagggagtaagggtgactgccctgtcgcaaaatgagaagagctatgtaaaatttgataaataatgatgctaaggatcatgcgcaatactttgctcaatgtacgtcgacgagttgatccgtcataggctgatacagcctgctgtttaaatcgtg

SEQ ID NO: 5410 - DNA, 437 bp, Oryza sativa
  Predicted polypeptide sequence is orthologous to G326
gcacttatttttgggacggatgaaataatgtgttttttagagaaaagaatcgagcgtcagtatgcttcgctgacaaggggatggcccacgtgtcagtgaatcgaggagtatggtaccacgtgatagatatactgatatacatatatagaggcgtatgagaagagagaagtaaaaaaatacaataaatactggaaacattattgtaaatatacactttgttttattctttttatatttcttgtttggtcatggatttgtttcatttttgtaaaatgtagaacggtgctatgtgatgtgtagtttcccatagtttgtaatgttgaactactggatggttgaagctgttgtattttgtcccactttcacatgaagcctggttaaataataaataaagaaaagggtaacaaacatttttcatgccaaaaaaaaaaaaaaaa

SEQ ID NO: 5411 - DNA, 1892 bp, Oryza sativa
  Predicted polypeptide sequence is orthologous to G326, G1337
gcctcctcattcctgcattgcattgcttccgagctcaaaagtcgtcgtagacccccgcctccttcctcctcctcctcgcgcttcgatttggtttggtttgattcggtttgcgagatgaaggatggtggtggaggaggagggagggggcagcagcagcagtggccttgcgactactgcggggaggcggcggcggcgctgcactgcagggcggacgccgcgaggctgtgcgtcgcctgcgaccgccacgtgcacgccgccaacgcgctctcgcggaagcacgtccgcgccccgctctgcgccgcctgcgccgccaggccggccgccgcgcgcgtcgcctccgcctcggcgccggcgttcctgtgcgcggactgcgacaccgggtgcggcggcgacgacggcgcggccttgcgggtgcccgtcgaggggttctccgggtgccccgccgccgccgagctcgccgcgtcgtgggggctcgacctccccggcggctgcggcggcgaggaggaggaggccgacgacgcgttcttctcggcgctcgactactccatgctcgccgtcgaccccgtgctgcgcgacctctacgtgccatgcgacccgcccgaggtggtggtggccggcggcgggcggcgactcaagggggaggcgctcggccaccagctcgccgagatggcgcgccgggaggccgagacggcgcacccgcacacgcagccgcactcggatctgagcccccgcacgcctcgccggacctccgccgcggcgagcggccgcctgcaggaaaagcaagctcccccgccgttgcctcatgctgctgcgacggcggcgccgctgccgtacacttcactgctcatgatggcgccggccaactgcaccgagctcatggaaaacaaccgtgttggagacgaagatgaaaatgttctgtgggagagcaccgcgccatcagtgccaccaacccagatatgggattttaatttgggaaaatcaagggatcacaatgagaactctgcacttgaagttggatttggctcaaacaatggaggctttatgattaagagttataatgacatgctcaaggagatttcttctgggacaacgaaggatctggaagatatttatgactcaagatattttgcagctgccgaagatatcatgtcgactaatgtctgtcagctgtcatcgaaaaatccaagcaccaggagcaacaaacggaaggcgagctcatgcgcttcgacgatcgatggaccgacaacttccacaagccatgtacctgctgcttcaggggcattggggggctcttcgaacgacagaggatcggctctccccaaggagatttccttctgtgatcagaccgtcgtccctaccggagccgatcagaggccatgtaccatcaagatcgacagcgagacgctcgcgcagaacagggacagcgcgatgcagcggtacagggagaagaagaagaaccgcaggtatgagaagcacatcaggtacgagtcgaggaagctgagagcggacacgaggaagagggtgaaaggccggtttatgaagtcgaacggagcacctgatgatgtcagcaatggcgggtgatctcatccctgcaatccctgatagctagctgcaatgtacgtagcctggctttttgacgttgcagagatcgatgtggccatatatatgctgagagctaagtctgaaatatgttgcgtatgttgttacaacctatgcacgctctgcttaagtctgtctgctgctgcatgtattgttcagctaaaatttttgcgtccaagagtcgatcttgataattaagtacccctactacaaatctacactacatactgtaatagaccttagattttttttctcatctcctcgtagaaatatatggcattttatatatacgt

SEQ ID NO: 5412 - DNA, 1817 bp, Oryza sativa
  Predicted polypeptide sequence is orthologous to G326, G1337
tgatgcccacacgcacccacccaccgcgccggcggcgaggccatcacctcctcctcctgcacgtgcgccgtgggcgtggtcgccggagccggaggggtggatgacgtggcggagctgcgactactgcggggaggcggcggcggcgctgcactgcagggcggacgcggcgaggctgtgcgtggcgtgcgaccgccacgtgcacggcgcgaacgcgctgtcgcggcgccacgtgcgggcgccgctctgcgcccggtgcgaggcgcgccccgcggcggcgcgtgtcgccgccgtcgctggagctggaggatgcggcggcggcggggaggccaggttcctttgcgccgggtgcgccgacgacgacggtgcggaggcggcgagggtgcccgtggtggggttctccggatgccccggggccgccgagctcgccgcgtcgtgggggctcgacctcggcggcggcggcggaagagatgaattcgaggaggatccgttcttccccgaggccggttacccaatgctggcggcggatcgcgtgctgcgggacatgtacgtgccctgcgacccgccgccggaggtcgccgccggcggacgcggacggcggctcaaaggggactcgctctgccaccagctcgccgagctggcgcggcgtgagatggaatccgcgccggcgcaggcgaactcgggatcgatctccccatcagctcgccggggctctgccgctgcaatccgccatgaggctgcggcagcggcggcggcgcaaagggccacattgccgtacaagtccacgccggtgacggaggcggcgggctgcggcgatgtcggcaacggcgagcagttcaccgacgacaacgaactcgtgtggcagcgcaccgcgccctccgatccgccatgccagatatgggattttaatctaggaaaatcaagggaccatgatgagcactctgcacttgaacttcatttcggcccaaaagatggaggctttatgatcaaaagttataatgacatgattgaggaagtttcctctagctcaaggtaagatcttcaatatatttatgactcgacatactcttttgccacggaagatattgtgtcggccaatatctaccagttgactccaaaacagctgagcactgccacatccggcaacaggcgacacaaggacgagcaacacggattgacaaatgacgggccatcatcttcgaggatcgacagcaaaacgatcgccatgaacagggacaacgcgatgcaacggtatagagaaaagagaaagactcgcaggtatgacaagcacatcaggtacgagtcgaggaagatgagagccgacacgaggacgcgggtgaaagggcgcttcgtcagggccactgacatcttcaacgtcggtggcggcgacggcggctgaaaatgtgcttgcgatgtctgaaatccagcgacatcctcaacaacgtcagttcagtggggattattgctgggggaatggagatgctgcatcaccaacactttttgtgaatagcctgaactgaaacttgtttcctggagtagtagaatacatacgatatcacatccatgatcttgtattgttgtatttttttttttgagggattgtttttttttaatgacaagttttttttgaatgactttttgagggattgttgtatggttattattccactcagaagtttttgcagcccctgaaaatgtggcaagttatgtaggacctgtttgtaattttgttgccactttcaaccccactaaactttagtagggtagcaaactaaacattatcttataaatacaattgtattaatatttggtagttacgg

SEQ ID NO: 5413 - DNA, 1361 bp, Oryza sativa
  Predicted polypeptide sequence is orthologous to G328, G2436, G2443
attgacgtcttcgcacaggcacccagccatgctgaagttggagccggagttccccggcctgccgcagcggtgcgactcgtgccggtcggcgccgtgcgcgttctattgcctcgccgattcggcggcgctctgtgccacgtgcgacgctgacgtgcactccgtcaacccgctggcacgccgccaccgccgcgtaccaatgggcgtggtggctgcccccggcgccgggggagccttcgtcgtccgccctgcaggcggtgtcaactcctcctggccaatccgagagggcaggaggtgcgactacgacgatgacgacgccgacgccgctggggaggaagacgaagaggcgacgtcgtggcttctgttcgacccgctcaaggactcctcggatcaggggctgccgccgttcggcgacgcgctggtggccgacttcctcaacctcggcgggggcgccggggagaaggaggacgcgtcgtcgagcaaggactgcagcagcagccacgggaagagcagcgagggcagccacgagttcgccgtgcccggcgagcccgtaccggagcgccagggcttcggggcggtgagtatggacattaccgactacgacgcctccaatttcaggcgcgggtacagctttggcgcatcgctcggccacagcgtttcgatgtcatcgctggagaacatgagcacggtcccagactgcggtgtgccagacatcaccacctcctacttgaggtcatccaagagcaccatcgacctcttcacggcagcagctggctcccctgtggcggcgcacagcataatgtcgccaccgcagttcatgggcgccattgacagggaggccagggtgcaccggtacagggagaagaggaagacgaggcggttcgagaagaccatcaggtacgcgtcgcggaaggcgtatgccgagacccggccgaggatcaagggacgcttcgccaagcgcagcgacaccgaccttgaggtcgaccagtacttctccaccaccgccgactccagctgcggcgtcgtgcccacgttctagcgagcagcttggccgcacgcctggaagacaatcaaagaagctcaggaatgaatatattctcccactgtatagtacatcttggttgcttagctatatatatatatatatatatatatatatatgtataattcgccgaatcgcctctaaatttgtgggaggtatgaggcttcagctgtaggtatatatagatgctagaaagatgctccttgtaaaattgtgcaggagtaaatgtaatcatgtagtcatccctccttctccaatcctttacaatacatttctgtttttttattcagcttaaaaactacgttttgttttttctcccgat

SEQ ID NO: 5414 - DNA, 1557 bp, Oryza sativa
  Predicted polypeptide sequence is orthologous to G328, G2436, G2443
caaaattccacaagagccatgcgaggtagaggaacaggagaagacgcatacacacacgacacatagagagagaggacaaacacaatagcttggatcgatagacttgtccatgtggtgcaagctaaagctactactaccacaagcaaggctacttcgttcatgaattataattttggtggcaacgtgttcgaccaggaggttggagttggaggcgaaggaggaggaggaggagaggggagcggctgcccatgggcgcggccgtgcgacgggtgccgcgcggcgccgagcgtggtgtactgccgcgcggacgcggcgtacctgtgcgcgtcgtgcgacgcgcgggtgcacgcggccaaccgcgtggcgtcccgccacgagcgcgtgcgggtgtgcgaggcctgcgagcgcgccccggccgcgctcgcgtgccgcgccgacgccgccgcgctgtgcgtggcgtgcgacgtgcaggtgcactccgcgaacccgctcccggccatcaccatcccggccacctccgtcctcgctgaggcggtggtggccaccgccaccgtcctcggcgacaaggacgaggaggtggactcttggcttctcctctccaaagattccgacaacaacaacaacaataacaacaacaacgacaacgacaataacgacaacaacaacagcaacagcagcaacaacggcatgtattttggtgaagtcgatgagtactttgatcttgtcgggtacaattcgtactacgacaaccgcatcgaaaacaaccaagatcggcagtatgggatgcatgaacagcaagagcagcagcagcagcagcaggagatgcaaaaggagtttgcagagaaggaagggagcgagtgtgtggtaccttcacagatcacaatgctgagtgagcagcagcatagtggttatggagttgtgggagcagaccaggccgcctccatgaccgccggcgtcagtgcttacacagattccatcagcaacagcatatctttctcatcaatggaggcgggtatagtaccagacagcacggtgatagatatgccaaattccagaatcctgacacctgctggagcaatcaatctcttctcaggtccctcgcttcagatgtcccttcacttcagctccatggacagggaggccagggtgctcaggtacagggagaagaagaaggccaggaagtttgagaagacaatacgttatgaaacaagaaaggcgtatgcagaggcacgaccccggatcaagggccgtttcgccaagagatcagatgtgcagatcgaagtggaccagatgttctccactgcagctctatctgacggtagctatggtactgttccatggttctgatgggactcatgagacgctatcttataggcatatatatggggacttactgagtagcaataacatcgatccagtgggagtagttctagacaatctgtgttatgaataatagtgtgttgtttgcgacttaaaattgatcaagtaccttagctttttaaagttttgctttgtaatttccggatagcagatatatattgttggtacttgctcagt

SEQ ID NO: 5415 - DNA, 776 bp, Oryza sativa
  Predicted polypeptide sequence is orthologous to G328, G2436
ctagaaagattatcagtttattcatgggtcttgactaaagcagtaacagaatttacaaagtgaaaaatagggtgttaattctacaccgagatatatggagaaaatatcaagaatctacaggatctcctacaaataaaataaactgtaaagaaagcactagctaaaactcaaaaacaaatggtaaaactgtttagagatttcatacatggtgaatgatgatcctggtgtaaaattgttgatgcttgcagggagaccttgctgtcacagggtggatatgaacaggagttccataattttatcccctgatgcatgatcacatagtcattctgcaaatggtccccactggaacaagtccaaaccactgctggtcccaattcacggcattaatgtgcacatgccaataacctgcatgtcgatgcaccgttaaaagattcagacgtgatctagtatcagtggacccaagatcaaaccagtgctctaaccatacgaaagcctccgtaatgtatgctgttgccagtgtgtcacagacaccatcatgagctcaattcaacatgacatgttttctgcatgtgacaacaattcaaacgatgcatacgggcatgaacctgcgctgagccaacttgtgaccggggtgctaagatcaagaacagctccagatggtccctagcaatcctcaaccatgtcgtttcagtcttgtcatcgatggcaacgatatccctcttttcacggtcataagagagcccatcagtggtaaggaaacaacgatctgctccgga

SEQ ID NO: 5416 - DNA, 447 bp, Oryza sativa
  Predicted polypeptide sequence is orthologous to G328, G2436, G2443
atggtggctgccgccgtcctgagcccatcccgacgcgcccatggccgtcgctattatcctgagtccatcccgacgtgcccgagaaacccagcacacgccgaggccgctactatcctggcgagccccaggatcgagaggatcatatgctatccctcggcgctcctgcgcctatcgctgtcgcctccaccgtctccacgccatccgcgagctctgcgccgtatttggtggtggtgtaggagctctaggactgcttggtgcgccgacgccgacactgacaccgacgccgaggttgaggttgaggttgagcgcgccgtgctgctatcgctgctaccgaacatcacggcctcggctgccacagcagctgaaccgatgggcgtgacagggacgcgcgtggcgccgggccagcgggttggcgtcgtggatgttggcatcgcaggcagcacatag

SEQ ID NO: 5417 - DNA, 1452 bp, Oryza sativa
  Predicted polypeptide sequence is orthologous to G343
gtcggaaacctaccccctcttcttcctccgcttctctctctctctctctctctctctctttctctctcctcaaccgtgcggctgcctcctcctcgtcgctgggcatggatgtgcacccgccgaatgcggccgcctcctcgctggaggagttgttcccgcaccagcccgccacggaaagtgatagaagtggcatagagtggctctctgtctatgtagaggactgcttgtcaacctctgcatcctgcacaaaccctgtctctgcagaactaccgcctattacaatggcaagtcaaggtgctgcaaaaccaaagttaccaccacgctcatctaccaatgcaagaaaaaagaaaaggagcctggcatctgtcataagcgacactgatgaccaacattgtatcacgctgtttgtcgagccaccgctactcctgctcgatcataaggactggctagcagagagtgagcttatcctccccaagaaggacaaagatgaagaacttgtccaagagcaagaacaagaggaggaagagaattacaaaatgagtgcaggaatgcaattccagcaggagcaactggtgatcacttgtagctattgtttgtccagccaatcaccacagtggtgggatggtccatcagggcctacctgcgatgcttgtcgtctgaggattgaggcgaggaatgggcacaccaccagttccaagaagcgctatggccaagagattgacaaagaacaggacataggaaagcggcgagataagaagaagatcaagaaggctgtttatgtgaatgatgagctgctatcggaggagccaatgaagaggtgcacccattgcttgtcctacaagacgccacagtggaggaccggtcccttggggcctaagacgctatgcaatgcttgcggtgtgaggttcaagtctggcaggctgctgccggaatacaggcctgctaatagtccaacttttgtgagtgacatacactccaattctcataagaaggtcatgcagctgaggaattctgttccacacccaaggaagtgaactggtggtcgggaacgtctcgatctgttgcgtttagttttaggaactcttcagttgtagaagtaagctgatagtgaagaacatcttaatctgtctcattgaattttaggcgggctccttggtcgtagaagtgagctgataatcacatctcaatctgctgcattgagcttttaggggctctcagccttagatgctgagaaaacgaaagcagaatctagttaggcgtcatgaactctttgttagctctagccgttttttaacttgagaaattaatctgctagttgttggagatcatcagtttaataccaatgggtggttgctacccttgttatcccaccattgtcttgcagcatgcttgttctgtgatactcgctgaatatgtttgcaagatggaaatcagaattcagagcagcctctt

SEQ ID NO: 5418 - DNA, 1612 bp, Oryza sativa
  Predicted polypeptide sequence is orthologous to G343
ttgacggaagaaggaaaaaaaaaaaaaagctcccctctttccctctcctgctgacgcgccccgtcgccgccgctcgcttgccgcgcgcggccaaagcaagcaagctcgccgccggccatccatggcggcggtggagggcggaataggagagccgcccggattagccagggaaaggcgcctacggctccggcgatctgtggcggcgaccggcgacatggacggcgacggcgacgttggcggcggcggcggcggtggtggtggtggtggtgttaggtacgtcctcgcgctcccggccatggcgtcgctggccgtcctcatcgcccacctcgacgccgccgtgcccgtgccccgtaggcctcgcagctacctcccccgcgccgtgcccatggcgtggtgggccttccggctccccgtcttccgccccccgcctccgcctccgccaccgccggccaagaatccggtcaaggaggaggagggggtggcgcgcgtggtggtggtggtggcgccgccgccgcccgtcgatcccggcgaggaggaggcgggcaagagggcggcgaagagggcgaggaggtgcctgaactgcgacgcggtggagacgccacagtggaggtcgggcccgatggggaggagcacgctctgcaacgcctgcggcgtccgcctcagggcggtcggctcgctgcctgaacaccgcgcgccggcggcgaggacgacgacggccgcccccgcgtcgccgcccgatagcccgatctggacgcccggccacaagccgccctcgtcgtcgcccgacatctacctcgtcaggaggacaccgaagctgccggtgacgcggcctccccgtaccaagcaagctccgcccacagcgcccgcgcccgcgcctccgccgccgccgccgcagccggcgtcgccgaagacgaagacgaaggcgaaggcgaagaagccgaagaggaagagaagctgcgtgcactgcggctcgacggagacgccgcagtggcgggaggggccgacggggcgcggcacgctgtgcaacgcgtgcggcgtgcggtacaggcaagggaggctgctgccggagtaccgccccaaggggagccccaccttctcgccgtccgtgcacgccgccaaccaccgccaggtgctcgagctccgccgccagcagcggcagagcaccaacccctccactccaccgccgccgccggtgtccgccgccgagccaatccccgacgagcaaaaagaagaggtggtaagcgtgccagtcgccgccgccgcgcccgccaccgacggcggcgcggcgagctcgctggacgcgctgctgctcgacgggccgtcggcgccgctcatcgtggacggcgacgatttcttggttagttaggtagccagaaaaaaaaaaagaggaataatttcagctgagaatgagatgaggaataccaatttttcgtttgatttttcaggaaaaacagttttaccacctgacattgtgaatactcgtcgatcctggggaaaatctttgcgtgaaatttagctagttttgctgcccagatgaactagttctggtgcttggtagctgatgaagttgaaaccggttttaatggatcaagggggatggatgttcaatgcc

SEQ ID NO: 5419 - DNA, 1358 bp, Oryza sativa
  Predicted polypeptide sequence is orthologous to G343
gagctcctcctctcatcagtcatcactacactcacttagctagtggcaaaaagatagatagctctagctcgtactgcatcaaacgggcggtagttgcactgcccgtttcaagggaactccagtgacaaccagcttcttgccaattcagaacgtgaccgtgtggtacgtacggccaaggcagtggctagctcgcgatggcgtcggagtgggaaatggccatgggcgtcgacctcggcatggggatgagcacgtaccacaacgcctccggtggcatcgccgccgcgccgatgatgggccaccacggcggaggaggcggcggcggcgggtactccgccgcgcaccaccaccaccaccattactacgggatgcctcatcaggcggcgatgggcgacgccatgcgcgtcgacgacctcctcgacctctccaacactcccggcgcccacgacttcttcccggcctccgctgccgccgccgccgcaggtgaccacgggcaccaccaccaccaccacatcggcggcatgggcgagccgtcgggcgccacgccgtcggccacgtcgtcagatcaccagacgtcgatgctctccttcgccgacgacttctacatacccaccgaggacgctgccgagctggagtggctatccaagttcgtcgacgactcctactccgacatgccgaattaccagtcgtccgcgcacgccgcaatggcggcggcggctgcttccgcggccaacaacggcggcggcagctcggccggccaagacagctgcctcacggcggcgcctggccgcggcgcccgtagcaagaggtcgcgcgcgacggccgcggccgccgccgcgtggcactccctcgtcccgcgcccgccgtcccagtcgtcgccgtcgtcgtcgtgctcgtcgtccgacttcccgtcctcgaacaagccatcgggcaccgcgaggccgaacggctcaggaggcggcagccgcggcaagaagagccccggccccgcgggggcggaggtgggcatggaggccggcgtgcggcggtgcacgcactgcgcgtcggagaagacgccgcagtggcggacggggcccctgggccccaagaccctgtgcaacgcgtgcggcgtgaggttcaagtccgggcggctgatgccggagtacaggccggcggcgagccccacgttcgtgctgacgcagcactccaactcccaccgcaaggtcatggagctgcgccgccagaaggagctcctcatcatccgcggcagccaccgcgacgccgccgcggccgcagcagcagccgccgccgccgccgccgcgggatccgccgcggcgaccgggaggccggagctcatgttccgcgactacggcgtgtgctga

SEQ ID NO: 5420 - DNA, 242 bp, Oryza sativa
  Predicted polypeptide sequence is orthologous to G344
gaatgtctgccttccttccacggtagagccacccactgcgctttcgccggcggcggaggaggagggaggtgcgtttatggttgattgtgtcagttgttccctcgccggctaagaatacgacttcttccggacggctcaggtcggtaattcaaaacttggacgtggtatataacagtgatcttacctcgtttggaccaccctctatatgcgctctatgctttacatgaaactgataatggaaa

SEQ ID NO: 5421 - DNA, 860 bp, Oryza sativa
  Predicted polypeptide sequence is orthologous to G346
ccttttaactcatcaaactcagatcgatagaagagatcgattcgtttctatcgaaagcgagcaaactagcgttagctactactcgaaggcaaaatggacgtgatggagaagtctcggcgagctcacttcttgttcgacgacgacgaccaaacgccgcccaagcagaacggcccccggaacgacgacgaccagcacaacaacgacgacggcagcggctgcctctgcgtgtcgtgctacggcggcggcgtcgcaaagccaaaggccaagtcgtcgtcgtcgacggcgaaggacgtcgtcgccggcggccgtcctgctgcaggctccaactgtacctgatctaattactctaaccatatatagcttgctagcgatcgagctcgatctcatctcgcacctagcttgatcatgtcgagcaaccatgtacgtgttgatcgacatgatcactctagctagctagctagctacttcatatggatgttgaataagggatcatattggaggaaaacatgcatgaatgcttatgcaactatgcaagcatgcccgtctccaattactggtacagactacagagtgatgtatgttaattacgagaaatgtactctctttacgaaatactatgaacatatattatgatcaattacatgacagttgtattattaattagcagcgttctgaattcattctgaaagggtgtgtccggcctttcgaatggacaaccagctgctgtaattaagctgttcattgttcgatctcttgccgaatagtataactttttttttggggggaatgggcactcatttattctttacaaatgaatatatctccgtaggagtataaaaaaaaaaaaaaaaaaaaaaaaa

SEQ ID NO: 5422 - DNA, 1587 bp, Oryza sativa
  Predicted polypeptide sequence is orthologous to G346
atggtggtggtcgacgggctccacgacggcggcggcggtgacctccaggccttgctggatgacgcgggggtggatgatgtcgcggcaaggggcggcggcgaggtagaggaggaggtggagcggccgtcgaacgaggacgcgttcccggcggtggagaagatggcgacggcagcggcggcgaaggggttgcagtgccggcactgcgggacgacggagacgccgcagtggcgccatggcccggagggccaccgcacgctgtgcaacgcgtgcagcatgcgctaccggagcggcaagctggtgccggagtaccggccgctgaggagcccgacgttctcgccggagcttcactccaacaggcaccaccgcgtcctccagctgcgccgccgaccggggccccagtcagccgccccgtcccccgcggcggtggcgaggtacggcggcgaggcgaaggaggaggaagaggagctggcatgggtgtcgaacaaggacgcgttcgcgacggtggagaccaccatggcgccgtcgccgcgggtggtggagacaccaccggaacacgaccaccggccggcgaacaccccgaccacctctccagagccgcactccgacagaccccgccgcgtcgtccagctacctcgccgcctgcaggagccatccgcatcagccaacctcgcccatgcagtggcggcgacggcgagggcggggcgagagtgcgcgcactgcgggacgacgaagacgccggcgtggcgccttggcccggacagccgccgcaagctgtgcaacgcgtgcggcaacaagtaccggagcggccagctgaacagcacgaccttctcccagaattcccaagaacagaagaagaagagcaagagctcggcgtgttccagggagaggaagcgatcggcggtggcggcgacggtggtggtgggtggtggtctccgtgacgacgcggcggcgatcgcggacgaacacctcgacggcggcgacctccaggccttgttggatgacgtggcgttggatgacgtcgcggcgaggggtggcggcgacgccggcgaggcgaaggaggaagaagaggagctggagtggctgtcgaacaaggacgcgttcccgacggtggagacgatgtcgccggcgccgccggagaaccgaacgaaggcgcccgtgccgccggcggggtggcagtgccggcactgcgggtcgacggagacgccgctgtggcgcgagcgcgacggcccggcggaggcggagcacgtgaggaaggaggagacaccaccgaacatcaccccggcaaccaaacaccgccgcatcgtcgacctcctccgctgctccactgctcttaacacggcggcgaaggcggtggagcggcggtgcacgcactgcgggacgacgaagacgccggcgtggctgagtggtccggacagccgcggcaagctgtgcaacgcgtgcgggaagcagtacaggaaaggtcggctggtgccggagtaccggcctctcaactgtccgaccttctcgccggagctgcactccaacgcacacgcacaccgccgtcgccgagagtcgccggtcgccatcgccatcgccggcgagaagtga

SEQ ID NO: 5423 - DNA, 870 bp, Oryza sativa
  Predicted polypeptide sequence is orthologous to G347
agaaccagaccgtggagcactcgatctccaagctcatctagctcttcttgcttcagcttcttcctctctctcacagttcatcacacttggctttttgagtcaggtgcttgttcttcctgctgttcttgccttggcatatgcaggaccagctgatctgcagcggctgcaggcgcgtcgtccagtacaggagaggggtcgccggcgtctgctgcccgggctgcaacacgctcaccgccgtcaacccgtcagcggtggccgacatgtcggagctcatctgcagcggctgccccacgctgctgttctacaaccgcggcgcctccaacatccgctgccccagctgcaacaggctcaactccaccagatcagccaaccagattgcacacctgacatgcgggcagtgccggacgactctgatgcacccacctggagcctcaactgtgcagtgtgcaacctgcagatatgttaaccatgtcagggatgctcggcctcaaactgtccttgtagagaatcctaagacactggatgataagggcaagctggtgagcaatgtggttgttggtgtcacctcatggaaaagatgatgaacaggggctcatctagggtttaatcccaagggtctatggatgattgatacccttggtggatttgtatcattactacaaagctattgttaaatcaagtgtgttttgaagcttgatataaacaagagaaaaacaatagggcaaaaaatgaagaaaaaaatatatccgaaatgtgccatgtttgtgcttcttttgtgagaaaaaaaatgtaaatatgctggctatggtgctagcctatgtgctttttagcaaaaaggaatggaaatgagatgagcagcattgtgtcctg

SEQ ID NO: 5424 - DNA, 1182 bp, Oryza sativa
  Predicted polypeptide sequence is orthologous to G347
ggtcctcctcctcctcgtcctcgtcgtcgtcatctccaacgcgagctcgacgaagccaaggagaggaggagagagagagagggagagagggaggagggagaccgacgcgaaggcctccgcccccccgaatccggccaccgccattccgctagatcgttggcgcctcagcttcccttcctcccgcggtttcttttgttggagggatttctcgaggcatgcagagccagatcgtgtgccatgggtgcaggaacattctgctctacccgagaggggcaccgagcgtttgctgcgcggtgtgccatgccgtgtccagcacagcaccgtctccaggaatggatatagctcatcttatatgtggtggatgccgaactttattgatgtatactcgcaatgcgacatctgttagatgttcgtgctgcgatacagtcaatcttgtcagaccagtgagtagtatagctcacttgaactgtggccagtgccagacagtgttgatgtatccatacggagcaccttctgtcaagtgtgctatctgcaattttattacaaatactgggatgaatacaatgagacatttgccaccaaatggaacttcatatactgccccatcaacctctgctccaaccactcaatcacagaatgttactgttgttgttgaaaatcctatgacggtagatgcaaagggaaagttggtgagcaacgttgtagttggggttacaactggtggtaaaaagtaacatattggcacacagtgcaccttgttttatgttccatatatggagttggaaatactttgtattatacacaaatgtttgtgatcaattgctggaaggaaccctgaagagcataggggcactcgcaatgtgcacaattacaatcaagctaaaaaaacaaactgcaggtgtgaatactgagatactgtagtttgttacccctgattcttttgtatgtaatatgagagctctgttggattttattgtgtgatcaaatcatctccagatggcactagctgccttctcaatgaataataacagattgcgttcaacatagcgcatgttttgtatacaacctgaatgagctgattttgtaaaatgcatggttttactactatttctggaactagactgagcatgccatctcatcgttcatgtgttaaaatttatttgcatattgtttctgtaagcc

SEQ ID NO: 5425 - DNA, 1089 bp, Oryza sativa
  Predicted polypeptide sequence is orthologous to G347
gctcctccccaaccccaccctcctcgcgattcctcctcctcgtcgtcgtcgccggcgagaggagccgccgccctgttgctggtgctcggtcgatcgccgcgcagttggtgcgcttcccttccctggagccaccaccaccaccactcactgcaggcgaggggtgggtggtctacgctgcggtggtctcgtctccttcctgctgctgctgctgctgcgccgggtatgcagagccagatcgtgtgccatggctgccggagcgtgctgcggtacccgagcggggcgcccagcgtgtgctgcgcgctctgccaggccatcaccaccgtgccgccccctgccccagtaatggaaatggctcatctaatatgtggtggttgccgaacattgctgatgtatactcgcaatgcggacactgtgagatgttcatgttgcagtacagtcaatcttgttagaccagtgaataatatagcacatgtgagctgtggccagtgccggacgactttgatgtatccatatggcgcaccttctgtcaaatgtgccatatgccattatatcacaaacaccggaatgaatactgtggcacccacgccatctccaatgcctacatcaagtggatcttcatataatgcccccccaagtggatcttcatataatgcccccccaccaacttcagctcccacatctcgaccccagaatgtaaccgttgttgtcgagaaccctatgactgttgatgaaaagggtaaactggttagcaatgttgtagttggagttacaactgggaaatagcagcgtattgtctgtaccttgttacatccttgatttgtaccactaaatacgtgaagatgggaataccatgtattacactggtgtttggttgaccattgaagaacaaaaatacaaatgttttttggaatcttgcaaaggaaagtatgaacgcctaaagttgtattttgtatctgttgattcttttctttgtatatgagctctattagactatattgtgatagaagaatgatggaatgacaaagcagtgtcacgtagttatacgtaccgtgcaacatgattgattttttagtttgtatttctcttgcc

SEQ ID NO: 5426 - DNA, 811 bp, Oryza sativa
  Predicted polypeptide sequence is orthologous to G351, G545
ttggccatatatatgttcgatcactcccacacaattctccaaaccaagagcacataacgtatccagggcagagcagcatatcgatcttagaattagctttcagttcacgcgcatcatacaaaaatggtgaccaacatgacccacgatgactacgtctccctctgcctcatggcgctcgcccaggcgggcgtcgggggtcagtggccggcgcagaaacagcagatcgacatggcaccgccggcaccggaacgcgagcttcttcggttccggtgctccgtctgcggcaaggccttcccgtcgcaccaagcgctcggcgggcacaaggccagccaccgcaagccgccgacggccgcgttgcccatgcacgtaatcgacgcgccgccgccgccgtcggccgaggacacagcctcgtcgtcgacgacgacaacaacgtcgggcggcggcaggcacaggtgctcggtttgccaccgtaccttcgcgacggggcaggcgctcggagggcacaagaggtgccattactgggacgggctgtcggtggtgtcggtcacggcttcggcgtcaggttccgggtcgtcgagcgtgaggaactttgacctcaacctgaaaccggtgccggagacggtggccgctggcgtcagaaggtggggagaggaggaggaggtgcagagccctttgccgttcaagaagcgccggctgtcaagcccatcattggagcttaatttatagtagcatcttaattcatcctaattccttactgtccagaaattcattcgtttacttttttttcttgttaaagctatcctttgtgatt

SEQ ID NO: 5427 - DNA, 1097 bp, Oryza sativa
  Predicted polypeptide sequence is orthologous to G351, G545
atcatccatccatctccctgcagctacgtactgtacttgttagcaatcaatcccatcaaatcatccaccgctcgctgctgctgctacgtactatacagcttgattaattaggttttacgacgacggcaacggggacagatatgacggccgccctgcaagcgctgctcgacccgacggcgctgtccttgggcctgcccacgccggcgatcaacaaggaggagtacctcgccatctgcctcgccgcgctcgcctgcacgcgggcggggaaggccctggtgggagtgggaggccagcagcaggtgcaggcctgcaataagtggctgtgcccagcgcccgcggcgcctgaggagctccgcttccggtgcaccgtctgcgggaaggccttcgcctcgtaccaggcgctcggcggacacaagtccagccaccggaagccgccttccccgggagaccactacggcgccgccgccgcggcgcagcagctggcatccgctggtgactcgaaggaggactcggcgtcgtcagcggccgggagcactggcccgcaccggtgcaccatctgcaggaggagcttcgcgacggggcaggcgctcggcggccacaagcgctgccactactgggacggcacgtcggtgtccgtctccgtctcggcgtccgcgtcggccgcctcgtcggccgtcaggaacttcgacctcaacctgatgccgctgccggagagcacagccgccgccgggatcaagaggtgggcggaggaggaggaggtgcagagtccactgccggtcaagaagctcaggatgtccaactaattcatcatacgccatcttgtaaaaacaagagatctgcccattgatcgactctattgaacagagtctattctttgattttttttttcttttcaactcactaattgtttggtttctgtcatcgagtatgcaacaagctaagctggtgaccatggatcttccaagattgattgtcgccaagggacatatatggttctaggagtgttgattcatttgattctttgtatatttgttcaatctaaaaattaatgtactcaatctgctcaatatatatagacgctatattattacgactcc

SEQ ID NO: 5428 - DNA, 712 bp, Oryza sativa
  Predicted polypeptide sequence is orthologous to G351, G545
gtcgatttcataccactatggggctaaacgagaagccattggtgcctccgttgtctccaacgccggtggacttccgagcccatcaggtgttcccatccaagcaccacgattttgacactagcaagagtcgtaacatctctggtagtgtcgccatcggcagtgattctgaggaggagtacttggcgacttctctcttgatgctcgcacatggcattcgggacgagaccaaggacatccgagggatgggagacgtaaaaggtgtgggtgttgacactttggagctggtgaaaccaagccaacgggcttatgagtgctcggtgtgtggcaaggtgtactggtgttaccaggcgttgggtgggcacatgacgtgccaccgcaacctatttgcacaagtggtggccggtgatgagttgtcctccgataggaccatggtggttaaggggcacaagtgctctatctgtcgccttgagttcccatctgggcaggcgctaggaggacacatgcgggtgcactatgtgggtggtgttgaaggaggctctgtcaaggagaagaacgttgtgaagaccaaggttacaggagcactgaagctagtgttgaaagactttgacctgaacgtgcctgttgtggcaacgatggtgggagacgaggctgagagctcacattcagaggccaaagcgcggatgatgacactcccctaaccagcgcaatactt

SEQ ID NO: 5429 - DNA, 894 bp, Oryza sativa
  Predicted polypeptide sequence is orthologous to G351, G545
aatcgcatgcaaacgtatcgccttcaattttcacgacacgagctgtgtgtgttggatagcgtgacgtgatggagcaaggcggcggcgccgccgacggcggcgacctcatctccctgtgcctcatggcgctcgccgccgcggcgcgcggggagagcaccgcgctggcgctggcgctggcgccgccgccgccggagctccacttccggtgctcgctctgcggcaaggcgttcgcgtcgtaccaggcgctcggcggacacaaggcgagccaccgcaagccatcggcggcggcggcggcgccgcccgcgcacagagacgtcgtcgttgctgctgctccggcatcatcaggccgcgtcgccgccgacgccgacgccgcctcggaggcggacgggcggcggcggcggcacgtctgctcgctgtgccggcgaggattcgccaccgggcaggcgctgggcgggcacaagaggttccactacttgcatggcccatcggtgtcggcgacggtctccagtgcagcgacggcggcgagcgtgggcgccgctttcgacctaaacgtggcgcccatcaaggaaatcgccggcgagcaacgacggtgcggcgaggaggccgacgacgacgatgaggcggagagcccttcaccggccaagaagccacgacgccggccaggatgagatcctccacgttagtatatatgaagtactaaccatccaattatatacatatagctcgttgagcatgtatgtatacaaccggtagagaaagcagaggctgctcacgtcgtcacgcgtgtgctccgatcgataactttagggtgtgcaattgtaaataaaaaaagggagattcggagggaaagacgtcctccagacagagattaaacacgggctcgatgttaaaatt

SEQ ID NO: 5430 - DNA, 883 bp, Oryza sativa
  Predicted polypeptide sequence is orthologous to G353, G354, G2839
gctcgtcattaagagcgaaagaaagttacttggaattctttggtttgttgtaatgacaatcacgagagaagaagcggagagcaaggagatggagagcctacgggtgcacgccagcgcgctgctctcgctgtcgtcgcctgcagcgtcggcgtcgcagccgacgtcgtcgtcgtcgacgacggagggggtgttcgagtgcaagacgtgcagcaagcggttcccgtcgttccaggcgctgggcgggcaccggacgagccacacgcggctgcaggcgaagctgctgagcgaccccgccgcggcggcggcggcggcggccgagagggacagggcacgcgtccacgagtgcgccgtgtgcggggtcgagttctccatggggcaggcgctcggcggccacatgcgccggcacaggggcgagacgggcacgacgaccgtcgtgctcgcggacgccgacgactcgggcggcgccaccgtgccgcagccgccggagcccatgccggacctgaactacccgccgctggaggacgccggcgacggctcggagcctgagttacttaaccttcttgtataagttgcatcgatagatatacatgtgaattgaattggcgtctgtacatagatatggtggatggattctttaccaaatttgatcgaaaaaaagaactaaattttggagcgtgatgatcatagcatgtaagttgtaacaaatgattgttaactgtaagataggaattctattcatttgttctcttctgtacaaaattacaaataggttgattaattagttggtcggttgtggttgattctttgtaaaataccaatttactagtataaatatactgacagcttattgtttcaaaaaaaaaaaaaaaaaaaaaaaaaaaaa

SEQ ID NO: 5431 - DNA, 737 bp, Oryza sativa
  Predicted polypeptide sequence is orthologous to G353, G354, G2839
gacaaagctgggtaccgggccccccctcgagtttttttttcctttttattttttttttttttttctgtaacaggtggtatggcctttaattatgtgtatgtacacaaaacaaactacgcttccatcatgtgagtaaaatctctgttatctaaattattctggcatgtacatgtgtggtacatatataaatcaatatttgaaaacagggaacaatggacgtaaaacacagccgattcgatcgaacagtctgacacaaataaaattcgattggaaaattgactaatgaatgaatgaatgaattagtatatccagcgtaaagcaattcctacaatggtaaaatctctatctgaaaaaaaaaaaataatgaatgcaatagccacaatcgtgcaccaatatgtacaggcagcaatcgcacgaatctaaacgaaaagctcgagcaaaacgggcggcgcgtgcaccgccgcggcggcggcggcggcctcctcgcggtggcggcgcatgtggccgccgagcgcctggcccatctcaaagccttggccgcaaatgtggcactcgtgggtcgccgccgccgccggcttctcctgcaccttcttggtggtctccttggccgtggcggcggcaaggccaagcgcgagcccgtggcggccgcgcaggtggctggtccggtggccgcccagcgcctggaacaacgggaacgcgcggctgcacgtcttgcaaacaaagtccccactcccgga

SEQ ID NO: 5432 - DNA, 761 bp, Oryza sativa
  Predicted polypeptide sequence is orthologous to G353, G354, G2839
cagatttcgatcggcgacgttagtgatcagctgggttaattaattacgtggctaattaagctagctatagccatgagcaagaggagcaggaccatgtgggacatgcaggagttcgtcggcagcgtggacacggcccgcgtgctgatgctcctcgcgcagcagagccagcacggcctgctgggcggcggcggcttcgccgccggcgcgcagccggtggtggtgcgcggcggcgcgcacgaccgcgtgttcgagtgcaagacgtgcaaccggcagttcccaacgttccaggcgctcgggggccaccgcgccagccacaagcggccgaggcagcagcagcagcacgcgctcggcggcggcgccggcgccgacgacgtggggctatgcctcgggaggcagccgacgccgccgcggccgcagccggcgaagccgagggtgcacgagtgccccgtctgcgggctcgagttccccatcgggcaggcgctcggcgggcacatgcgtcggcaccgcgcggaggccgaggcggcggcgacaacgacgacgacgacgacgaagaacggcgacgtaggcaaggcggcggccgtgaaggcctgcgacggcggcggtgtctgcctggacttgaacctgacgccgtcggagaaccgcgcaaagtgccggaacgtggtgggtctcggcgccggcgggcagggcgtacacaaggcgctcgccatgttggattgtttcctttgagccgttcaaactgcacatattattgcatgatagct

SEQ ID NO: 5433 - DNA, 382 bp, Oryza sativa
  Predicted polypeptide sequence is orthologous to G353, G354, G2839
acgtcgatggcactgacgtcgtcgtcgacgccggcgggcagcagggcgctggcggcggagggggtgttcgagtgcaagacgtgcaacaagtcgttcccgtcgctccaggggctgggcgggcaccggacaagccacacgcggctgcaggcgaagctgctgagcgaccccgccgccgcagcggccgagagggacagggcacgcatccacgagtgcgccgcgtgcgcggggtcgagttctccatggggcaggcgctcggcggccacatgcgccggcacaggggcgagacgggcacgacgaccgtcgtgctcacggccgccgacgtcgacgactcgggcggcgccaccgtgccgcagccgccggaggccatgctggacctgaacta

SEQ ID NO: 5434 - DNA, 932 bp, Oryza sativa
  Predicted polypeptide sequence is orthologous to G353, G354, G2839
attcaaccacgctttcagccttccaagctctacggctcattatttttccatctccctccttaatttagccaagctctacactgctcgatcaatggcttacgggaagaggcctcggcagcaagccgaggaggcggcgttcagcctgttcgacagcagcgacatggcgcgcatcatgctgctcttctccggcgcccacggcggcggcggtggcgcggcggcggcgtcgccgccggagcggatgttcgagtgcaagacatgcaaccggcagttcccgtccttccaggcgctcggcggccaccgggccagccacaagaagccccgcctggcggacggcgacccggccgccgaggcgccggccaagcccaaggtgcacgggtgctccatctgcgggctcgagttcgccgtcggccaggcgctcggagggcacatgcggcgccaccgcgccgtcatggcggacggcctcgggcttggcctcagcctcggcctcggcatcggcgtcgtcgggcagagcgacgacgacggcggcaagaagaaggccgcggccgccgccgccgccgccgagctggtgttcgacctgaacgcgccggcgatagaggaggagccggatcgcgccaggccggcggggctcgccgtagagttccccgtggtggttgacttcccgtgctgacattgacacagagatttacttctccatacaagttttgaaaattaatttacagtttacatttatacgctacccgagaagtcaaccctggagacattagctagagagattccgtcatacatattttttccctggaaatgtattcggatgattataatgttttcagggcctatatattgtattggttgacttatcgtggtacttatagtcggttgtccttttccctttcggtgctacatattttattctacctgtagtggttgttttc

SEQ ID NO: 5435 - DNA, 884 bp, Oryza sativa
  Predicted polypeptide sequence is orthologous to G353, G354, G2839
attggagagtcatacatctcaagcttgcttcagatttcgatcagcttcagtcttcagacaacagagaggttggttcacaaagtttctgtaagtaaagcattcattcagatcatgaagaggtttgcattcgaggacagcgatatggcgcgcgtgctgatgctcatgtcgtcgcacgggcagcaggagcaggcgctggctctgccggtgccggtgcagctgccgctcgccgccgcgcgcggcgaccgcgccccggagcgcgcgttcgtctgcaagacgtgcaaccgcgtgttcccgtcgttccaggcgctcggcggccaccgtgccagccacaagaagccgaggctcgacggcgacggcgacctctccctgtccaagcccaagctccacggctgctccatctgcggcctcgagttcgccattggccaggctctcggcggccacatgaggcgccaccgcgccatgaccggcggcatgccgcgggcgatcgtcgtcgacaagaagcccgacgtcgtcgacgtccacgtccacggccacgacgacgacggcggcatcaagcgcggcggcctgtggctcgacctgaaccatccaccctgcgacgacgccggcgacgacgacgccgagtgcggccacaatgccgccggcgccggcatcacgttccaccagttcttggataccggagccatggccgttgactgcgtcggctactagctctctttgccggatttttgccggatactacaatacttatatgcaccgattaatcttggtgcaatttctcttttaccttttctttttcttttcatttcttcttcttcttgttgagaaatccacattttgtagcggtagaatatattagttcctaatacaacagagcatggcacacg

SEQ ID NO: 5436 - DNA, 845 bp, Oryza sativa
  Predicted polypeptide sequence is orthologous to G353, G354, G2839
atttcggtagctggtttgctattaacactttaattttgcatgcagcaattaaggtgttaattaatatatataattaagctttaagctcattagtttaccgacgatggaagtggccaccaatacggcgacacgatcgccggtgaagctaatgctggtgctgacactgtcgccggcgagcaaggtgatcgccaagggcggcggcggcgtgaagcgggtgcacctcgacggcggcgcgttccagtgccggacatgcgggcggcggttctccacgttccaggctctcggcggccaccggaccagccacaagcggccgcgggtgcgcgccgacggccttgacctcctcctcggcgcgcgccccggcaagctcggcgccggcggcgcctcgacgccggtagtgcaccggtgcgacatgtgcggcaaggtgttcgccaccggccaggcgctcggcggccacatgcgccgccaccggccgctggtgagtcgtaatggcacaatgtccacgacgtggacggcggcggcggcggcggcggcgacaatgtccggctcctcgtcggaagagcgtgacgacgacgacgacgacgacgtgcacaattataatttcatccactttttgtgagtggctaatggacaaatcaatatatgaattgaataaaaccagtgattaatgtcaataataattaagtttgttctggagtggtatacaaacacgcaacatgcttatagctagatatatatacacgtatacgccacaagatacaataccaattaagttcgtctttgattttgtaatgttcaattatattttttcaatgattaaatacacgtgattttaattgtattcgttc

SEQ ID NO: 5437 - DNA, 1013 bp, Oryza sativa
  Predicted polypeptide sequence is orthologous to G353, G354, G2839
gggagcgcaggtacggtcggaattccgggtcaccacgcgtcggtcggactcgtcggcggcggcggcgggcggcgcggcgaggaggaagagggcgcggcggaggagcgtggtggcgacgtcgggggaaggggagttcgtgtgcaagacttgcagccgcgcgttcccgaccttccaggcgctcgggggccaccggaccagccacctccgcggccggagcaacgggctcgacctcggcgccatcggcgacaaggcgatcaggctgcacagggcggccgacaaggagcacagggacaagcacgagtgccacatctgcggcctcggcttcgagatgggccaggcgctcggcggacacatgcggcgccaccgcgaggagatggccgccgccggcggtggatcctccgccgacgactgggtctggcgctgcgacgcgcggccggaggggatcgccgccgagccaccggtgttgctggagttgttcgcctagttaccgctggtctccattagtttcgtccaagttttgaactgacgcagtgtgtgtcaccattaattagttcatgtcacatgtctagaaaaaaaaaagccaggttcatcgatcttgtaactatgataggggtttaattttttttttcattaggcaaaaaaaaaaaacaaaagggagggcgtcgggaacctctagaggatcaaggtttagtacgcgttgatgcgaggtctagccttctatagtgtccccaattcatcctggggcggcgttaacgcgctggaggacacctgggttccctaatgctgggaatcccttgcggggtattaaggcgcgaggcctcaaagggggacgagagaagcccctggacagcgggggttcacacgaaagacagccagattctcacggcgacaggtgtgtgctcttgtcctcgtattcttctctgtggtgtcgtatagatcgtggaggcgacatcacaagacagttggggaagcagacgagagcacgggatactagccagcccagacgcctcgct

SEQ ID NO: 5438 - DNA, 420 bp, Oryza sativa
  Predicted polypeptide sequence is orthologous to G353, G354, G2839
cggcggccaccggaccagtcacctccggcccactaccaacaagcggcggcccggcccgtccaagcctctaatccacgcgtgcgaggtgtgtgggttgggctttcagatgggccaggccctaggtggccacatgaggaggcatcggcctagaaatattgatctgggccataagcagatcgtcatgccagaaattcggcccagttcctccctgcagctgcttgatctcttcgtttagatacactcaatatacagtggtttatgtgctgtgtgctatagtaccgtactgtcttgcagtatactacagcgaaaaaaaacttacagccatttagtacaaaaaatatttaggaatcaataaaacagatacaatgtttagcctatgacaatgtggatgcactacttaataaactttttttttctacc

SEQ ID NO: 5439 - DNA, 1907 bp, Oryza sativa
  Predicted polypeptide sequence is orthologous to G361, G362, G370, G1995, G2826, G2838
ctgccagtgctttctgctctttctattccctccctcccttctcccttcatagttccaccctccttccattcctctctgctggtcagggacgagagaaacgtaaacccagccgtgacattatattgcctagctagttgattaatttgttgcaagaactggctagctagctcgagaaattctgtgtacctggccgggtgcatgggcagcggcggcgaaggaggtggtggagcagcgagcgtacgggatcagccgccgcatgacttcgccaacgtcgcgtccttctccgagttgccgttcctgcggccggctccggcgcccagggagagccccaacaactccgccatccgcctcttcggcatcgacgtcccgcacgcgtcgtcgtcgcctgacggcaaagcctccaaggaatccgtcgtcgtctccaccgccgccgccgcggcgtccacgcatggcgctgccgctgccgccattgccgcggccgccgacagcagccgcaagttcgagtgccactactgctgcaggcacttcccgacgtcgcaggcgctcgggggccaccagaacgcgcacaagcgggagcggcagcacgcgaagcgggtgcagatgcagaccgcgatggccgctgccgccgcggcggccagcggcgcgcaccaccaccaccaccaccaccagctgctcggctacccgcagcatcatcaccgcttcggcttggcaggccccacggtggcggcattgtatcaacacccgtcgtggccgacgatgagcggcggcggcggcggtatctcctcaattggccctcagttctatagcgggatcggatcggtcacccagccgatcaacgggagcccgctgccggcggggctctggaggccgggcccgatggcggcgccgccgctgctggccggagagcggcggccggtcgcggtgtcgacgtcgtccgtgttccgaggagacgagccaagagcttcagcttctcttgtggcgtcccagacagcttcttcctctttgctgctgtctccgcaaggtcagttcgcttgtgagcagccgccggcgaccaccgcagctgagggcgtgagcttagatttgcacctataattgttcttttttcttctgttggttttagcggattactacgtacaataactgatttctcgctaccttttcttccttgcctgggaatgagattgccctttactaaattcagatgaatcgtgcgccttttttttttctcctgacacgtgcaaaagaattccatttgccaaactttgatccttttgttaatgtgcatatatacacatgacaaaataatttgggtacattgttagggtttgaattatcataaattacgtccaatacaaaacgcctatgcatttgaaaatgtttactaagtagttagttgaggaacagtcaggtttcatgctgtttctagacaataaatgtgcatattaattcctacgatgaaagagaacagaaattacaactgcatgcattaaccaatttcaatttcggattgcaaaagcaccagggacaataaaagagtaagattttaactgatcatatttttcacggaatcggtcacatataagtaagctgaaagtgcacaatactttttcaacaattgaaaaaaaaaatcataatgcatatacttttcatgcggcccagtaaactgctgcagcttgcagggccggcctgtacgtatgcacacgctaaaaaacatgaaggatatagacactaaaattctttctgaagcgggtgcagagttttttgttttttttaatcctctgtacgtgcgtacctatgggcaacagttctagcaactgctgctgcttgtatgcaatgaggctgtagctttatgtgtagctttcgcatgtcgctagggtcaggtatatgcacaactgcagatgcatgat

SEQ ID NO: 5440 - DNA, 1234 bp, Oryza sativa
  Predicted polypeptide sequence is orthologous to G361, G362, G370, G1995, G2826, G2838
gcttcttgcatggtccccctcttcgtccccctctcctccgccccagcttacaactcccatatccccttaaaaccacaccaactcgtagccaatttcttcagcgcggagacgcaagatatagcagcagctagcaagaattgccccgagttgggtggttaattcttggttttggttcacgtagaagcagatagcttggttggttggttagacggccatggcgaagccgcaggacatgcgcagcgtcgactcgttctcgcagctgccgttcatccggccggcgccgccgccgcagcagcaggcgcgggacacaatccggctgttcggctgcgaattctccaacgacctgcagctgcggcccacggaggccggtgcaggctcccccgacgcggccaacggcagcacggtcacgtcagagggcagcaacggcggcgacggcggcaccaagaacggcggcgccgcgacggcggcggcggagcgcaagttcgagtgccactactgctgccgcaacttcccgacgtcgcaggcgctgggcggccaccagaacgcgcacaagagggagcggcagcacgccaagcgagctcacctccaggcctccctcgccatgcaccgctacatgccggggcacatgtacggcctcttcaactaccaccaccacatcggcggccgcttcgaccaccacccgccgccgccgccgccgccgccaccgccggcgcactacccgatgtggacgagcgccgccccgggcgccttcgccgggccaggttccatggcgcagcccatcaacggtagccccgtgcaggccgggctgtggagcgtgccgccgccgacggagaatttcggcagcacggccggcaggcagggcgctgacaagctggctactacggtggcgggcacgccggcggcgggggaggtggcatgcaaggacgagatggtgccgatgagcttgctgtcctcgtcgccttcgttgtcgtcgtgctcgtcgacgtcgccggagatgctaggtaggtgtgaattggggcagaaggagggtgtcagcttggacctccatttgtaatccatgtctaattaggttttcttcttgtggattagcagtcgcaagaaagggtatgttaattctcatagcttaaataatctactctttttgccttgtccggatccaagtttagctagctacctagcttgtgttgccactttatttttaccaggcaaagaaaaagaaaatccttcgaattgc

SEQ ID NO: 5441 - DNA, 1236 bp, Oryza sativa
  Predicted polypeptide sequence is orthologous to G361, G362, G370, G1995, G2826, G2838
gcataaccaaaagaaagaaagaaaaatcttcaatagtggagagagagagagagagagagagagagcgcttctcctcctctcttctcttctcttctcccccttcgcttctctttccccccactcaatcaaaccctaaccctactgcgtacgccgcgccatcgacgacgacgcgctcgcgcgatgagcgttgagcgagatgggcgcgaccagcccaacatcgactcgttctcgcagctgccgttcatccgccaggcggcccgcgagaagccgccgtcgtcgtcgtccggcggctccgtcgtcgtccctcctgcgcccatccggctgttcggcttcgacgtgccgccggacgcgtccaccaccgccgatgtgctaggagagaacaaggagagcgccgccgccgtcgtcgccgctgaggggagtaaacaaacggcgtccggtctggacgcaatcggcggcggcggcgggagccggaagttcgagtgccactactgctgccggaacttcccgacgtcgcaggcgctgggcgggcaccagaacgcgcacaagcgggagcggcagcgcgcgaagcacgcgcagttccagacggccatggccatgcaccacggccacggtcagtactacccgctcccggacccctacgcggcggcgttcgcggcgtaccccggccaccaccaccaccaccgcttcgccgccaccgccgccgccgccatgcctccgccgccgcactacccgtcgtgggctgcaggctccaggtactacagcggtccaggatccatctcgcagccgatcaacgggagcccggtggcgccggccgggatgtggcggctccctgccgccgccagctgcgtcggcttggcgacgacgacgactacggcggcgccgctgcccgcgcggcgccaagagcggccggcggcgacaattccttcgctgctcggaggcggcgaggagcccgtggtgctgggaggagctggctccacctcgttctcgccgtcgacgtcctcctcctcgtcgtcggcgtcgccgcacgagcggcgcgcgcagccagcgcgtaaagagaatgtgagtttggatctgagcttgtagcagcggaggaatgatggccggtgtcagcctcataattgtttcttaattacaaaacaaaatcaagtgccttttcatttcacgtttggatttattttcagctcgttgagctaataccaatggtactagagatcagctactaattaagatagtagt

SEQ ID NO: 5442 - DNA, 804 bp, Oryza sativa
  Predicted polypeptide sequence is orthologous to G361, G362, G370, G1995, G2826, G2838
atgagcatgacgagccccaggctaaagctcttcggcttcgacgtctccgaggaggagacggcggagcacgaggagcagtactcggctgagccggagagcgcgccggtctgcgggggcaacggtggcggcggaggcggcggctcggactcgtcctcgtcgtctactacgaccaccacgacggccacggccggcggcgacgggcggaggtacgagtgccagtactgctgccgcgagttcgccaactcgcaggcgctcggcggccaccagaacgcgcacaagaaggagcggcagcagctcaagcgggcgcagctgcaggcggcggccgcggccgccggccgtgtcgcgggcggcgccgccgcgctctacccgcgcgccaacccgatggtctccgccttcgctccgaccccccacctcctcggcggcggcgaggcggggcccaccagctgggtctacttctccccgcgcgccgccgcggtggccggcggggcgcaaggccagcagttccacgtgtcccacggctgcgtcttccccgcccgcggcgccggccctgccgccgtcgccgccgcctcgccggctgtgttctcgtacactccggcgacgtctgccgccgccgtcgccgcggcctcggcaccctacgtgacgacggacgagcaccacgggcggaggatccacgcgagctcggcggccagccttgcgagatatcccggtccggcgatggtggtggcggagccggtggccaccgtgccggaggacacctgcctggggcttgacctccagctcagccttgcgcccgccggcttgtga

SEQ ID NO: 5443 - DNA, 1364 bp, Oryza sativa
  Predicted polypeptide sequence is orthologous to G361, G362, G370, G1995, G2826, G2838
gacacatggccatcagatcaccttgaacctacctagctagcgagctaatctcctgtagttcagtagctatctagctagcttgccctagctaccttgccggcgagctaggcggtggccggctggccggcgatgagcgagcacgacgcgaaacacgtcggagacgtgccggcggccgcgggcatcgagtcgttctcgcagctgccgttcgtgcgcccgaggccggcggcgatggccggctccagccccgcgtcgtccatccggctgttcgggttcgagctcccgcccgacggcgtcgtctccgccgccggattaggaggcggcggcggcggcggcgggcgcaagttcgagtgccactactgctgccgaaacttcccgacgtcgcaggcgctgggcgggcaccagaacgcgcacaagcgggagcggcagcacgcgaagcgcgcgcagttccagagcgccatggccatgcacgcgcactacccggcctaccctgcctacgccagctactacggctcgcaccgcttcggcccctagccgccgcacatggcgccgccgccgccgccgccgtacccctcgtggtccaaccaccaccacctcccgcccggcggtcccgcgcccatggtggcggcgaggtactacggcccggcgccgccaggctccgtctcgcacccgatcaacggcagcccggtggtgccggccgccgctgcgctgtggcgtgtccccgccgccgccatcgccgtggcggcggccgccgcgccgctggcgcgccaagaacggcagccgccgctgtcgctggccggtggacgcgaggaggaggacgcaatggtggaggtaaggagagggaacggggtaggcggcgccgccgccgcggtggtgcaactgcaacccggctcgcggctgtcgcggtcgtcgtcctcgtcgtcgtcggcgtcgtcgtcttcgcagcatcaccacgagcgccgccgcctgggagacctggcagagattaaccgggagaatgtgagcttggatctcaccttgtaattctccatgagaattgagagatgcgtgcgcgattaattagcgggttcttgccttcttggtaagtgcgaattaagagaaaaaaataattctttttctttagttcgtgaattcgtttagctagagatgctcacaagagagggattttctttttcttcagtgccttttttgcagtcctttttcgccgctgcactcattcaatattccaacctcgttctgtaacttgtaacttctgttcatcacattagatttctttgttagaaatagagataaattcaaggacaagacgtatggagcatgaaagattgtggtctcataattaattactatctccctaattttctact

SEQ ID NO: 5444 - DNA, 944 bp, Oryza sativa
  Predicted polypeptide sequence is orthologous to G361, G362, G370, G1995, G2826, G2838
ggggaattcggcattatggccgggggctcatcatcatttctcatcactgagctgagctcagttcagtcagttcatggaagtatatctccttcttggcttcatttgacaacttccaacacaagcagaacaaggtgatcaaatcatcctcaaggcttgtcttttttttccttctctggttatctccaatggaggctcccccttctctttccatcgtcgacgaagacggcttcgtcatcgacctctcgctgacgctgggcctgacatcgcctccgccctctccaggcggcgcgtctccttccattcctccgggaagaggcggcggcggcggcacgagtggtggtgacaacaacagaggcagcagaggtggtggcaatggtggtggtggtggtggtgtgaggctcttcccttgcctcttctgcaacaagaagtttctcaagtcgcaggcgctagggggacaccagaatgcacacacgaaggagaggagcgtcgggtggaacgcccacctctaactcccggccggcgtcgtcgccgacgacacgacgacgacgaagacggcgaaggccgacctgacatggccggatgcccacacaaaaatgtctccaaggggtgacccctcgcggctcccaatggccaatgcacagcagcagactcgcacgtaggagccagccattaacgaaaccatgcatcgcgactacagcgcggacacaccgcgggggcaaccgcaggcgccgcagccccgcgccgacacgacaacctccaatagccgacgcgggcgcacaccccggcagcgagcgcctcagctacgacacgtagacgccaacgcacgcagaggcgctgcggcgcgacagccgagccgaacagaccaagcagcagacgccactgacgcacgcagccgaccacaccgactcaacaccagtacaaacggaagtaaatgtgcagaagga

SEQ ID NO: 5445 - DNA, 650 bp, Oryza sativa
  Predicted polypeptide sequence is orthologous to G361, G362, G370, G1995, G2826, G2838
agttcttgaagtcgcaggcgctgggcgggcaccagaacgcgcacaagaaggagcggagcatcgggtggaatccctacttctacatgccgccgacgccgcaccccgccggcaatgccgccgccgccgccgcggcggcgacgcccggtgggatgtcgtccgtcacgacgccatccgggagctacggcgtcgtcggtggtgccgccgtcggggctactgctggcgttgggggcggaggtggagtgggaggggggcttctcccggcgcacgcgtacgccgggcacgggtacgccgcggtgccgacgtcgttccccatcgcgtcgcacagctcgagcgtggttggctccggtgggctgcagtactacgctggtaccgccgccgccgccgcgcaatccaagaaggcaaggtcaatcaatcgccatgttcttcttctccaagctccacctactcctcttccaattcctcctcgtgtgtgattaatccccctcttcttgctgcctgcgtacgtactccttaattaattagctcttagggacgttaattaatctcagttcttggctctcttctcctctcctctcctctcctctcatctcacttgtatgttaatgttagtactccttgtaatcgatcaatcagtcctctttttttgcatc

SEQ ID NO: 5446 - DNA, 1270 bp, Oryza sativa
  Predicted polypeptide sequence is orthologous to G363
gagtttgtcatgatcaccaccacactgacaagaagaatatagcatgttattctactcattctccacttgtgagttctgacttatctgcacattggtgagacagtcaatgagtgcagatgagactgcagagattaaccctgtcttgtccagagaataatctttgatttcagagcatcttgccactcaaatatctcgcatacatacataagattcgctcgcatgatctgagctgttttgtctgaatttctgaatgcagctgaggcagaaatcggtgagagtggtaggtgtttgttgcgatcgttgaagcatgaagagcagcagccaagaagcgggagaggaggtgtccgagatcagcagccaggcggcgtccaacaacaacgagacgtgcaactcctcctccggtaaggtcagcctcgacctgtcgctcaccgtcgccgccgccgccgcggcggctgcctccgccaccgagtcgagcaccacggacagcggcggcacgcggccggcggcgacggcgacggcgacggcgcgcgagccggcgcgggtgttcacgtgcaactactgccagaggaagttcttcagctcgcaggcgctgggcgggcaccagaacgcgcaccggcgggagcgcacgctggcccggcgcgccgtgcggctcgacgcgttcccctacggctacgccgacgtggcctcgctgccgctgtacggcgccggcctgtaccccatcggcatccaggcgcacgcgtcggtgcaccaccaccaccctggcgtggcggcgccggcggggcgcgccgagttgaggtcggcgcgcgcgctgctcggcccgatgccgttcttcgtgcaggcggcaggcgatgaggatgccagcttcgggtggccgggcagcttcaggccaccgcccaccgccgccaccaccatccccgccgccgccgccgccccggtcgccgtcaactccggctcctccaactccaaccacggcggcagcgtcgtcgtgcaggccgccgccgacgagcccgacctcacacttagactctagctgtcccatccatccatccattagtctggtgtaacattcatcaggttgctcctgatcatctcctccgtttgtgagtagaattcttgcttgcttgcttgcttcgctctcgatcctgctgcttgagcttgacatcaaccaacctgctagtaaattactattgcttcaaatgcatgcgtggaagtattgtttttgtaaatacagcttagcctatcctaatatgattgtacttgtgccctaagc

SEQ ID NO: 5447 - DNA, 692 bp, Oryza sativa
  misc_feature (125)..(125): n is a, c, g, or t
  misc_feature (286)..(286): n is a, c, g, or t
  Predicted polypeptide sequence is orthologous to G370
tttgaggccttgagtgtgaatgatgagatccaaaggtggctgtccaatattgaacagatgaagagaacccgcagcgtctgagaacgcagaacaacggccggtagtcatacccagttgccacatgnacatgaagattctgctacggtcggcaatgaagagtgccctggtcagaaaaccacgctggttctcgagcaaggtcaggtggagatgatgatatccttgatgatctcgatggagatgatgatttggcaagaagggaggaagcagttgcccaagaagggccctnaaaagcacggatgccgaagaaagatggacctgtgatgcagctgtgttgaaatgaccgtgtctggccagttgcctcgtgggaatgcatgaacgatggtttggctggtgtgtgcatgagtggcccgaaccgatgatgctgtgatgtgcatgccccgtgagaaggattgtgcaccatgtgcgccagggatttggatgcgcttggtttgatgtgtggcatacgatgctgatgcatgaccttgtgctgtgcaccagtttgttcggttggatgttgaagttggcttgcaccccttgcaccatgcctgctgggttgcatgattgcatctgcattggatggctaattatctcttgatggaaaaacacgtccagtataatgaatgagcctcagctcctattcaaaaaaaaaaaaa

SEQ ID NO: 5448 - DNA, 711 bp, Oryza sativa
  misc_feature (38)..(38): n is a, c, g, or t
  misc_feature (89)..(89): n is a, c, g, or t
  misc_feature (159)..(159): n is a, c, g, or t
  misc_feature (255)..(255): n is a, c, g, or t
  misc_feature (659)..(659): n is a, c, g, or t
  misc_feature (689)..(689): n is a, c, g, or t
  Predicted polypeptide sequence is orthologous to G372
gatcttgatggttgtgactagagatggattcctccctntgacgttctcttataggaagaagtgtgaaccagagagagcaataccatatntgtgctatggcccacctgcatatattttgatgggattggaatgccatgggggctgacctggacctatgtngcattgacatgcgcactaggaaatggtggatattgtgcgatgataaatatgcacgccatataaatgatctgctggaccgtgtggaggagctgatanagagtggccataaaactgtgggctgggtgctaggttgtgcgagtgcatggggctgggcggatgctggagaccaaactgccctgaagaaaaggaacaatgccccgtgcctggaggaccctatgcccaggcatctgcctgctgccatgttgggatggcttgcaaccgttgccgatgctgtgcacgccacatggcctgacctgaccgttgatggattgtgtcccacctgctgacacctgatgtgctggtgctgaatgtgaatgcatgactgtgccacaatttggtttgctgttgctggtgttgctgcgtgccctgtgtgctgacgggcatgtggtgacctgaatatataaataaagcgaacttacccttgtgccgatgagcagtgagtacccatcaagttcattgcngtacttctttctgataatctaatactacangaattcaaaaaaaaaaaaaaaa

SEQ ID NO: 5449 - DNA, 1882 bp, Oryza sativa
  Predicted polypeptide sequence is orthologous to G374
gtttcccttctcccttcccctcccgccgcgaagccaccagcgccaccagcttccacgcctccactgccgccacgagagccgaaccacgcagacctaagccagagagatcgcgagagggagcctccgctccttcgcttagcggcggcggagaccatggcgagctccggggaggaagggcgggtggtggtggacctccgctcggcggcggagtcggcgggcggcggcggcggcgacgaggaggcccacgccgcgccgctccacgagatcgagtccctttgcatgcgctgcggcgacaacggcaccacgaggcttctgatgaccatgattccgcacttccgggaggtggttctgatggctttcgagtgcccgcattgcggtgagaggaacaatgaggttcagtttgctggacagctccagccgaagggatgttgttaccgtttggaggtcccgcgcgggcagaacgagatactgaaccgtcaggttgtgaaatctgattcagcaactattaagattccagaactggactttgagatccctccagaagctcaacgtggatcactttcaacagtggaagggattattatgcgagctgtggatgagctgcaggcacttcaagatgaaagaaagaaagtggatcctcaaaaggccgaagctattgataaatttttagcaaaattgagatctcttggattaggagaagctgctttcacctttgttcttgatgatcctgctggaaatagcttcattgaaaaccagaatgcaccttcatcagatcctttgttatctgtgagattctatgaaaggatgcgtgagcaacaggcagcacttggttttcttgttgaaccatccacagaagaacctggggatcagcctgttaatcatgcttcaactgtggaagggaactctgaggtgttgcaggagccccacggttcggttggagctgttgcaggtcgccgtgctatagctcaaggaaaccctgatgaagttgctgcagcgctgtgcagatattcagcaccagaagaggttgatactttgccatcaacatgtggggcctgtggaactgagtgtgtcactcgtttctttgctacaaaaatcccatattttcgtgaggttattgttatggcaacaacatgcgacatgtgcggctatcgcaactcagagttgaagcctggtggtgaaatcccagccaaaggaaagaaaattacactacgtgtgcagaacggaaaagatcttacacgtgatgtcataaagtcagattcagctggcgtaaaagtacctgaactcgagttggaactagcaagtggaacattgggtggtattgttacaacagttgaaggtttaattgtgaaaatatgcgaggctctgcagagagtgcatggattccatttgggtgatagcacactggaatggaaaaagaagaaatgggaggatttcaacgatagattatccaagcttctaagtttacaagagccttggactttaattatcgatgatggattggcagcttcatttgttgctccagctaccgattctttagaagatgacaaccagctaaccattgaggagtatgtgaggagctgggagcagaatgaggagcttggcttgaatgacatggacacatcgtctgctgacgccgcctacaacaccaccaacccataatgtactcaatgttgtaacatgtgatattatcaaatatacttattgtgctccatgttgtagtaagttgcgatatttctcattttaaatcctcaagttttgtgttagccatagcttttgtttctgagacgatcgaagatattcagttgaccaaatttgctttatcagaacgtttcttgtttctttgcttaattacattgaacgccaccggcattgtagtcgtgcc

SEQ ID NO: 5450 - DNA, 2010 bp, Oryza sativa
  Predicted polypeptide sequence is orthologous to G375
atggccggctcccctcatctggccggatttgggagggagggacggaggaaggggagcggtgccgccgactctcctcctagttgtcgtgcgccgccgtgcctctggtggccgccaccttcgccctcatgccgcctccactgctactgccgccgccggccggttcccctcttccggctggatctagaagggagggaggagagcgccgctggccaccgccctccccccttcctcctcgggccagatctgggagggagggaggggagccatagccaggagcagcagccgccaccgccactgccctcccccctccctccggccaccgcgccagggtgcgccaccactgccaccggtgggaggggagaggggaggagaggtgggaggggaggggagaggagagaagaggtgggaggggacttagaaaactttggctgcgagggaagaggggagagagacacgtgtaatgtgatggaccaaaaagtgtggtcctccactttccacacctgcaccgctgctgcagcacacaccgcagcaggagggtcgggtggctgcatgcacgcatacattgttcagtccacctgcagcagcagcagctggttggggggaggaagaagaaggagagtgttcgatcggcggcggcggcggctcaccggtccgacatgcgcaggggttcaccgtggtacgactactactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggtacgtcacggattagctcgatggttgactgatcttgacgatgagctgatggtgttcgacgacgatcttggcgtgcaggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgacctgaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatgtatatagctctgaaaatgagcaacgagacacgagagcagaagcaccggtagcagggaacccacaggcaagcagaacaactggcaaaaatcctctgcaccaacagaccaacaacactttggtttcagctgtacgggctcatgccgatggtggcttcccggcgggcgtaggagacccgcgacttggagaagtagaagtagtaggctccggtgagcacgcaggtgatcagggagaaggcggcgccggcgccgaacgtgccccgccgcaccgtctcgcagtccggcgggttctcgaagaagaccttgcggtagcgggtgtggtaggcggactgcaccagcccggccagcaggcacgactccgcgatgaggaatgtcaacctgagtag

SEQ ID NO: 5451 - DNA, 1134 bp, Oryza sativa
  Predicted polypeptide sequence is orthologous to G375
atcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaacaactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcgtcatcttgcgccgccgccgccgccggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcggcggcggcgtcgcggagtaccatgcgctgagcgcgctccggtacgcggcagggctcggcgatcacctggcgctgccgttcggcgcggggcgggcggagcacgacgccgtcgaggtgaagccggtggcggcggagaggctgctgtcgctcgagtggtgcggcgaggcgagccgcacggcggcgccggagagctccattagctcgctgggactgtggagcggcatgatcggcggcgggcaccatcaccatggctcctccgctgccatctgaggcgaagcaagctagcatgcatgcaatgcgaaggacacgtgatcgaacgccgcgagccgctgcaatctgtgcaagaaggaaaggattagcggtttgctaatagcattaacaaagtatgactacgtagaattgtttggctttaatttctttgctgctgttttccatcttctcatgcatggtaatctcctgcttattttcgtttgtctttgtatttcccaactattccaagtcctggtgatgttcaaaaaaaaaaaaaaa

SEQ ID NO: 5452 - DNA, 831 bp, Oryza sativa
  Predicted polypeptide sequence is orthologous to G375
atgcaggagcagcagccggagaccggccgccggccggcgcagcagttcgccaccgtcgacctgcgccgtcccaagggctacgcggcggctcccgcgacgccacagcctggttcggctgcgactgctgctgccgccgctggcccggctgcgacggcggcagcggcggcggcgggggagggtgacccgtgcccgcggtgcgagtcgcgggacaccaaattctgctactacaacaactacaacacctcccagccccggcacttctgcaagtgttgccgccgctactggaccaagggtggcacgctccgcaacgtccccgtcggcggcggcacgcgcaagaagtcctcgtcttcgtcgtcgtcgtcttcctcgtcatccgccgccgccgcagcacccgccgccaagcgccagaagacgtcgaagaagcgccgcgtcacgactcccgagcccctcgccgccaccacccccgtcctcaccgaagccgccgctgactccgccgccaagacgacgaccgaagctacgtcggagaagaagacgacgacttccacaacgacgacgacaccgccggcgcctgacaccacgagcgagatcaccacggagctcgtcgtcccggccgtggaggaggactcgttcacggacctcctgcagccggactccgccgccgtcaccctcggcctcgacttctccgactacccgtccatcaccaagagtctggccgacccggacctgcacttcgagtggccgccgccggcgttcgacatggcgtcctactggccggccggcgccgggttcgccgacccggacccgaccgccgtgttcctcaacctcccatga

SEQ ID NO: 5453 - DNA, 900 bp, Oryza sativa
  Predicted polypeptide sequence is orthologous to G375
atggactccgactggctcaagggcatcgtccccgaggagcacgggatggggtcgtcgtcgccgtcggcggagctgatcgcgtgcccgcgggcgccgatgcaggcggcggcggcggcggccgaccgccggcttcgcccccagcacgaccagccgctcaagtgcccgcggtgcgagtcgacgcacaccaagttctgctactacaataactacagcctctcgcagccgcgctacttctgcaagacgtgccgccgctactggaccaagggcggctcgctccggaacgtccccgtcggcggcggctgccgcaagaacaagcgcgcgccgcccaagaaggccgccgcccacgcccagcccgcggtggcggtggcggcggcgctgcaaggccgccacatggagaccggactccacctgtccttctccgggatgcagcatcatcttgcgccgccgccgccggcggcggccaccgcggccgacccgctctgcagccttggactatttgactggaagcagtacgaccccgtcttcgccggctccggtggcggcggctcccccgtggcggcgctggagagcgctggtggctcggaggcgcagttcatgggtgctggcatgatgggcattggcggcggcggcgtcgcggagtaccatgcgctgagcgcgctccggttcgcggcagggctcggcgatcacctggcgctgccgttcggcgcggtgcgggcggagcacgacgccgtcgaggtgaagccggtggcggcggagaggctgctgtcgctcgagtggtgcggcgaggcgagccgcacggcggcgccggagagctccattagctcgctgggcgggctgggactgtggagcggcatgatcggcggcgggcaccatcaccatggctcctccgctgccatctga

SEQ ID NO: 5454 - DNA, 2166 bp, Oryza sativa
  Predicted polypeptide sequence is orthologous to G378
tattggctttcctcgcatcaggcatatgcagatgcagtgatactggtgttctaaacttcgaagtagactctggactgggacagctcaatgcaaaaactgtgtcagctactcagctctttgataattatccaattataatcaagctgtaatgacccagaagagcagaaatgatttaagccagtctaccaagtatatccaggagattgatatgcgatggtgtccaaggggcgatatatatttatatattatatattatacatcagatgatcagcacaagccagttcagagttttgagaggtatgttacataaggagaaaggagtgagtagatagaaatatagatatatatgtagatagttcaaccaaaaagatagagcatgtagcaatataagcagaaacaaaatgctctatagattaagggttttctatatatatagagagagagagagatgtcagtcttcttctctaagaacagcaacactgatggacaactcgatcgcagcacacagcaagaaagcagagcagcctcctcctccttctgctacaactatagcagtgatcaccatggccgtcgtcgtcgtcgatctcacagcttcctccggcacaacgggcaggatccatgcttgatcaaccagccgtcgatgcacggcacatggaacacgtgccagcaatccggcaagctcctcaccttctcacctgtctggaaatcctgcagtagtaagaggagccaaatgtttcagaattcacaggattcagtaatcagtgagaattcatgcaaagatctggcacataaatgagaagcacacggttttgatacgagacagtgataaattaaatatggatgcaatgtactctcatcaattggttgcaaggtaatgtgcaagcaataatgcagagatgttcaatttaggtacagtgagtttgagaaatggtaaaagtttcagacctggaggcaaactgaacatcccgagaggtcaccaatggcgttcctcctgtactcctcagtgatcctgacctccgggagcttgtcgatggatgcccgtggcatgccgttggtgccctcgatctcgaacaggtcaggggactccctgaagggcgatgaatccactgcattcatctgaattcagaggcaatctcgtcagacaaatctgtaactgaagctgctactgcatatttctgaatcagacgcaaccatgtatgcaggggcagattcatgagacgaccaaactgacctggctccggaccacccgctgcaccgccggatcgaccttctcgcggacaagcctgccggtcaggaggctgtagatcacattaagctgcattttgtgcagagagatttgtgttaggtttaacaagccaacaaaaaaaaattagcaaaatgtaaggctgtgagcacgtatatatgacagatgaagcagaagagatgttcagaggtcccgtttgtgcagatatttgttgcacaatctacctagggagcttcccccccccccccctaaaagtggtactgagaatacatgagcaggttaattagattgtaaagaatgcacaaattgctttggaaaacatcatctgaactattcttttttgtacgaaataatcatctgaactttcaagacagcaaggtttgacaagttgtatcatctcataaaagaggcagttagctttgaccctttgttttaaaataaacacaaacaggttatatgaattaagcaagtactagttcatataaataaattaagcaacacacactgatgactggtacagacaaggaagttcagtagttgaggtaagcaagcaagcaagcgtgcagctatgaggttgctctcctactccaaagctactactaatctactatacctgtcggcatgatgaagaagaaatgtgtgtgttcgttcttaccacatagcagatgctggagatcccggatcggcgggatcgccagacgcggatggaggagtcgacgacctcgatggagacgagggcgccggtgatggcgccgatgccggtgccgcggaagaggccgctctcggtggccagcccgatcagcccgccagtcaccgctccaagaaacagtccagctgcacacacacaaacacatccatgttaattaacattcatagctaccaccacagctttccggttcaagattcaggcttcaagattgaac

SEQ ID NO: 5455 - DNA, 1246 bp, Oryza sativa
  Predicted polypeptide sequence is orthologous to G378
atatgctaacaagattttttttagagacgtacccaacatccacaaagctagctagctagatcctcctcttctctgcactctgctagagcaagctcgatcgatcgatcagtgatatttccccttatccaaatccagcacaaaccaacaatatccatggaggccgtagcagtgcacgccagcttctcgtcctactcccctccggtggtcgccggcggccgcgacgacgccggcagcagcagcagcagcaggagcatgtcccgcctgccggctcgcgtcgccggcgccgtagctcgcggcatcgtcaccttcgtcttcgccacagtgggcacgatcctgggggcgatcaccggcgggctgatcgggctggcgacggagagcggcatggtgcggggcaccgggatcggggccatctccggcgcggtggtcgccatggaggtcgtcgactcctccgtcgccatgtggtgctcccacgactccgggatctggagcgttctctacgtccttgacgtgatctggagcctcctgacggggcggctggtgcgggagaaggtggatccggcggtgcagaacgcggtggacagccagatgaacgccgccgacgcgcccttcagggagagcgcgccgacgctggcggagatgttcgacaccggcatccccggcgtcgccgccgccgccacgggcatgccggcggacgccatcgccgcgctcccggtcaccacgttcgccgccgccgccggcggcgacgaccgcgccggctgctccgtgtgcctccaggacttggaggacggcgagcgggcgcggaggctgccggagtgcggccacacgttccacctccgctgcatcgacagctggctgctcaggcacgcgtcgtgccccctgtgccggcgcacggtggtcgccgccgccgtcgccgtcgacgacgtcgtcgtcggctgagctggcgcgagctcgcatctggttggctcgttcgtggttaattaggcttaagctagaagattagtgagaagggcgtgcagtgcacggcacgccgccggcgacggcgtgaggatcacgactgacgtgcgtgtgtgtacctactacctcaccttcttttgataccttgattcgttttggcgtagtacatatgtgtagcggatacttgcattatactagtatatacacacacacttgtatgtattgtagatttatatacttgtacatggagaccttgtgattaacataatagagagatccagattttgtctct

SEQ ID NO: 5456 - DNA, 2744 bp, Oryza sativa
  Predicted polypeptide sequence is orthologous to G380
gatcctctcatcaccaccaccaccccacctccttctctccctgtctttctccttctcctcctccttcctctcgctctctcctccttgacaaaatttcctccacccattcccttctccacccaccctgccgatctctctgaattcggtcgcctcctccgcaccatctttctctcctcctctcttctagcaatcggtcgtttcctccggttgttgtgctgattcttcgttctttctctccctctctctctctttctttcttcctctctctgccttggagaggatcaagaaacgaagggagggaggagaggagaggagaagggaaatcgagaaaagtctgttctttggtttggctcgtgtggttcttgagagctgctgtttggaaaatctctgcacctgttgctgaccacttgcttcaattgttgaaagagatgaacagcacctgagatgctattgccagacatcaattgataaagagcacatcttcagtaatgcaaggacagaagaactctgttgagcagcttgctgatgtgtttggatttgaccatgcatccagttcaggaaaccctgtcatggatcaacaaggatattggaacaacattcttggttcagtggagtcacataaccttcaaggttatcaggtgaaccgtagtgatggaactattccctatggaaacggtgtgcatcaaaatggcacttttttaggtttttgggaatcaggcgaagcaagtgcaagtggcagttcactacattttgggggctctaatgagatcaaagctgagcaacgtaatatcggtggtggcctaaggattggtgaaaggcgcttggtagctgagcgcaacctttctttggataatgttgatataggccttaacatcaatggtaatgatctatctggtgaaaattcaaatgtgaatggtgcttcacaaggctctgaactacatggtggctgctctcatactggttcaaatggtcaagcctctgagctgagattacatccatacaggacattcatattaggtgcagatcaacctgagccttttaattctttgaatggcagtgaaaatcctttaggtgatttttccttgatgccagaaggcattgatcagcgaccaggcagttccctggatggccgccggctggcatgcaagaggaaaaatatagaaggagttaatgggcagtgctcggcaggtgctagcactagtttttcccacaggaacgatagtattttccataacattgcttcttcgagtcataatccctctcctagtacaaatttaccctctcctaattgtctgttggttccaagcactcttgatgaacaactcccgcgttatggagctactacagctggattgtcatctagtagctatgatcctagtggaggcaataacaattcaggaggctcacaaagaagttttcggccaagaactagcctggctcaacatattggcccctatggtgtgtggccatcttcaagtactatcagacattccaattcatggaatcatcagccacctccctttcagagttcatttgatgaaccaccggaggtaattccagtggtcagtagcctgaactttcaataccagcatccaatgaatgtcgttcctggcattccacagatgtcacaccggttcactggtccaggggcctcatcatcaagaacaggcaatttggagaacagaattattggtagtgaggaatttagcgcgaggaatgtagtggctaccagcttccctgatgcagttcctccggccgcactagacatgaggcatttgataccagaaccatctagttggaatgtagatggcagagctactaccattccaggaaatgttccttcttcatcgagagctaataccaattcgatggttaatccaccagcaggctctccatttattgcccatcaaaacttgcatagacgtaatcctcgtaatttgtcagaggagataagtcgtttatctggagctcttcgtggccatcagcacccacgcctaaggtccggttttctgttagaacgacaaggtgatggtgtttggggtgttccgttgtcaactaggagcagggaaggaagaagattaattgagatccggaacgcgcttgaaatgattcacagaggggaaaatgtaagatttgagtccattttctatggtggagtcgacattcatgacagacacagggatatgcgccttgacatagacaacatgtcttatgaggagctattggcactggaagaaagaataggcaatgttagcactggcctcagtgaggaagaagtgacaaagctcctaaagcaaaggaaattctcatcatggaggttggaagcatctgtggaagaagagccatgctgtatctgccaggaagagtatgttgatggggatgatctcgggacactggactgtggacatgacttccatgttggatgcgtcaggcaatggctggttgtgaagaacacctgtcccatatgcaaaaatactgctctgaagtcttagaaaaagcacagggcagtaaacactgtgtgcttgttcgatcgcaagatcgtttagtgattcatattaccgtgccgttttttgattagaaattttttttgccattgacctacaaatttgattaaaaaaaaaggtaaaagaactggtccctgcaaactgccccctcctgcagtaaataatccctggaatctgtcgctctgcattcaactgaatatttatggctggtatattggatgatggctcaatatttttttc

SEQ ID NO: 5457 - DNA, 2004 bp, Oryza sativa
  Predicted polypeptide sequence is orthologous to G380
atgcaaggacagaagaactctgttgagcagcttgctgatgtgtttggatttgaccatgcatccagttcaggaaaccctgtcatggatcaacaaggatattggaacaacattcttggttcagtggagtcacataaccttcaaggttatcaggtgaaccgtagtgatggaactattccctatggaaacggtgtgcatcaaaatggcacttttttaggtttttgggaatcaggcgaagcaagtgcaagtggcagttcactacattttgggggctctaatgagatcaaagctgagcaacgtaatatcggtggtggcctaaggattggtgaaaggcgcttggtagctgagcgcaacctttctttggataatgttgatataggccttaacatcaatggtaatgatctatctggtgaaaattcaaatgtgaatggtgcttcacaaggctctgaactacatggtggctgctctcatactggttcaaatggtcaagcctctgagctgagattacatccatacaggacattcatattaggtgcagatcaacctgagccttttaattctttgaatggcagtgaaaatcctttaggtgatttttccttgatgccagaaggcattgatcagcgaccaggcagttccctggatggccgccggctggcatgcaagaggaaaaatatagaaggagttaatgggcagtgctcggcaggtgctagcactagtttttcccacaggaacgatagtattttccataacattgcttcttcgagtcataatccctctcctagtacaaatttaccctctcctaattgtctgttggttccaagcactcttgatgaacaactcccgcgttatggagctactacagctggattgtcatctagtagctatgatcctagtggaggcaataacaattcaggaggctcacaaagaagttttcggccaagaactagcctggctcaacatattggcccctatggtgtgtggccatcttcaagtactatcagacattccaattcatggaatcatcagccacctccctttcagagttcatttgatgaaccaccggaggtaattccagtggtcagtagcctgaactttcaataccagcatccaatgaatgtcgttcctggcattccacagatgtcacaccggttcactggtccaggggcctcatcatcaagaacaggcaatttggagaacagaattattggtagtgaggaatttagcgcgaggaatgtagtggctaccagcttccctgatgcagttcctccggccgcactagacatgaggcatttgataccagaaccatctagttggaatgtagatggcagagctactaccattccaggaaatgttccttcttcatcgagagctaataccaattcgatggttaatccaccagcaggctctccatttattgcccatcaaaacttgcatagacgtaatcctcgtaatttgtcagaggagataagtcgtttatctggagctcttcgtggccatcagcacccacgcctaaggtccggttttctgttagaacgacaaggtgatggtgtttggggtgttccgttgtcaactaggagcagggaaggaagaagattaattgagatccggaacgcgcttgaaatgattcacagaggggaaaatgtaagatttgagtccattttctatggtggagtcgacattcatgacagacacagggatatgcgccttgacatagacaacatgtcttatgaggagctattggcactggaagaaagaataggcaatgttagcactggcctcagtgaggaagaagtgacaaagctcctaaagcaaaggaaattctcatcatggaggttggaagcatctgtggaagaagagccatgctgtatctgccaggaagagtatgttgatggggatgatctcgggacactggactgtggacatgacttccatgttggatgcgtcaggcaatggctggttgtgaagaacacctgtcccatatgcaaaaatactgctctgaagtcttag

SEQ ID NO: 5458 - DNA, 693 bp, Oryza sativa
  Predicted polypeptide sequence is orthologous to G383, G1917
tttttttttttttttttttttttttttttttttttttttttttttcccctttcaaaaatggcgggaaaattcattcatttcaaacatttttcaggggcctatcgaaaactaacaactcacccggatggaaggaataaacccaatttattctctcccatcaccccggggttaaaaaaataaaatctataaccctaggaaaaaagggtggcaaaacaaaaacaaaattaaaaaggaaaggggagtaggaaaaaataaataaaaggaataattcccccccatccttttatattgcccgaaaatgggggcttgaacaacccttaaaaaccacggcagtagttaaccatatgggaaaaaattccccgatgggggggctggggattaccaacccaactttatttcttccaactgttcttccacctttatgggggcccccggggggcctaaacggggcccactaactcttcggggggcaccccctctttgttcaccctcctggggaaagggcccttgctttacacaacccttttggggggcgccaacccttccgccagaatgggcaacaaagatcgccgttcgctcactcgccggcaaaactgtgcgccccctcgcccttgcccccccccccaggggaacgcggaccacccccacttatccttccgaggtaaaaccccgggggagaatctggcgcacctt

SEQ ID NO: 5459 - DNA, 1149 bp, Oryza sativa
  Predicted polypeptide sequence is orthologous to G383, G1917
gtgtagagtgttgtgaatagccagttcagttcatcagttgataggagccatgcttcaccattactacagcggcggcgccggccatcatcaggacgtcgctgcagctggtagccccggcgacatggcttcctccaccttctcgctcttcttcccgatgtccaatgggcagtgttggccgccgtcgacggtggaggagtccgcggcctacgacgaccacagcaccgtcaccacctctccttcctcgccttcgtcgtcctccaccggctccgtcgactgcacgctctcgctcggcacgccgtcgtctcgccgcgccgagcccgtcgcggcggcggcgccagcggcaaaccatggggcgcccgtgccggcgcattatccgtcgctgtcagcggcgaccgtgtcctgggacgcgactgccgagtcgtactattgtggccagcaggggaggccggccaccggcgccgccaagtgcgccgccggcgccgggcacgacgcgctcctcgaccgccgctgcgccaactgcggcaccgcgtccacgccgctctggaggaacggccctcgcggacccaagtcgctgtgcaacgcgtgcgggatcaggtacaagaaggaggagcggcgcgcggcggcgacgacgacgacggccgacggcgccgccggatgcggcttcatcaccgcgcagcgtggacgcgggtcgaccgcggccaaggcggcgcccgccgtgacgacgtgcggcgaggagacgtcaccgtacgtcgtcggcggcggcggcggcggcggcgaggtcgcggacgcggcgtatctcgcctggcggctcaacgtcgtcccaccggcggcgacggcgacggcgttctcggtgtggccggagcgagctagcctctaccactacaactagctataggcgattaactagtgtagcattagcgttggggagaagggaagctgcaccgtttttttggggaacattttgtacggtcgcacgctcccggattgatcgaactgtatgcatctgctgtgctgtgttgcacgctagctagctagatgactctgatcttgaaacgaaccgtgatcatttcattcatttggaatgaacatgtagctgtgcaaggtcatcttgctcggaaaattcataatcttccaatctcttgtgctgcc

SEQ ID NO: 5460 - DNA, 2537 bp, Oryza sativa
  Predicted polypeptide sequence is orthologous to G384, G385
acggggaaatacaacagaatcgaaatacagaatactgggataacgacacactgggagtcacttgcaacctttagggttgaatctccggagatggaaatgaatcaacagcataatgagggcaacgaatctttcgtggccttgatgaacggttttgctggtgacgggacggcaacactaccgaatgatggggagcagagaatgagtattccagcaagagaattatttgcagcaattgaggccgactcaggcttgttgcctgtgaacagtagcaacactaatgaaaaaaggaagaggcgtctacagaggctcactggcaaacagtcggaggtacttgaggggtttttcagcatctgtgggcatcccgatgatggacaaaagaggcatctgagtgagacaacaggtcttggtttagatcaagtgaagttttggtttcagaataaaagaacacaagtaaagactatgtgctggaaggaagagaactataagttgtcggtggagaatgaaattctgagggatgagaacaggagagttaagatagctcactgcactgctgtatgcctcacttgctgtaattcatcagtacagaaccagcttgccgttgagatggaaaggttaatggggcagagtgagtggctgcaacaagagattgcacggtcgaatggaacacccccggctgcaaaccttgcctttcaacttaattcatcagcagactatgtattttcagggcaacatgaccaacaaatgattgctgaactagccaaaaacgcaatgcacgcattgattattttggccgaatcccatgtcgctctatggtttcccgtccctggctgttcttatgaagtattgaacaagatggcttatgaccaagcatatcctggggataacagtgcaaacgccattggattcaagacagaggctactcgtgcagtttctatggtgatgatggactacaaaagcgttgtggatttcctcatggatccttacaactaccgaactttctttcctgaagttatttccggggcagtaaccaacaggatctacacgtggcctaccagtgatggttataatggggttatacaactgatgactgtcgagatgatgttcccatcgcccctggtaccggctaggaaatgcacattcctgcgctattgtaatgtgctgaacgaaggattagtggtcgtcattgatgtgtcattggacgatggcagtatcttctccaaatgccgtaaaatgccatcagggtttctgatccaatccataaggccaaacagctgcaaggtcactgccatagagcacgtccttgcggatgacaccggtgttcatgagctctaccagcctcgtgtgaatggactcgtcttcggagctcggcgctgggtggcgaccatggcgcggcagtctgcacgcatgagagatgttcatcacaacaagacagctccgcaagtcagcacgaaggggaggaagaatctaatgaagctagcggacgacctgctcgcgagcttcgccggcggcatcgccgccactggcggaggaacgtggaccgtcgtgatcggcgccggcacggagaaggacatcagggtcgcgtacaggaggaccaccgagggcagcagcagctacaacgcgatcctgtccgtcaccgcgtccctgcgtctgccgctgcccatgaggaaaaccttcgatctgctcaggaaccttactcaccgctgcaagtgggacgtcctggtgcacggcagcgtggtgaaggaggaggtcaccatcgccagaggcgtcgggaacgacgacactgtcaccgtcctccactgcaagcgcgccggcagggaggacaggggaaggaccatgatcctgcagaacaacgggtacgacgcgtcgggctcgttcatggtctactcccagatcgacagcgagctgatgaacaccatggtcctgagccccagcgacctgccgcccgggcggggcgggccgtccctctaccccaccggcttctcccttctccctgacgtcgaggctgcccaggacagcagcggcatcgccctcggcgaggttgggggaactctcatgaccatgggcttccagattccggtgaagctcgccagtggggatcgcatgtattcccggtctgcggcatcggcaatcaggctcatgactgacaccattgccctcgtcaagaagacgctgatgaacgagcattctggtatctacggggttagcccgttccacccctagattcagaaaaacaccagagggagaaaagggaggtccgtgtgcagataaaaatcaagaacatgcgaaggggattcatcggctccgatcaccctgcatctcccagaatttgctgaattaattagaactttaaggttgtgttaacaacctgtaataatgtttttaaggccaaacttatatcgtgtctttgctgtaataatgtagtatgcgcctgatggatgtcgactgccgtgtaccgatgcagtttgcttcgcagagacgcggatacatttgctatcgtatggatgctcctttagaagcaaaaaaaaaaaaaaaaaaaa

SEQ ID NO: 5461 - DNA, 390 bp, Oryza sativa
  Predicted polypeptide sequence is orthologous to G384, G385
cgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaag

SEQ ID NO: 5462 - DNA, 3063 bp, Oryza sativa
  misc_feature (3002)..(3002): n is a, c, g, or t
  Predicted polypeptide sequence is orthologous to G384, G385
ggcacgagtgatctcttgccgtgtgatctctagcttgtgtgctagatctgtttctacttgcgtttgcgttgcttggcaagcaagatatatatatatatatctatatctatctatctatcattctatctccctacatatttagagctagcactttgtgtgttctttgggtttgggacacactcatatacgcgtgttcatgagtggaaatggaaggagctgcaagggcaagaattagggtttgagatataggagtataatgatgatcccggcgaggcatatgccgtcgatgatcggccggaacggcgcagcgtacggatcctcatcggcactgtcactcagccagccaaacttgctggataatcaccagttccagcaagcgttccagcatcagcagcagcagcatcatctccttgaccagatcccggcgacgacggcggagagcggcgacaacatgatccgcagccgtgcgtccgaccctctcggcggcgacgagttcgagagcaagtccggcagcgagaacgtcgacggcgtctccgtcgacgaccaggaccccaaccagcggccgcgcaagaagcgctaccaccgccacacccagcatcagatccaggagatggaagcattcttcaaggaatgtccacacccagatgataagcagcgcaaggagctgagccgggagctcggcctggagcctctccaagtgaagttctggttccagaacaagcgcacccaaatgaagaaccagcatgagaggcacgagaactcgcagctgcggtcggataacgagaagctccgggccgagaacatgcggtacaaggaggccctgagcagcgcctcctgccccaactgcggcggccccgccgccctcggcgagatgtccttcgacgagcaccacctccgcatcgagaacgcccgcctccgcgaagagatcgataggatatcggcgatcgcggcgaagtacgtggggaagccaatggtgccgttcccggtgctgtcgaacccgatggcggcggcggcgtcgcgggcgccgctggacctccccgtggcgccgtacggcgtgccgggcgacatgttcggcggcggtggcgccggggagctgctgcgcggggtgcagtcggaggtcgacaagccgatgatcgtggagctcgccgtgccggcgatggaggagctggtccgcatggcgcagctggacgagccgctctggagcgtcgcgccgccgctcgacgccacggcggcggcgatggagacgctcagcgaggaggagtacgcgcgcatgttcccccgagggctcggccccaagcagtacgggctcaggtcggaggcgtcccgcgacagcgccgtcgtcatcatgacgcacgccaacctcgtcgagatcctcatggacgcgaatcagtacgcggcagtgttctcgaacatcgtgtcgagggccatcacgctggaggtgctgtccaccggcgtcgcggggaactacaacggtgcattgcaagtgatgtcagtggagtttcaggtgccatcgccactggtgccaacgagagagagctacttcgtgagatactgcaagcagaacgcagacgggacatgggccgtcgtcgacgtctcgctggacagcctccgccctagccccgtcctcaaatgtcgccgccgtccgtcaggctgcctcatccaagaaatgcccaatggctactccaaggtgacgtgggtggagcatgtggaggtggacgacaggtcggtgcacaacatctacaagctgctggtgaactccgggctggcgttcggcgcgcggcggtgggtcggcacgctggaccgccagtgcgagcgcctcgccagcgtcatggccagcaacatccccaccagcgacatcggcgtgattacgagctcggaggggaggaagagcatgctgaagctggcggagaggatggtggtgagcttctgcggcggcgtgacggcgtccgtggcgcatcagtggacgacgctgtccggcagcggcgccgaggacgtccgcgtcatgacgaggaagagcgtcgacgaccccgggaggccccccggcatcgtcctcaacgccgtcacctccttctggctccccgtcccttccaagcgcgtttttcacttcctccgcgacgaatcctctcgcagtgagtgggacatcctctccaatggcggtatcgttcaagaaatggcccacatcgccaatggccgggatcagggcaactgcgtctcacttcttcgcgtcaacagctcgaactcgaaccagagcaacatgctgatcctgcaggagagctgcacggacgcgtcggggtcgtacgtcatctacgcgccggtggacgtggttgcgatgaacgtcgtgctaaacggcggcgacccggactacgtcgcgctgctgccatcgggcttcgccatcctgcccgatgggccggcgcacgacggtggcgacggcgacggcggcgtcggcgtcggctccggcgggtcgctgctgacggtggcgttccagatactggtggactccgtcccgacggcgaagctctcgctggggtcggtggcgacggtgaacagcctcatcgcctgcacggtggagcgcatcaaggcggccgtctccggcgagagcaatccgcagtagcttcgtccttgaatcaaacaaaagcttcttgtgctttcaatttcaggagcagcaaaattttggagctttcatcagtgggaagtcaagaacgcacctcagactgtccttgccatgtggtgcccatatatagtttggattatttttcgctagtttttccgcaaattcgggaaatttcaaaaaaaatgtgtcaccactacgcaagggcggttggttcgggtattgacttcctcttcatgttcgcctctcggatgctgctaccttatgaatttagggttcttctggagtacaaaaaaaaccccttaatttgatctgtaatttctgttgttcagacttcccagtacctagctagctagtaggagttgcagaatagagatctgtgtccctgtcttanacttttagttctcttcagtgtttgatcagtgctgtttcaatccaaaaaaaaaaaaaaaaaa

SEQ ID NO: 5463 - DNA, 759 bp, Oryza sativa
  Predicted polypeptide sequence is orthologous to G384, G385
atgtcatcctctctttatcccttcttcctcctctctctcatcccttctctatctctccctctttctcttcgtgcgtggggagcggcgtccggatcggcggcggcgacggagggcgggggccagagcggcaggcaggatggcgggtgggcggtcgctggagttgtggacctggaggcagcggcggtggcttgtcacgtgttgcgcagccatgcacaggaggtgaacttcgtccgctactgccgacagatcgagcaggggctatgggccatcactgacatcttcgtcaacctgcagcgcgacgcctacttcggcgtgccaccgctgcgttcccgccgactcccgtcgggatgcctcatcgctaacatggccaatagctactccgaggtgaccagggtcgaacacatggaggtggaggagaagaacccgatcaacgtgctctaccgtgacctcgtgctgagcggcgatgtattcggggcgcactgctggctcgccgcgctccagcgcgcgtgcgaccgctacgcctccctcgtcgcgctcggcgtcccgcaccacatcaccggaggtatgcacacgctatgccacgcacctagcccagatccagagcttcgaatcggccacgacgggcggctagaggacgggccgcaaggaggagctgctcctgcgcctgtcgcccgaggtccgccgcctggcacccgctcgccgccgcctccactcgagcccccgcgccgccggctcatgtcaagggggagagagagataa

SEQ ID NO: 5464 - DNA, 3280 bp, Oryza sativa
  Predicted polypeptide sequence is orthologous to G384, G385
gccccccctctcgcaataactcctcctccccatctccacattcctcccccaaatcccctcttcttcttcttcttcttcttcctcctcctcccatggcgatcggcgtctgcttctagctagagagatctcgcttcgtttcgagctgtccaccggtggttttctcgcatgcgatatcacacgcttcttggaagcacatcagagttcttggtgctgaccttgccctagatctgcttctgactgttgctgttacgtggcgtgcaagctagctatagccatttctgtgtgtgtagctgtactggtggtgaagaagaagatgcaagcgaatgggtggaggagctagaggcttggctggaggaagaagaagaaggggttggtggtggctagctagctagggtgcgtgcttaattacctggcttcgttcatgacgccggcgaggcgcatgccgccggtgatcggccggaacggcgtggcgtacgaatcgccgtcggcgcagctgcccctcacccaggctgatatgctggacagccatcatctgcagcaagcactccagcagcaatacttcgatcagatcccggtgacgacgacggcggcggcggacagcggcgacaacatgctgcacggccgcgccgacgccggcgggctggttgacgagttcgagagcaagtcgtgcagcgagaacgtcgacggcgccggcgacggcctctccggcgacgaccaggaccccaaccagcggccgcgcaagaagcgttaccaccgccatacccagcaccagatccaagagatggaagctttcttcaaggagtgcccgcacccagacgacaagcagcgcaaggagctgagcagggaactgggtcttgaacctctgcaggttaaattctggtttcagaacaagcgcacacagatgaagaaccagcacgagaggcacgagaacgcgcagctgcgggcggagaacgacaagctgcgcgcggagaacatgcgatacaaggaggccctgagcagcgcgtcgtgccccaactgcggcggccccgccgcccttcgacgagcaccacctccgcgtcgagaacgcccgcctccgcgacgagatcgaccgcatctccggcatcgccgccaagcacgtcggcaagccccccatcgtctccttccccgtcctctcctccccgctcgccgtcgccgccgcccgctcccctctcgacctcgccggcgcctacggcgtcgtcacccccggcctcgacatgttcggcggcgccggcgacctcctccgcggcgtgcacccgctcgacgccgacaagcccatgatcgtggagctcgccgtcgccgccatggacgagctcgtccagatggcccagctcgacgagccgctctggtcgtcgtcgtcggagccggcggcggcgttgctcgatgaggaggagtacgcgcgcatgttcccgcgcggcctcggccccaagcagtacggcctcaagtcggaggcgtcccgccatggcgccgtcgtcatcatgacgcacagcaacctcgtcgagatcctcatggatgtgaatcaattcgcgacggtgttctcgagcatcgtgtcgagagcgtccacgcacgaggtgttgtccacaggcgtggcaggcaactacaatggtgcactgcaagtgatgtcaatggagtttcaagtgccgtcgccgctggtgccgacgagggagagctatttcgtcaggtactgcaagaacaactccgacgggacatgggccgtcgtcgatgtctctctcgacagcctccgccccagccctgtccagaaatgccggcgcaggccgtctggctgcctcatccaagaaatgcccaatggctactccaaggtgacatgggtggagcatgtggaggtggacgacagctcggtgcacaacatctacaagccattggtgaactccggcctcgcattcggcgcgaaacggtgggtcggcacgctggaccggcaatgcgagcgcctcgccagcgccatggccagcaacatccccaatggcgaccttggagtgattacaagcgtggaggggaggaagagcatgttgaagctggcggagaggatggtggcgagcttctgcggcggcgtgacggcgtcggtggcgcaccagtggacgacgctgtcgggcagcggggcggaggacgtgcgcgtcatgacgaggaagagcgtcgacgaccccggcaggccaccgggcatcgtgctcaacgccgccacctccttctggctccccgtccctcccgccgccgtcttcgacttcctccgcgacgagacctctcgcagcgagtgggacattctgtccaacggcggcgccgtccaagaaatggctcacattgccaacggccgtgaccatggcaactctgtctcgcttcttcgtgtcaatagtgcaaattcaaaccagagcaacatgctgatcctgcaagagagctgcacggacgcgtcgggctcctacgtggtgtacgcgccggtggacatcgtggcgatgaacgtggtgctcaacggcggcgacccggactacgtggcgctgctgccgtcggggttcgccatccttcccgacgggccgtcggggaacgcgcaggccgccgtcggggagaacggctccggctccggcggggggtccctcctgacggtggcgttccagatcctcgtcgactccgtgccgacggcgaagctctcgctgggctccgtcgcgacggtgaacagcctcatcgcctgcacggtggagcgcatcaaggccgccgtctgcagggacagcaaccctcagtagtagcaccggcttcaaccaaatatgatcacgaacaatgttccaaggagcagcaaaattttggagtttgattcagcagtagggagtcaagaacgcacctcaaactctccttgccatgtggtgcccttgctagtgaagaatttgcgaggaaaccgacgcgtttgcgagaaaattttcgcgaagatacatagtgtcaccactatgcaaggggggatggttcgggcattgacttccaccttttgattttcatcaaatgcatcgaagagtggatgctgctaccttgttgtttttctgaatctctatgttagggcttcttttaccatgtttaaaaagggctatgaagcctcatttttatctgtactgttgtgatgtgttgtctgtttgttcagacttcaggttcctgtcccttagctaggagttgagaatagagagattcatgtccccccttttggattttatcacatttccgatgatttgtagacttgtggttgttgcttgttggtcattaccattcttgtctc

SEQ ID NO: 5465 - DNA, 3089 bp, Oryza sativa
  Predicted polypeptide sequence is orthologous to G384, G385
agcacgcactgctgctgctgctcgctctcgctttgcttcccctaatcttctcccgggccaggggggaagaggggcggaattcgggcacgagctttggagttggagatcacttcggcgacggcgtggtccccgccggcatgcagttcccgttctccggcgctggcccgggcgtcttcacgtcatcgccggcgctctccctcgcgctggcggacgcggtggcaggccggaacagcggcggcggtgggaagatggttaccgcggcccatggcggcgtcggcggaggaggaggaggaggacgcgcgaaggcgagggacgcgttggaggtggagaacgagatgagccggtccgggagcgaccacctcgacgtcgtctcttgcggcgacgcgggcggcggcggcggcgacgacgacgatgacgaggacgccgagcacggcaacccgcccaagcgcaagaagcggtaccaccgccacacgccgcagcagatccaagagctggaagcgatgttcaaggaatgcccccacccagacgagaagcagcgcgccgagctgagcaagcggctcggcctcgaaccccggcaggtcaagttctggttccagaatcggcgaacgcagatgaagatgcaactggagcgacacgagaactcgctgctgaagcaggagaacgataagctgcggtccgagaacctgtcaatccgggaggccacgagcaacgcggtgtgcgttggctgcggcggcccggcgatgctcggggaggtgtccctggaggagcaccaccttcgcgtcgagaacgcgaggcccaaggacgagctcagccgagtgtgcgcgctcgccgccaagttccttggcaagtccatctctgtcatggcgccaccgcagatgcatcagcctcatcctgtgccaggctcgtcgctggagcttgcggttgggggtatcggttcgatgccatcagccacgatgcccatctcgacgatcactgattttgctggcgccatgtccagttcaatgggcacggtgatcacgcccatgaagtctgaggctgaaccatcggcaatggctggcattgacaagtccttgttcttggagctagcaatgagtgcaatggatgagctagtcaagatggctcagatgggggatccgctttggattccaggtgcctccgtaccttcctcgccggcaaaggagagtctaaacttcgaggagtacctaaacaccttcccaccttgcatcggggtgaagcctgaagggtatgtatcagaggcatctagagaatctggcattgtcatcattgacgatggcgccgcgcttgtggagaccctcatggatgagcgacggtggtccgatatgttctcatgcatgattgccaaggcatcaaccactgaggagatttctactggtgttgctgggagtagaaatggtgcattgcttcttatgcaggcagagctacaggtgctttctcctcttgtgcctattagagaggtgaagtttctcaggttctccagacagctggctgatggtgtatgggctgtagtggacgtttcggctgatgaattgatgagggatcagggcattacttctgcatcctcgactgcaaacatgaactgccgaaggctgccttctggttgtgtgctgcaggacactccaaatgggtttgttaaggtcacatgggttgaacatacagaatatgatgaggcatctgtgcacccgctctaccggcctcttctccggtctggtcttgcccttggtgcagggcgatggatcgcgacattacagcggcagtgcgaatgcttggcccttctcatgtcttctattgcattgccagagaacgactcatcagctatccatcctgaaggtaaacggagcatgttgaagttggcaaggaggatgacggacaacttctgtgcaggggtgagcacatcatctacccgtgagtggagcaaactggttggattgacaggcaacattggggaggatgtgcatgtaatggcgcggaagagtgtggatgaacctggaacgccgccaggtgtggtgcttagtgctgctacatctgtgtggatgcctgtgatgcctgaacggctcttcaacttcttgcacaacaaggggctgcgtgctgaatgggatatcctcagcaatggtggccctatgcaggaggtgacaagcattgccaaggggcaacagaatggcaataccgtatgtctactgaaggctagtcccaccaaagacaagcagaacagcatgctgatcctacaggagacgtgtgcagacgcatccggttcaatggttgtgtatgctcctgtagacatcccagcaatgcaccttgtcatgagtggtggggattcgtcatgcgtcgcccttcttccatcaggttttgccatcctgcctgctgggcctagcatcggcgcagatcacaagatgggcggttcattgctcaccgttgcattccagatacttgccaacagccagcccagtgctaagctcacggtggagtcagtcgagaccgtgagcaaccttatctcctgcaccatcaagaagatcaagacggcgctgcattgcgacgtgtgaacccaacaaggggggacttttggcctagtgggagcggctgtggcgatgagcctgagtcaagaacgaaccgcgacataggaagggacctttgctaggtggcaaggaccggacggggcaggtccttagcacagagcaatggtggtggttcgggtattgactcagcctctcccgcctccgttctctcctgtgactggtgcatgttgaagtgaacctgcattttggacgccatgtagcaggccatctttctttctttttcctttttctttttctttttctttttttagggagaagggagtcatctgtgttttttgttggctggctcagggtgttggtgtttctggtttctagcttttgttacagggagatgtgatacattttgtagaagctccgaattgtcgtgctggtatgtgaggttctgatcataggtctgtgtttgatagtctcgagctatcaacgcctggcaaatgcaaaccttgttatgctaaaatatgttttagatcaatctgattctgaaagctgtttacatgtccc

SEQ ID NO: 5466 - DNA, 3437 bp, Oryza sativa
  Predicted polypeptide sequence is orthologous to G384, G385
gtctggttctatttttctctcgcgtccacacgacgggggggcctcctctcctctccctcctcccctcgtctccacactagacttgccattttgaccctccgcttgctccctcctcccgttcctatctccccgccgccgtacataagtgctttctttaatcggatgcgtcccctcccctcgccaccagttcgttcgctcgctcgctcgctcgctcgccttgttaatctatccctccctctctcccgcccctccgtccgccgtggagggttagggttttgagggttcgctcgcctcggcgaggctttatctctctaccagtagtctcttactcttcttcgttgggccgtgggttaggaatcgggttgtgaggcgtgtgggaggggcggggtagatccaaggaagaggactttctcgagtttacgccgtggtgttttgcttcggcgaggaggcggcggcatgagctttgggggcctctttgacggcggcggcgggggaggcatgcagttccctttcgccagtggcttcgcgtcctcgccggcgctctccctcgcgctggacaacgccggcggtggcatcggcgggcggatgctcggcggcggcgctggcgctggttctagcgcgggcggcgcgatgacgagggacactgaggcggagaacgacagccggtcgggaagcgaccatctcgacgccatctcggccgccggcgaggacgacgtcgaggacgccgagcccagcaactcccgcaagaggaagaagcgataccaccgccacacgccgcagcagatccaagagctcgaagcgctgttcaaggagtgcccccatccggacgagaagcagcgcgccgagctcagcaggaggctctccctcgatgcgcggcaggtcaagttctggttccagaatcgccgcacgcagatgaagacgcaactggagcggcacgagaacgcgcttctcaagcaggagaacgacaagctgcgcgccgagaacatgacgatccgggaggcgatgcgcagcccaatgtgcggcagctgcgggagccccgccatgctcggggaggtgtccctagaggagcagcacctgcgcatcgagaatgcgcgcctcaaggacgagctcaaccgcgtgtgcgccctcgccaccaagttcctaggcaagcccatctccctcctgtcgccgccgcccttgctgcagccgcacctctcgctgcctatgcctaactcgtcgctggagctagcgatcggaggcatcggtggcttagggtctctcggtacactacccggctgtatgaatgagttcgccggaggcgtgtcgagcccgatgggcacggtgatcacgcctgcgcgcgcaaccggggctgctataccatcgctggtgggtaacatcgacaggtccgtgttcttagagcttgcaatcagcgcgatggacgaacttgtcaagatggcacagatggacgatccattgtgggttccggcactgcctggttctcccagcaaggaggtgctcaactttgaggagtatcttcactccttcctaccgtgcattggcatgaagcctgccggctacgtctctgaggcctcgagggaatccggtctagtcatcatcgacaacagccttgcccttgtagagaccctcatggatgagagacggtggtctgacatgttctcgtgcatgattgctaaggcaacagtgcttgaggaggtgtctaccggcattgcaggaagcagaaatggcgcgttgctgctgatgaaggctgagctacaggtgctctcacatctagtaccaattagggaggttacatttctccggttttgtaagcagctggctgagggtgcatgggcagtagttgatgtgtccattgatggtttagtgagagatcataattctggaacggcacccacaggtggaaatgtgaagtgtaggagggtaccttccggctgtgtgatgcaagacactcccaatgggtattgcaaggtcacatgggttgagcatacggaatacgatgaggcatcagtgcaccagctctaccgtccactccttcggtctggtctcgcctttggcgccaggcgttggcttgcgacgctgcagcgccaatgcgaatgccttgccatcctcatgtcctctgctacagtgacagcaaatgactcgactgctatatcgcaagagggcaagcgaagcatgctgaagctggcacgccggatgacggagaacttctgtgctggggtgagcgcatcgtctgcacgtgaatggagcaagctggatggtgcgaccggtagcatcggggaggacgtgcgcgtgatggcacggaagagcgtgagcgagcctggagagccaccgggcgtggtgctgagcgcggccacctcggtgtgggtgcccgtggctccggagaagctcttcaacttcctgcgcgatgagcagctgcgtgcggagtgggacatcctcagcaatggaggccccatgcaggagatgacccagatcgccaaggggcagcgggatgggaactcggtttcactcctcagggccagtgctgtgagtgccaaccagagcagcatgctgatacttcaggagacgtgcaccgacgcttctggctccattgttgtgtacgctccggtagacatcccggcaatgcagcttgtcatgaatggtggcgactccacctatgttgctctgcttccatccggattcgccatcctgcccgatgggcctcgcatcggcgccaccgggtacgagacgggcggctctctgctcaccgtggcgttccagattcttgtcaacaaccagcccaccgccaagctcaccgtggaatcggtcgagaccgtgaacaatctcatctcctgcaccatcaagaagatcaagacggcgctgcagtgcgacgcctgagtgtttacagtggatttatgtccgcggggatacgccggcggcgacgagcctgagtcaagaacgaaccgcgcgttgaaaaaagaaaataacctttgctaggtgataaggatcttgcttggccggtccttagcacagagcaatggtggtggttcgggtattgactctggcctctaccgtacgccgatctctccccggcagccggtgatcattggatgatacagtaccatgcattttggacatttcttcgaggggttaaacttatgctttagtttcgtcgtcttagggagtcaaacctgtatacttttggcagttggctcatcgttgctctagtgttgtttgttttttgttgtgctatggctgtatgaggtagcctgtactagtagtttctcggaaatgctgggttcatactgtactagtgtcgtccatacttcatataggttatggtacaagtgtaggatcaaattgaaggtctcagaaagtgtatcagccaataatgtctgtttgacagtggcattgctatggatcagctgaaaattgttttttgcaatacacatgggatcaaagct

SEQ ID NO: 5467 - DNA, 2487 bp, Oryza sativa
  Predicted polypeptide sequence is orthologous to G384, G385
atggaggtttgtgaaggcggcagcgacgatggcgggcgcggatctgggacctcggtggtggtggatctagtgctcgaaacctcagcgacaacggatctagtgcttgggacatcagtggcggcggagctggtgctgccggcttcgggagctgcaggacctctggcaatgatggcgaacgatgctcaggagctctgtgacaacgatgacggaggcaacaatgggctgcgggagagggagaggatgatgatccctggccggaacatgtcgccggcgatgatcggccggcccaacggcggcggcggcggcggcggcgtcgcctacgcttcttcttcctcggcgctctccctcggccaggcgacgacgacgagcgagagcgacggccgtgcccctcgcgacgagctggagatgagcaagtccggtggcagcgacaacctggagagcggcggtggcggtggcggaggtggctccggtggtgatcaggaccccaaccagcgcccccgcaagaagcgctaccaccgccacacccagcaccagatccaggagctcgaggccttcttcaaggagtgcccccaccctgatgacaagcagcgcaaggagctcagccgcgagctcggcctcgagcccctccaggtcaagttctggttccagaacaagcgcacccagatgaagacgcagcatgagagacacgagaacaatgcgctgcgcgcagagaacgagaagctgcgggcagagaacatgaggtacaaggaggcgcttgccaacgcgtcctgccccaactgcggcggtccggccgccatcggcgagatgtccttcgacgagcaccacctccgcctcgagaacgcgcgcctccgcgacgagattgacaggatctccgccatcgccgccaagtacgtcggcaagcccgccgcggccgtctcggccgcgtacccgccgctgccgccgtcgaacaggtcgccgctcgatcatatgggcattcccggcgctggcgccgacgtgttcggcgccgacttcgacaagccgctcgtcatcgagctcgccgtggccgccatggaggagctcgtcaggatggcgcagctcggcgagccgctctgggcgccggcgctcggcggcgaggcgctcggcgaggaggagtacgcgcgcacgttcccgcgcgggctagggcccaagtcgccggagctccggtcggaggcgtcgagggagacggcggtggtgatcatgaaccacgtcagcctcgtggagatgctcatggacgtcgggcagtggacggcgctcttctcgagcatcgtgtcgcgcgcggcgacgctggaggtgctctcgacgggcgtcgccggcaaccacaacggcgcgctgcagctcatgtccgccgagttccagatgccgtcgccgctggtgccgacgagggagacccagttcctgcgctactgcaagcagcaccccgacggcacgtgggccgtcgtcgacgtctccctcgacgggctccgcgccggcgccgggggcggatgccagccggcggcggcgcgcggccaccggcgccgcccctccggctgcctcatccaggagatgccgaacggctactccaaggtgacgtgggtggagcacgtggaggccgacgaccagatggtgcacaacctgtacaagccggtggtgaactccggcatggcgttcggcgctcgccggtgggtggcgacgctggagcggcagtgcgagcgcctggctagcgccatggcgagcaacgtggcgtcctcgggcgacgccggcgtgatcacgacgtcggaggggaggcggagcatgctgaagctggcggagcggatggtggcgagcttctgcggcggcgtgacggcgtcgacgacgcaccagtggacgacgctctccggcagcggcgccgaggacgtccgcgtcatgacgcgcaagagcgtcgacgaccccggccgccctcccggcatcatcctcaacgccgccacctccttctggctccccgtcccgccttcccgcgtcttcgacttcctccgcgacgactccacccgcagcgagtgggacatcctctccaatggcggcgtcgtccaagaaatggctcacatcgccaatggccgcgaccacggcaacgccgtctccctcctccgcgtcaacaacgcgaactcgaaccagagcaacatgctgatactgcaggagtgctgcacggacgcgacggggtcgtacgtgatatacgcgccggtggacgtggtggcgatgaacgtggtgctcaacggcggcgacccggactacgtggcgctgctgccgtcggggttcgccatcctccccgacgggccggacggcggcggcgggtcgctgctgacggtggcgttccagatactggtcgactccgtgcccaccgccaagctgtcgctcggctccgtcgccaccgtcaacagcctcatcgcctgcaccgtcgagcgcatcaaggccgccatcaccggcgacaacggcgtcgcgccgccatgcccacggtga

SEQ ID NO: 5468 - DNA, 2892 bp, Oryza sativa
  Predicted polypeptide sequence is orthologous to G386, G707
gatggcgcacatgcttggatgggccggcccgtcgctccacgcctcggatcaccactgtcttcgcccgcggcggcgcacgccgccgccggagcccctgccccctctcgggcggcgcggcggggaccggggctcaccgcggccatgcgctgttcttgctatccctctcgtcagtttgtgccctcaccctgatgatttccgtttcactagccttgcacttcttgtcttcttccactcaacaggttggcgctaggttttgccgattggggatgaactcgtgacgaaattgcaatgtggggctctctctcggtaatggattggagaagtgatgaacggcgagcttaaacttatggcttcctatgtgagcaagcttaagttcatcttgcaaaaagatcagcagcaggagccccatactgcgaaccttctagtcctacttgggagtagcaatcaggacaaaagaaatggcctctcacagggagaaaacagaatggacacttgtaccagaaagaagccaagaagataccaactcctcaccatgcaacaaaaagaaacgcttaatcgtgcatttcaatcatgtccgaaccctgatagaaatgacttgaagaagttggccaaggaactaaacatgactgagaccaaaatcaaatattggttccagaactgcaggacaaagatgaagaaattcaagaacaatgaggagcgcaaactactgcagaaggagaatgaggagctaaagaaggagaatgcagagttgagaaataggatgaagaactcaacatgccgcgcttgtgacctccctttgttccatatagattgccgtcattgggagaatccaatgctcaacaagggtaatcatggcgttacaagtaatctcattcctcaggcagtgtcatccttgctccccagctcaagtggttttgtagcttcaggctccaatcttagtagcaatgctgtgctcatgcccgtatctgccatgccatcatcagttttgcagcctgctccagccgtctctggtgccaattttcccatcttgcacaatctatctgccaatgcaaatgatggctatacggaaaaaaacgtacttcttgatctggcgaaccgtgcaatggaagagttctttagtctaatgaaggagaatgagtctcttcttgtcaaaaaaaaggagaatgggcctctctggctcccacacatggatattctgggagtcgaatcacttaactaccaggaataccttgcaaaatccaggacgattggacaaaaacctgttgacttcaaagtggtcgtcaccagggacactgccattgtcaatggtagctgtgttgacctcgtcaaaagccttttggatgctaaccgctggagagagttgtttccaggcatcgtggcaagtgcaaacaccaccaagatcatctctactgggccctctaacttgcacgacgggttgcttcaattgatgcgtgcagagctccaggtaatgtcacctgaagtcccagtttgcgatgtgacattcttgaggcagagtgtgcagtttggaagtggactgtggtgtgtggttgatgtgtctattgataccatccttcctggagagagtaaaacagctcagtccagtgtgcagaccagcagtacagctgccagacgcatggaagtcaggctgttgccatcaggctgtgttattgaagaaatggagaatggctattccaaggtgacctggatggtgcatgcagcttatgatgagagagcagtgccagtgctttatcattcacttctccgctctgcaaaagcccttggtgcgtgccgctgggtagcatcactccagagacacagccagttcctttccggcctgcacaaatacatcttttgtcctgacagcacaatgacagaagtggtgatgcgaagaaaagtcctgtacctggtgaagcagatgacgagcagcttcacaggcctatttgcgtcgatgtctaaggccacgctgcaagatggtgatgatactcacttcgcgcatcagatagttggtggtgcaacaggtgaacctgccggactgctgctgagcgccaccacaaccatatggctccccggcgtgaacccgaggcacgtgtatgaccacctgcgtgatgagcagtgccatggtgaatggcgctgcctcctcggtgagcagctgcatcagggcaatgccttgccgtatggtgcccccctgaatggtgagaccgtgccagagttctatcgcatggtgaacgggctgcatgaagggcatgctatctccctgatcagccccagagaaatgggtggtaacataagcaacactctgctcctgcaagaggcaagaactgatctttctggctccctcatagtttacgccaggacagatgtgaacaccgtgcattccatcatgaacagtggcctcaaccctgccaccgtcttcctcgtatcctctggatgtgccattcttcctgattgcctggaatcattccctctacacccagctgcaactgcagatcaggccggcacctccagtgccgctatcgctagcaggagcgaaaccggtgggtcattcgtcaccgtcacttaccagatgtttttcagcagccaaggtggcgcagcacctgccagctcatcaattcatcaaggccgtgatgcgctcaagaaagccaccgacattttcaaggtggtcctcgacactctcaccgtggcatagcgcaataccccaggggtagcatttgcatgcgaaagtgaaatccagatcgagttaaatttcagtgtttaagactatgttgtttctgttgttcaggggatggctttatctctgatagacccgtggatcatgctgtttaccttgtttaccattttcagactatcgatttgaaatgttgatcagacatttataataattggaactttgag

SEQ ID NO: 5469 - DNA, 2218 bp, Oryza sativa
  Predicted polypeptide sequence is orthologous to G386, G707
gattatagccattctctccagccaccctctcgcctcctcctcctctcatcatctcccatccttcctcctcctcaactcctctcctctcttcgcttcttctctcatgctagctactactactagcttctccttctcctgtcgcacggtgcggcggaagtggtagtagtagtagctttcttggtttaagcaaggatcggcgaggacggacgccggcggcgaccgagcttggggtgtgtgtgtgtaaagttgtcttctccggcggatgagctgttgtttcttggctcgcgcctccggcgtgtccggcttgttgccttccatgtccgcgacgctgcaataattcgcttccatatttgctgccgccatgccatgtatagccgcgctgctgatgcggccctccagccgttttaatgcgtgccaaatcctctccccgaggctcataaaaattattgaattgttgggatctgaggggatccgccggagttggtaggatcacggtggagtgattttggccggaggaagaagaagaaggagaaaaactggtgtttgttttgtcgtttgtagtgagctcgcgtgatgagcttcggtggcatgttcgatggcgccggctccggcgtcttctcctacgacgccggcggcggcggcggcggcggcggagtacacaactcccgcctcctccctacgccgcccgtccccaagcccggcggcgggttcgccgctcccggcctctctctcggcctgcaaactatggacggtagccagctcggcgacgtgaaccggtcgcttgccatgatgggcaacggcgggagcggcagcggcggcgacggcgactcgctccagcgacagtgccagtatctcgcatgctgaagctggcgcagcggatgacggacaacttctgcgcgggggtgtgcgcgtcggcggcgcagaagtggcggcgcctggacgagtggcgcggcgagggtgggggcggcggcggtggcggcggcggggacggggaggacaaggtgcggatgatggcgcggcacagcgtgggcgcgccgggggagccgccgggcgtcgtgctgagcgccaccacgtcggtgcggctccccggcacgctgccgcagcgcgtgttcgactacctccgcgacgagcagcggcgcggcgactgggacatccttgccaacggcgaggccatgcaggagatggaccacatcgccaagggccagcaccacggcaatgccgtctccctcctccgtccaaatgccacaagcgggaaccagaacaacatgctgatcctccaggagacgtgcaccgactcatcgggctccctcgtcgtctacgctccggtggacgtgcagtcgatgcacgtcgtcatgaacggcggcgactccgcctacgtctccctcctcccctccggcttcgccatcctccccgacggccacaacaatggcgcctcgccgtctccggcagaggtcggcagcggcgcctcgccgaactccgccgccggtggcggtggcggtagcaacaacaccgggtcgctggtgacggtggcgttccagatactcgtcaacaacctgccgacggcgaagctcaccgtggagtccgtcgacaccgtcagcaacctcctctcctgcaccatccagaagatcaagtcggcactgcaggccagcatcatctcaccatagataagtggacatttgacgtggattccgactcgaccatttttgagtcgagtcggatgccatctcaaatgtctaacttttgaaggttagaagactgagaggacttccgcggcgggcgatggccgaccgaaactggctgatggatgcaactcaatcgttgatcaggtagagttttcgagaggcgatatgcgagcgaggataaaaataaaattaagttatatatagtgtgtggagtatatttgcatagatgagcaaattaaatggggtgagttgcagagggatcaagtcaagaacgaaccttgcgctaggcttggctcaagctgatgtggtggttcgggtattgacttagtctctggtgaaaataaacccctagggctttgatctcctatatatatctagcagtttgcttaatttaaccattttgtgaagttttttttaattctccaaaatgggggaaatatagagaaacaatactgatcagatccccaagatcgttggtgtttgtttagtttgcataatgttggaatgagttgatatataaacatgtttattttggc

SEQ ID NO: 5470 - DNA, 663 bp, Oryza sativa
  Predicted polypeptide sequence is orthologous to G386, G707
gggtcgacccacgcgtcgagccgctccggctagcgacaactggacggcgcctccggcgacgaactcgacccggacaacagcaacccgcgcaagaagaagaagcgttatcaccgccacaccccggagcagatccaagaactcgaagccgtgttcaaggagtgtccacatcctgacgagaagcaacggatggagctcagccggcggctcaacctcgagagccgccaggtcaagttctggttccagaatcgccgcacccagatgaagacgcagatcgagcggcatgagaacgcgctgctgcggcaggagaacgacaagctgagggcggagaacatgacgatccgggaggcgatgaggaacccgatgtgcgcgagctgcggcggcgcggcggtgctcggcgaggtgtcgctggaggagcagcacctgcgcatcgagaacgcgcggctcaaggacgagctcgaccgcgtctgcgcgctcgccggcaagttcctcggccggccaatctcgagcatctcctccccgggcccgccgtcgctgcaggcgtgctccggcctcgagctcggcgtcggcagcaacggcgggttcgggctcggcgcgctcggggcctcggcggcgatgcagtccatccccgatctgatgggcggctcctcgggctgacgggggggc

SEQ ID NO: 5471 - DNA, 402 bp, Oryza sativa
  Predicted polypeptide sequence is orthologous to G388
aggaagaactaccacaggcacaccgccgaacaaatcaggatcatggaagcgctattcaaagagtccccacatccggatgagaggcagcggcagcaggtcagtaagcagctcggcctctctgcacgccaggtcaagttctggtttcagaaccgacgaactcagatcaaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgaggtttgtatgccgccgccgcgaagccgcgcc

SEQ ID NO: 5472 - DNA, 2340 bp, Oryza sativa
  Predicted polypeptide sequence is orthologous to G388
atggggaccaaccggccgcggccacgaaccaaggacttcttcgcagctccggcgctctccctcacactggcaggcgtgttcggccggaaaaatggacctgcggcgtcgggtggagacggggtggaggaaggcgacgaggaggtgcaggctgcaggcgaggcggcggtggagatcagcagcgagaacgcggggccggggtgtagacagtcccagtccggcggtggctccggggaagacggcggccatgacgacgacgacggagagggtagtaataagaagaggaggaggaagaactaccacaggcacaccgccgaacaaatcaggatcatggaagcgctattcaaagagtccccacatccggatgagaggcagcggcagcaggtcagtaagcagctcggcctctctgcacgccaggtcaagttctggtttcagaaccgacgaactcagatcaaggcggttcaggagcgacacgagaactcgctgctcaagtccgagctggagaagctccaggacgagcaccgcgcgatgagagagctcgccaagaagccatctcgctgcctaaactgcggcgtcgtggcaacctccagcgacgccgccgccgccgccacggcggcggacacccgtgaacagcggctgcgactcgagaaagccaagctcaaagctgagatagagaggctgcgagggacgccaggaaagtccgccgccgatggaatcgcctcgccgccgtgctccgcgtccgcgggcgccatgcagacgaacagcaggagcccgccgttgcacgaccacgacggcggcttcttacgccacgacgacgacaagccgaggatcttggagctggccacccgtgcgctggacgagctggttgggatgtgctcctccggcgagcctgtgtgggtgcggggcgtcgagaccggcagggacattctgaactacgacgagtacgtgcgcttgttccgccgcgaccacggtggttccggcgatcagatggccggctggacggttgaggcttccagggaatgtggactagtttaccttgacacgatgcatcttgtgcacactttcatggacgtggacaagtggaaggacctattccctaccatgatctcaaaggcagcgacgctggaaatgatcagcaaccgcgaagacgatggccgagacggcgtcctgcaactgatgtatgcagagcttcagacactgacaccaatggtgcccacgagggagttatacttcgcccgctactgcaagaagctggccgcggagagatgggcgatcgtcgacgtgtccttcgacgagtctgagactggcgtccacgcgtcgtcggcggtcaggtgctggaagaacccatccggctgcctcatcgaagagcagaacaacggccggtgcaagatgacctgggtggagcacaccagatgccgccggtgcacggtcgcgccgttgtaccgggcggtcaccgcgagcggcgtggcgttcggcgcgagacgctgggtggccgcgctccagctccagtgcgagaggatggtcttcgccgtggcgaccaacgttccaacgagggactcgaccggggtctccacgctcgcgggcaggaggagcgttctgaaactggcgcaccggatgacgtcgagcctctgccgcaccaccggtggatcgtgtgacatggcgtggcgcagggcgccgaaaggaggcagcggcggcggtggcgacgacgacatctggctgacgtcccgggagaacgccggcgacgaccctggcgagccgcaggggctgatcgcgtgcgccgcggcgtcgacgtggctgccggtgaatccgacggctctcctcgacttactgagggatgaatcacggcgaccagagtgggacgtgatgctacccggaaaatctgttcagagccgcgtgaatcttgcaaaggggaaggaccgtaccaactgcgccgctcgaccggaagaagaagaagagagaggcggcaagtgggtcctccaggacgtctgcaccaacccctgcgagtcgacgatcgcgtacgcggcgatcgacgccgccgcgctgcagccggtcatcgccgggcacgactcgagcggcgtgcacctcctgccgtgcggattcatctcggtgatgccggacgggctcgagtccaagccggcggtgatcacggcgtcgaggaggggaggcgaggcttcgggggccggatcgctggttaccgtggcgttccaggtcccggccagcccgtcggcggcggcggccacgctctcgccggactcggtggaggccgtgacggtcctggtctcctccactctgcgtaacatcaggaaagccttggggtgcgactcgtgcgaggaggaattctag

SEQ ID NO: 5473 - DNA, 739 bp, Oryza sativa
  Predicted polypeptide sequence is orthologous to G390, G391, G438
aaagatcaatcaaatagaagtcttgttcaagcttttaaacaacctttaataaggccagtcccttaaaaacggaaatgaaacagacatgtgaaacaatgaggatgcaaaggagccatttcaacaaaggtacaccaatgagctccttccacttcaacaaagcaaaaaaaaaaaaggaatctttcaaatagcaaagaaacaaaaaaaaactccttggaggaggatcacaacatgaactggatcagtagttcatccatttttttgtaggaagtaaacaaattcagctagagcatacaacatagttctgaattttcttacacgtcgtactatattatccccaaaattaagcatagtaagcacgtactaaacacatctatacagtaggtaggctcgggttaaagatgtaccagtggatagcaaacattctatatatgctacagagctcgcctatgtcactctttcatcctcttcttgtcaaacatttgtaggcttctgttttgggaaccaaaccttgatcttctgcttgggctcgatgttggcgaggatggataactcgcaaagtaactgctggcggcgagagaatctgggcttggggcactcggcgtacacccgctccagcgcctccacctgacccggcgtgtagtgcacgtacttgccggagtccatcccggccttgtcgtacccgctgccgtcactgccgctgccgctccgcatcgggcatcgccaccgctgccgccatcct

SEQ ID NO: 5474 - DNA, 737 bp, Oryza sativa
  Predicted polypeptide sequence is orthologous to G390, G391, G438
ctttttattacaggatacttccttgattatataaaggttgccctattatgcaagaaaggaagcaaaacaaataaatacatagacttgcaattcctaaatatagttgaagcagagtatgcacaaccaaggcaaacaattgaacactactattgctattgctccattgtcaaccaatttgtccagaacatttcacagccagacacacagaaggcaaaccagtttgatagtatatccctgcatgcttttgctcaccttctgttttgggaaccagaccttgatcttctgcttgggctcgatgttggcgactgctggcggcgacagaagctgggcttggggcactcggcgtacacccgctccagcgcctccacctgatccggcgtgtactgcacgtacttgccggagtccatcccggccttgtcgtacccgccgccgtcactgccgctgccgccatcctcctctccggccaccaccaccaccaaagtttcccccttcgccgcctcctcctctcctctccgtcaggggatgcgtcgacctcggcggcgacggtcatggtgttccgcgtagagaggagaggtcgagagttgagaggggaacagttgggaagctgcggaggagaggacggagaggcaacgcggcgacgggggaagacgtatggcagtcctgcgccggcggccggtccgacgccgccatgagggaagggcatcggcggcagacgcgcggccggctctgccgccaac

SEQ ID NO: 5475 - DNA, 3082 bp, Oryza sativa
  Predicted polypeptide sequence is orthologous to G390, G391, G438
ggcttcccctgtccaccactattaaaccaacccccaccccttctctctcctcctctaccgtccttcccttcttctctctcgctacctttcccttcccacctcctcctcctcctcctcaccaccaccacgcgcctccgctcgcaagaagcacctccgaccgccatggcgcgcgcgggagctggcggcagtctctccctggaggcatgacgcggcggcgcccgtggccgtggctcctgttgctactactgcgaccaactactgcgctcggtcggcggtggtggtggccctggtcgtcgtcgtagcgcgtcggcggaggcgggagaagaaggagaagggtcgacggggatggcggcggcgatggtggcggcggtgcatggagtggggaggcaggacaggtcgtcgcctggcggcggaggggcgccgcaagtggacacgggcaagtacgtgcgctacaccccggagcaggtggaggcgctggagcgggtctacggcgagtgccccaagcccagctcgctccgccgccagcagctcatccgcgagtgccccatactcagcaacatcgagcccaagcagatcaaggtctggttccagaaccgcaggtgccgcgagaagcagcgcaaggaggcatctcgcctgcaaactgtgaaccggaagttgactgcgatgaacaagctgttgatggaggagaatgacaggctgcagaagcaggtgtcccgcctcgtttacgagaacgggtacatgcggcagcagctccataatccttctgtggcaactacagacacgagctgtgagtctgtggttacaagtggtcaacaccaccaacagcaaaacccagcagccacgcgtccgcaaagggacgcgaacaacccagctggtctactcgctatagctgaggagaccttggcagagttcctgtcgaaagcgacgggtactgctgtcgattgggtgcaaatggttgggatgaagcctggtccggattccattggaatcatcgctgtttcgcacaattgtagtggcgtagcagcacgagcttgcggccttgtgagccttgagcccacaaaggttgctgagatccttaaggatcgcccatcttggtatcgcgattgccggtgtgtggatgtgctccatgttatccctacgggtaatggtggaactattgagcttatctacatgcagacttatgcaccgacaactttggcggcaccacgtgacttctggatactccgttacactagtggtcttgaggatggaagtcttgtgatctgtgagagatcattgactcaatccactggtggcccatcaggacctaacactccaaactttgtcagagccgaggtgcttcctagcggctatttgatccgcccatgtgaggggggtggttccatgattcacattgtggatcatgttgatttggatgcttggagtgtgcctgaggtccttagaccactttatgaatctcctaagatccttgcgcagaagatgacaattgctgcactgcgtcacattaggcaaattgcacatgaatcaagtggggaaatgccctatggagggggccgtcagccagcagttctgagaacatttagtcagaggctaagcagaggcttcaatgatgctgtcaatggattcccggatgatggctggtcactgatgagcagcgatggtgctgaggatgtgacaattgcttttaactcatctccaaacaagcttgttggatctcatgtcaactcctcccagctgttttctgcaattggaggcggcatcttgtgtgcaaaggcatctatgctgttacagaatgtaccacctgctctcctagtgcgatttttgagggagcaccgctctgaatgggctgatcctggtgttgatgcttattctgctgctgcgttgagggctagtccatatgcagttcctggtctgcgagctggtggttttatgggcagtcaggttatattgccacttgcgcacaccttagagcatgaagagttcctggaggtcattaggcttgagggacacagcctctgccatgatgaggtcgttctatcaagagatatgtaccttctgcagctgtgcagcggtgtagatgaaaatgctgcgggtgcatgtgcccagcttgtctttgcacccattgacgaatcttttgctgatgatgcaccactgctaccctcaggcttccgtgtgataccactggatggcaagacggatgcaccatctgcgacacgcacacttgacctggcatctactcttgaggttggatcgggtgggactacacgggcttctagtgacacctcgagcacctgcaacacaagatcggtcctgaccatagctttccaattctcatatgaaaaccaccttcgtgaaagcgtagcggcaatggccaggcagtatgtccggaccgtggtggcatcagtgcagagagtggccatggcaatagctccttcacgtcttggtggacagattgaaacaaagaaccctccaggatctcctgaggcccatacgcttgcaaggtggattgggaggagctaccgattccacactggagcggatctccttcgcacagactcacaaagcacggattcttccttgaaagcaatgtggcaacactctgattcaatcatgtgctgctccctgaaggctgctcctgtgttcaccttcgccaaccaagccggcctcgacatgctggagacgacgctgattgctctccaggacatctcgctcgagaagatccttgatgatgatggccggaaggcactatgtacagagttccccaagatcatgcagcagggtttcgcctacctcccgggcggcgtgtgcgtgtcgagcatggggcggccggtgtcgtacgagcaggcggtggcgtggaaggtcctgagcgacgacgacacgccgcactgcctcgccttcatgttcgtcaactggtcattcgtctgagaaccaccctagtagaatcgatcccccctcttgtttgtctgtcctaaagaccttatgtagtattgcttttgtgtatcatcaccatgaacatgtcaagaacctccccagtttctatcatcatgaacttccgtttgaatctagtactgctaaatgatct

SEQ ID NO: 5476 - DNA, 3227 bp, Oryza sativa
  Predicted polypeptide sequence is orthologous to G390, G391, G438
gctgctcctcctcctcctcctctctctctctctctctctctcccgtgctgtgattgctgcctcggggtgggcggtgcgagctacatacagcacaccggcggcggcggcggcggcggcgaggctccgggagaggtccagctaggcgtggtgggtggtggtttcttgatttcttgtgtttgggctgtgtcggcggcgggtgatggcggcggcggctccgtgcgccggagcgcggggcggctaggggcggctgtttctctgaggcgtctctcccccggcggcggcggtggaggtttgttgttgttgtgttgaaggcggagaagaggggaggctttggtggtggtggaggaggaggatggcggcggcggtggcgatgcggagcggcagcggcagcgacggcggcggcggcgggtacgacaaggccgggatggactccggcaagtacgtgcggtacacgccggagcaggtggaggcgctggagagggtgtacgccgagtgccccaagcccagctcctcccgccgccagcagctgctccgcgactgtcccatcctcgccaacatcgagcccaagcagatcaaggtctggttccagaacagaaggtgccgagataagcagcggaaggaggcatcaaggcttcaggccgtgaaccgaaaattgacggcgatgaataagcttctcatggaggagaatgagcgtcttcagaagcaggtctcccagctggtccatgagaacgcgtacatgaagcagcaacttcagaatccgtcattgggcaatgatacaagctgtgaatcaaatgtgaccactcttcagaaccctctgagagatgcaagtaacccgtctggactccttacaattgcggaggagaccctgacagagttcctctccaaggctacagggactgctgttgattgggtgccaatgcctgggatgaagcctggtccggattcgtttggtattgtggccgtttcacatggttgccgtggtgttgctgcccgtgcctgtggtttggtgaatctagaaccaacaaagatcgtggagatcttaaaagaccgcccatcttggttccgtgattgtcgaagtcttgaagtcttcacaatgtttccagctggaaatggtggcacgatcgaacttgtttacatgcagatgtatgctcctactactttggttcctgcacgagatttttggacacttagatacacaactacaatggaggatggcagccttgtggtctgtgagagatcattgagtggttctggaggtggtccaagtacagcctccgcacagcaatttgtaagagctgagatgcttactagcggctatctagtgcgcccatgcgagggtggtggctccatcgtgcatattgtggaccatctggatcttgaggcttggagtgttccagaagtgcttcggccactctacgagtcatctagggtagttgctcagaaaatgactactgcagcactacggcacatcagacaaattgctcaagagacaagcggggaggttgtatacgctttggggaggcaacctgctgttttgcggacatttagtcagaggttgagtagaggcttcaatgatgctataagtggtttcaatgatgatggttggtctgtcatgggtggggatggcattgaagatgtgatcattgcttgcaatgcaaggaaggttaggaatactagcacttcggccaatgcttttgtaactccaggaggtgttatatgtgctaaggcatccatgctactgcagagtgtcccacctgcagttttggttcgatttttgagggaacatcgttctgaatgggcggattataacttcgatgcatattcagcttcatctctgaagacaagctcatgttcacttcctgggttgcggcctatgagattttctgggagccagatcattatgccacttgctcacacggtggagaatgaggagattttagaagttgtccgtcttgaaggacaagcacttacacatgatgatggtcttatgtctagagatattcacctgcttcagctttgcactggaatagatgagaaatcaatgggatcctgcttccagcttgtctctgcaccaatcgatgagcttttccctgatgatgctcagttaatatcttcaggctttcgtgttataccgctgaacatgaaaacagatggtacacctgctggtagaacattagatttggcatctagccttgaagttggttcaactgcacagcccacaggggatgcatctatggatgactgtaatctacgatcagtgctgacaattgcctttcagttcccttatgaaatgcatctccaagacagcgttgcaactatggcccggcaatatgtccgcagtattgtttcctctgttcagagagtatcaatggctatttctccttctcggtctggcttgaatgctgggcagaagataatttcaggcttccctgaagccccaacgctagctcgttggatttgccaaagctaccagttccatttgggggtggagttacttaggcaggcagatgatgctggggaagcactattgaaaatgctatgggattacgaagacgctattttgtgctgttctttcaaggaaaagcctgtgtttacttttgccaacgagatgggactaaacatgctagaaacatctctcgtcgctctccaagatctctcactggacaagatatttgatgaagccggtaggaaggccctatacaacgagatcccgaaattgatggaacagggttacgtgtacctgcctggtggagtgtgcttgtccgggatggggcgccatgtttctttcgagcaagctgtagcatggaaggtgctcggagaagacaacaatgtgcactgcctcgccttctgcttcgtcaactggtccttcgtgtgacccaaaatccaatccaccatgctcgcagtcatcgtcgttgtcgtcagatctccattttttgcaatctctgtagaagagaggacaccaaaccaaccacaaacctgtcagctgttagctaatgattctactagcttttctagatctttgaaggcaaaatgctgccggtgcctgtaaagagtgtgtgcgtgcgtgtgtaaatttgggcgcgttttgcactaatttgatctggggtaaggaggcgctggctgctgctgtgctgtagtttggtaaaagttgagtacactaaccttggatggtctcgaactgtatgatgaaattcctagcagtaaaatttcaacttggatccgtgagg

SEQ ID NO: 5477 - DNA, 3252 bp, Oryza sativa
  Predicted polypeptide sequence is orthologous to G390, G391, G438
ctctctcccgtgctgctctcccttctcctctcctcaattaccacgccgcagccgcagccccccaaccctagctagtacggcgggcgacctgagggggtagctgcctacctctatacctgctatctccgttcgatccgggtcgggctcgtgctgctgggggcgggggcaatcaatcggcgagctcggtgatccatggccgtggctgtggggtggctgtgagggtgcccccggcggcgctcccctccgcgcctgccggcgagggggctcggactgaagggatctaggcgagctgaaaattgaagtgcaggcaaggagataagagcagcgtccaaattgtgagtacttcattagcaggaggtagtggttgtgcttgcttggctcctttgcaatttggctttggcgaggtagcaatggctgcggcagtggcaatgcgagggagtagcagtgatggaggtggctatgataaggtttccgggatggactccggtaaatatgtgcgctacacgcctgagcaggtggaggcgcttgagcgggtgtacgccgattgccccaagccaacctcctcccgcaggcagcaactgctgcgtgagtgccccatacttgctaacattgagcccaagcagatcaaggtctggttccagaacagaaggtgccgggataagcagcggaaggagtcttcacggcttcaggctgtcaacaggaaattgacggcaatgaacaagctacttatggaagagaatgagcgactccagaagcaggtctcccaattggttcatgagaatgcccacatgcgacagcagctgcagaatactccgctggcaaatgatacaagctgtgaatcaaatgtgactacccctcaaaaccctttaagggatgcaagtaacccctctgggctcctttcaattgcagaggagaccttgacagagttcctctcaaaggctactggtacagctattgattgggtccagatgcctgggatgaagcctggtccggattcggttggtattgtggccatttcacatggttgccgtggtgttgctgcccgtgcctgtggtttggtgaacctagaaccaacaaaagtggtagagatattgaaagatcgtccatcttggttccgtgattgtcgaaacctggaagtctttacaatgattccagcaggaaatggaggaacggttgaacttgtctacacacagttgtatgctccaacaactttagttcctgcacgagatttttggacgttacggtacacaaccacaatggaagatggcagtcttgtggtctgtgagagatctttaagtggttcagggggcggtccaagtgctgcctctgctcagcaatatgtgagagcggaaatgcttccaagtggatacctggttcgcccatgtgaaggtgggggatcaattgtgcacatagtggaccatctggatcttgaggcatggagtgttcctgaggtgcttcggccactctatgaatcttcaagggtagtcgctcagaaaatgactactgcggcactccggcacatcagacaaattgctcaagaaacaagtggggaagtggtgtatgccttggggaggcaaccagcagtgctacggacttttagtcaaaggctgagcagaggctttaacgatgccattagtggtttcaatgatgatgggtggtctataatgggcggagacggtgttgaagatgtagttattgcttgcaactcaactaagaaaattaggagtaacagcaatgctggcatcgcctttggagcccccggaggtattatatgtgctaaggcatcaatgttactgcagagtgttcctccagcagtactggttcgatttctgagggagcatagatctgaatgggccgattacaatattgatgcatatttggcttcaactctgaaaacaagtgcatgttcacttactgggttgcgacccatgagattttctgggagccaaatcatcattccacttgctcacacagttgagaatgaggagattcttgaagttgttcgccttgagggtcaacctcttactcatgatgaagctcttctttcaagggatatccacctgcttcagctctgcactggaatagacgagaagtctgtgggatcctcctttcagcttgtgtttgcaccgattgatgatttcccagatgaaactccattgatttcttctggcttccgtgttataccacttgatatgaaaacagatggtgcatcctctggtaggacattagatttggcatctagtcttgaagtaggttcagcaacagctcaagcctccggagatgcatctgcagatgattgtaacttgcgatctgttctgacgatcgcttttcaattcccttacgagttgcatctccaagacagtgttgcagctatggctcgccaatatgtccgtagcattgtttctgctgtgcaaagagtgtcaatggctatctctccctctcaaactggtctaaatgccggacagaggataatctctggtttccctgaagcagcaacccttgctcgatgggtttgccagagctaccattaccatctaggggtagagttacttagtcaatcagatggagatgcagaacaattgttgaagatgctatggcattaccaagatgctattttgtgctgctcattcaaggaaaaaccggtgtttacatttgccaacaaagcaggactggacatgctagaaacttcccttgtcgccttacaggacctcacattggacaggatctttgatgagcctggaaaagaagcattgttctcaaacattcccaaattgatggagcagggccatgtctacctgccatcaggcgtgtgcatgtcaggaatgggtcggcatgtttctttcgatcaggccgtggcttggaaagtgcttgccgaggatagcaatgttcactgcctggccttctgtttcgtcaactggtcctttgtgtgaccatcccacatccactgcgaagtgaagattcatttttgcttgttcaagactgttttgcactagatctagacctgagaatctagtagtatttgcgaaatttctcgcttatgtaaatgtaatctcgctcccattccatcaagtacccaagtacaaggcagtggccaagtggttttagttgtagggggatcggagcaatcctgacggttgggtacttgggttccttccagcaatgtaaaatcggatcctgtagggcgtcgaaaactgcattggcaagattcttcgaaatgcagaccaaatttagctagtacatcgtaactttggc

SEQ ID NO: 5478 - DNA, 3140 bp, Oryza sativa
  Predicted polypeptide sequence is orthologous to G390, G391, G438
ggaagaccagagagaagacgagaggcgatcgcagtggagtggagtgaagtactagcagtattaaaaccagcagcaagcgagagagaggccaccaaccacttcctcctccaagaaaccacccccaccacgagcacgagcacgagcaaccatggcggtggcagagggagctgcgactgcgagctacgggccatgactgcggcgagttcttgctgggttgttgttgtacaagcagcgacgaggaggaggggagcagaggaggaggaggcggagggatggcagcggcggcggtggggggaaggggggagaggctgtcgtcctcctccccgacggcggcggcgccgcaggtggacgccgggaagtacgtccggtacacgcccgagcaggtggaggcgctggagcgggtgtacaccgagtgccccaagcccagctcactccgccgccagcagctcatccgggagtgccccatcctcagcaacatcgagcccaagcagatcaaggtctggtttcagaatcgcagatgccgggagaagcagcgcaaggaggcctcccggctgcaaactgtgaaccggaagctgaatgcgatgaacaagctgttgatggaggaaaatgaccggctgcagaagcaggtgtcccgtctcgtctacgagaacggctacatgcggactcaactgcacaatccttctgcagccaccacagatacaagctgtgagtctgtggtgacaagtggtcagcaccatcaacagcaaaacccagcagttctgcatccgcaaagggatgcgaacaacccagcaggtcttctcgctattgctgaggagaccttggcagagttcatgtcgaaggcgacaggaactgctgtcgaatgggtgcaaatggttgggatgaagcctggtccggattccattggaatcatcactgtttcgcacaattgcagtggcgtagcagcacgagcttgcggcctggtgagccttgagcccacaaaggttgcagagatcctcaaggatcgcccctcttggtaccgtgattgccgatgcgtagatatcatccatgttatccctacgggtaacggcggaaccattgagctaatctacatgcagacacatgcaccgacaactttggcggcaccacgcgacttttggactctccgctacacaagtggacttgaagatgggagtcttgtgatctgtgaaaggtcattgactcagtccactggtggcccatctgggcctaacactctgaattttatcagagccgaggtacttcccagtggttatctgattcgaccatgtgagggaggtggctccatgatttacattgttgatcatgttgatttggatgcttggagtgtgcctgaggttcttcgaccgctctatgaatctccaaagatccttgcacagaagatgaccattgcagcattgcgacacattaggcaaattgcgcatgagtcaagcggtgaaatcccctacggtgctggtcgccagcccgctgttttcaggaccttcagtcaaaggctcagcagaggtttcaatgatgctgttagtggatttccagatgatgggtggtctttgttgagcagtgatggtagtgaggacattacaatttcagtaaactcgtctccaaacaagcttgttggatcccatgtcagcccgaaccctctgttttctactgttggaggtggcatcttgtgcgcaaaggcatcaatgctacttcagaatgtacctcctgctctacttgtgcgatttctgagggagcatcgttctgaatgggctgatcctggtgttgatgcttattctgctgcttctttgcgagccagcccatatgcagttccaggcttaaggaccagcgggtttatgggcagtcaggttatactacccctcgctcataccttagagcatgaagagttcttggaggttattaggctcgaaggacatggtttcagccatgatgaggtgcttctatcacgggatatgtaccttctacagctttgcagcggggttgatgagaatgctactagtgcatctgcacagcttgtctttgctcctattgacgaatcttttgctgatgatgcaccacttttaccctcaggattccgtgtgataccactagatacaaaaatggatgggccatctgcaacacgcacgctcgaccttgcatccgcccttgaggttggaccaggtggagcttcgcgtgcttcagttgaagcatctggcacatgtaacagatcagtcctgaccattgctttccaattctcatacgagaaccaccttcgtgagagcgtggcggcaatggctaggagttatgtcagagctgtgatggcatccgtgcagagggtggctgtggcaatagctccttctcgacttggaccccagatcggaatgaagcaccctccagcctctcctgaggcgcttacacttgctagctggattggtaggagctatagggctcacaccggagcagatatccgttggtctgataccgaagatgccgattctcccctggcgctcctgtggaagcacagcgacgcaatactgtgctgttctctgaagcctgctcctatgttcaccttcgccaacaatgccggcctcgacatccttgagacgacgctggtcaacctccaggacatctcgctcgagatgatcctggatgacgagggccggaaggcgctgtgctcggagttccccaagatcatgcagcagggtttcacctatctccctggaggcgtctgcaagtcgagcatggggcggcaggcatcgtatgagcaggcggtggcgtggaaggttcttagcgacgacgacgcgccgcactgcctcgccttcatgctcgtcaactggaccttcatgtgatccaccatccatggtttccagcttccagctagtgcttttgcttttgtgccattgtggcaaactgaacaaagacctgaataccaccaccgtattgtattaaacatatgcgtccatacatgcatggtgcttgctttatcctagctagtgctagcacctgtgtgtatggtctctccatgtttgaagcttaaaattttagaaccctggtttttttttttttctgctgctgtgtggatgaacaagtttcaggacctatgtatctctatctatctatgctaatgctatgaattgtgtgatgtgtgt

SEQ ID NO: 5479 - DNA, 2349 bp, Oryza sativa
  Predicted polypeptide sequence is orthologous to G390, G391, G438
gaacatctctctgcccaatcctcctcccggccaatccgccatccccatccccggccaatccatgcggcctcctcctcccggccgggggcaaggacggcgccggcgtttacaaagacgacggagcaaggggacgacaacattgccgccctccaccatgcctcctgtgctgccctcctctaccatgatggcctcctcgaccttgtggttgcgtccacggggggagggaggaggcggcacccgcccgagctgccgccggtgctcccctcctccttctccatccacttgtggtgacggcggcggcgggtggagggacgcccgctgaatccgccaccggttctccttccctccttgttctccctccacttaggccggcggcggcggtggtggcggggggagggcagatccggcgcccgacgccggcggatccgccgtcgtgccccctcccttcccttgtggcggcagtggcgagggtacctacgttggcggcagagccggctgcgcgtctgccgccgatgcccttccctcatggcggcgtcggaccggccgcctgcgcaggactgccgtacgtcttcccccgtcgccgcgttgcctctccgtcctctcctccgcagcttcccaaccgttcccctctcaactctcgacctctcctctctacgtggaacaccatgaccgtcgccgccgaggtcgacgcatcccctgacggagaggagaggaggaagcaagcttgcaatcgcacaaccatctatcgatttctcccttccttctctttcttctttctttctttcgtttccccctctcacatgtcaggttattttttctcctcatcctctccggatgatttcacttttgctcgaaatctctcaggttgttgttgtgttgaaggtggcgaagggggaaactttggtggtggtggtggccggagtggaggatggcggcagcggtggcgatgcccgatgcggagcggcagcggcagtgacggcagcgggtacgacaaggccgggatggactccggcaagtacgtgcactacacgccgggtcaggtggaggcgctggagcgggtgtacgccgagtgccccaagcccagattctctcgccgccagcagttactctgcgagttatccatcctcgccaacatcgagcccaagcagaagatcaaggtctggttcccaaaacagaaggtgagcaaaagcatgcagggatatactatcaaactggtttgccttttgtgtgtctggctgtgaaatgttctggacaaattggttgacaatggagcaatagcaatagtagtgttcaattgtttgccttggttgtgcatactctgcttcaactatatttaggaattgcaagtctatgtatttatttgttttgcttcctttcttgcataatggaacaacctttatataatcaaggaagaatactgtacttaccagagtatgtgccagattaagccatccattaattagatgctgaagtaaactatatgactatattgcgatgtattctaattccactacttacaaaactgtagggtataagatttgcttatttttagaagataggctaaacgagggtcatttaggtcacatggccaaactaagacacatatacataacgtattatcatgcatctgatagtaatgcaaaacaatgcagtactatttactttcactgcaggtatttaggctctatcttttatttttctcaagaggcacttaacatgatatacaaaatttgaagagttacattttttaaaaaacttctatgagttctgcctaaatgattgttatccatggtgtgcctaaataattgttcgatctagaggtgatccaaagattcgtctatattagacgtaacaataatgcagtgttttttttgtttattttttagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtacgacgtgtaagaaaattcagaactatgttgtatgctctagctgaatttgtttacttcctacaaaaaaatggatgaactactgatccagttcatgttgtgatcctcctccaaggagtttttttttgtttctttgctatctgaaagattccttttttttttttgctttgttgaagtggaaggagctcattggtgtacctttgttgaaatggctcctttgcatcctcattgtttcacatgtctgtttcatttccgtttttaagggactggccttattaaaggttgtttaaaagcttgaacg

SEQ ID NO: 5480 - DNA, 2914 bp, Oryza sativa
  Predicted polypeptide sequence is orthologous to G390, G391, G438
ggtccctcccgtcccccgtctcgccctctccctctccttctcccgcctcgcgtcgccgccgccgccgccgccccgcgcgccgcccctcctccctctccctcagccatcctcctcctccgccgccggtccattctccgcccttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcacggccgcggcgttcgcggcgtaggcggcgggggacgggtgcagcgccggatgcgagctcgcgctggcctcctcatcctcgagcgcctccaccccaatactttcttcgtcctcgcctcgtcgcgtcgctctgtcttctcccctccctgcctcttcggttgatgtcttcatttcttcccctttcgtgcgaatgggaccaacggcggatcaagcgagggcgccgcagatcgactggcggcacagcttctccccatcctttggtgctgcattgctggtatcatcgtcgtgtttcccgctgttggtgcgtgtctcacggagaaagaatggattggagtaaatcagcagcggtgtggattgtgctctgacctcggcaggggcggatacaagaacacagcgatgagatccggtgcggtttgtggcggaccaagcatgtcggccgatggagatggttctctgcatctacgcattccccaccaacatgccgcccttcagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattatccaaggcagtgacagcatgtattgacgaacgcaatgtgcttgctggccgaatagacatgaacacatatcactgagagggagtgaaacagtgttgacgagtagcctgcttttgggtgatagaaatagcattgtagtagggtggtaatagcaagaagccgaaaggtaaggatcaggctataacgttggggcattggcaactcaattaaaaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttggttgcgcagaagatatcgatggcggttgcctacaaagatacccgttctgtgatcacaggatggggaaggaagcttgcggctttgcatgctctgagccaaaaagctcaccacaggcttcaatgaagttctcaatgggcttgcggatgatggatggtccgtgatcgagagcgatggcatcgacgatgtttgcatctctgtcaattcatccaaagtgaccggttgcaatgcaacattcagcagtggactcactattgtcagtaccggtgttctttgtgccaaggcatccatgctgttgcaggatgtctctcctccatcactactgcaatttttgcgcgaacaccagtcacaatgggctgacggtgaaaccaaacttctgcaatttacccatgtctcgtcttggaggattcagtggtcaggtcatacttcctttagcacacacttttgaacctgcagagttcctggaagttatcaagctaggaaacaccagaaactaccaagatacactggtgcagatcgatcaccggcgacgagagacactctcactgaacgaagctacctagcttaattacctagctactcgatcgatcatcagtctagatatggcggctttgaacggtaaggtggtggtggcggtgatggtggtggcgatggtggtggcggcgccgggggcgtcggcggcgatcacgtgcgggcaggtggggtcggcgatcgcgccgtgcatctcgtacgtgacggggaggggcggcctcacccagggatgctgcaacggcgtcaaggggctgaacaacgccgcccgcaccaccgccgaccgccaggccgcctgccggtgcctcaagaccctcgccggcaccatcaagtctctcaacctcggcgccgccgccggcatccccggcaagtgcggcgtcaacgtcggcttccccatcagcctctccactgactgcagcaaggtcagctagatcgattaatcctgcttggaccgaccgatcgatatatcgatcgatgctggctcgcagttgatcaactagccaaaataatagctacagtaaaaataacagctggggcatatcaatgcagcgctggtcatctctctctctatctctgtatactttatgttgcacgctccgtgcgtgcatgctatcttaattttcttgactctgtacaccgctctgtgtacgtgtaatcctacgttgatgaattgcatcttgtccagacttggacctagctaactacgtactccagcttggcagcttcttgccgaggcaatctgtagtaatttccttgttacattcccctgtcccctctactccctctatcccataaaaacaaacctaatatact

SEQ ID NO: 5481 - DNA, 1149 bp, Oryza sativa
  Predicted polypeptide sequence is orthologous to G390, G391, G438
gtgctgacctcctctaccgtgatggcctcctcgaccttgtggttgcgtccacggggggagggaggaggcggcacccgcccgagctgccgccggtgctcccctcctccttctccatccacttgtggtgacggcggcggtggcggcggggggagggcagatccggcgcccgacgccggcggatccgccgtcgtgccccctcccttcccttgtggcggcagtggcgaaggtacctacgttggcggcagagccggccgcgcgtctgccgccgatgcccttccctcatggcggcgtcggaccggccgccggcgcaggactgccatacgtcttcccccgtcgccgcgttgcctctccgtcctctcctccgcagcttcccaactgttcccctctcaactctcgacctctcctctctacgcggaacaccatgaccgtcgccgccgaggtcgacgcatcccctgacggagaggagaggaggaggcaagcttgcaatcgcacaaccatctatcgatttctcccttccttctctttcttctttctttctttctttcgtttccccctctcacatgtcaggttattttttctcctcatcctctccggatgatttcacttttgctcgaaatctctcatgttgttgtgttgaaggcggcgaagggggaaactttggtggtggtggtggccggagaggaggatggcggcagcggcagtgacggcggcgggtacgacaaggccgggatggactccggcaagtacgtgcagtacacgccggatcaggtggaggcgctggagcgggtgtacgccgagtgccccaagcccagcttctgtcgccgccagcagtcgccaacatcgagcccaagcagaagatcaaggtctggttcccaaaacagaagcctacaaatgtttgacaagaagaggatgaaagagtgacataggcgagctctgtagcatatatagaatgtttgctatccactggtacatctttaacccgagcctacctactgtatagatgtgtttagtacgtgcttactatgcttaattttggggataatatagtgcgacgtgtaagaaaattcagaactatgttgtatgctctagctgaatttgtttacttcctacaaaaaaaatggatgaactactgatccagttcatgttgtg

SEQ ID NO: 5482 - DNA, 4658 bp, Oryza sativa
  Predicted polypeptide sequence is orthologous to G390, G391, G438
agtccctcccgtcccccgtctcgccctctccctctccttctcccgcctcgcgtcgccgccgccgccgccgccccgcgcgccgcccctcctccctctccctcagccatcctcctcctccgccgccggtccattctccgcctttcaccgcctccgttgccggccaccactgcccccgtccacgcctcgcgtcgccgcccccatccccgtccccgccccgtcgctagggtttcgtcacgagcgacctcccgccgtggaagcttccaccttcctcctcatccttgtcctcacggccgcggcgttcgcggcgtaggcggcgggggacgggtgcagcgccggatgcgagctcgcgctggcctcctcatcctcgagcgcctccaccccaatactttcttcgtcctcgcctcgtcgcgtcgctctgtcttctcccctccctgcctcttcggttgatgtcttcatttcttcccctttcgtgcgaatgggaccaacggcggatcaagcgagggcgccgcagatcgactggcggcacagcttctccccatcctttggtgctgcattgctggtatcatcgtcgtgtttcccgctgttggtgcgtgtctcacggagaaagaatggattggagtaaatcagcagcggtgtggattgtgctctgacctcggcaggggcggatacaagaacacagcgatgagatccggtgcggtttgtggcggaccaagcatgccggccgatggagatggttctctgcatctacgcattccccaccaacatgccgcccttcagtgattgttggggccaaacctatggtggctagtcgctgaggtggtgtcattaatggaggcaaagagtggcaagtggtgaccaaagcggaaggacctggtgtgttgcgcgtgcgccggccactggcggtgcgaggccacggcgacggtcatgctgccattatccaagtatggctgctgaccaatttcttccctgaagtaggtgagggcagtgacagcatgtattgacgaacgcaatgtgcttgctggccgaatagacatgaacacatatcactgagagggagtgaaacagtgttgacgagtagcctgcttttgggtgatagaaatagcattgtagtagggtggtaatagcaagaagccgaaaggtaaggatcaggctataacgttggggcattggcaactcaattaaaaggtaagtatctattggtcacagagcttgacaactttgaatctttgatgatcgtattgtaccattgtttcagttgtagtggccattgttcctgttaaatgcaagttgatactaataaacccattgaatagaggccttcatataattcaatgtttaagagaaaccaaccgtggactggagctctcagattagtttattcaagccacttttttctagcatgcaattatttcgtggcttattgcattccctataattttcattgacttagaggaggtttggggctttttatttttaatgaggtgcaacaatctgtccatctcactcgttggtgcaattacattttttgcttgattttcttcactgctttatgacgactgagataaaaacttatctgtgcagcttcatgtttctgatgcaggggtagggtagttgtctggttgttcatgttctgatttaactcattagtgttgtgctaaatggaaggtcaagctgctctacatgcaggcaagaacagacaagcctgaaaatttttgtggcaaattcttagctcaacctgaaattccgaagctgaaatctgtattcagtcttcaactctatgctccgacgacgctggcgccggctcacgacttctggctgctgcggtacacctccattctcggtgatggaagcttagtggtgtgtgagagatcactcagtagcaagcaaggaggcccaagcatgccacttgtccagccttttatcagagatgagatgcttcccagtgggttcttgatccgacctagcgatggtggaggcagcgtgatacacatcgttgatcatatggacctggagccttggagcgtgcctgaagttgtgcgacctctgtatgaatcttctgccttgattgcgcagaagatatcgatggcggtacagtaattatagtaccctgttcttgatgttcttgttgatttgtaaaaattattgcctaattcagtcatgcaaaattcagtctttacgctgcctgaggcaggttgcctacaaagatacccgttctgtgatcacaggatggggaaggaagcttgcggctttgcatgctctgagccaaaaagctcaccacaggcttcaatgaagttctcaatgggcttgcggatgatggatggtccgtgatcgagagcgatggcatcgacgatgtttgcatctctgtcaattcatccaaagtgaccggttgcaatgcaacattcagcagtggactcactattgtcagtaccggtgttctttgtgccaaggcatccatgctgttgcaggatgtctctcctccatcactactgcaatttttgcgcgaacaccagtcacaatgggctgacgatgaaaccaaacttctgcaatttacccatgtctcgtcttggaggattcagtggtcaggtcatacttcctttagcacacacttttgaacctgcagaggtaagtccatcttctactgtctgtcggttacaaaaaaggtcctgtccaattctgttttcctgctcgatgttttggtgcaaccatctactgtttcagttcctggaagttatcaagctaggaaacaccagaaactaccaagatacactggtgcaccgtgatctgttcctcttgcagatgtacaatggagtagaggagagcagtgcaggaacatgttcagagctaatctttgcacccatcgatgcatcgttcagtgatgattctccgctgctgccttccggtttctacatcatccctatcgattctcctctgacacatctagctcgaactgcatgctagatctcgcttccatgctcgaagcagcgacgccatggagcaggatcagcggcatcaatagcagcggcgagctccaaggcggtgatgacgatcgcgttccagttcgcgttcgagagccacctgcagggcagcgtgcccgccatggcgcagcagtacatgtgcagcatcatctcatcggtgcagaggattgccgtggtgctctcatcctcccgcctcgtccctcccggcgttgccgccgccacgcagcacgcgccggcgactcggtgctgcccagatggatttgccagagctatagatttcattttggagctgaactcatcaaatctgcagatgccaacagcagcagtgaatcggttctgaaagcagttggcatcatcccagtgccatactctactgctctctcaaggcttcttcagcctctatttttctttttctgattaagatacagattttacctagatttttataaattcgtttttttaaactgttgaactgtatatttcgaacgaaaaaaatttatatagaagctttaattataagataaatctatttttcaattttaaaataattaaaccttaattagtgagatgttaatgattttctcgttttacctgtccgaacttaatcttttatcttaaactcgaatggggccagtactcaatactgttatgcatggaggattgtttgttatctcaatttatttcagggacttttgaatcttttgtgcagcttgactgaaattttgttgacacaaattcaccttaaagttgacagtgttgcacaccattaaccatttgatttttcatgtaggtgatgccagtgttcacgtttgcaaaccgaagacggaggcggcgccaggcacaagatggcggaggaggtgaacaaatctatgatcatcaggaaaatcaatcaaatttatgttacctaatctatccaacaagtgaacaaattggaggcagctaagactacataagaaattgaaaagcacggccatactcttttgactaagtttcgaagtcaggcttgcaaggatagactaaagctcttatatcagtctttcttctcttagcaaattctcattgctagatctcagatcatcttgcaaacctcttatatcatttatatcattttccatatgcaaatctgtggttcatctctaaattgtaatgactgggtaagctctctggtcctcccatgtccttgacaataacagtaatatccttcaacttttcaacttatcttcattctcacaggtaagtcttgtaattcatcttctatttgtgctagccttgatgttaagtctgcatttataacggtactctcttgagtttctaaactaacttcatcaatggattatttgacaggtgatgcctggtaagtcttgtaattcatcacaggtaagtcttgtaattcatcttctatttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaact

SEQ ID NO: 5483 - DNA, 842 bp, Oryza sativa
  Predicted polypeptide sequence is orthologous to G394
aaacaaatcaatatacattgatatataatatttctgaaacaaatcaatataatacatggatcacgtacagagtacagtatatatatgtgtgtgagctagctagctagctaggtgtcatgtcgtcgtcatctaactacaacactcttaactcccctgacaataaaattcatcaccagtaagtgaccatctatagctagatgcaagcaaaaccaacaacttgaattaaaattttgtttgatttctggatcgatcctagatgcggccggcagtgctcagtccatcctcctcacacattaattaacttgtgaaaaaatgaagctaactaattaaagcagagggggtgaacatatgcatgagagagccagctgatcgatgagctaactagctatagccatatatatttactactagatgcaagcatgcatgcaagaattaatatatgtactactataaactatatatatgtacactacacactgatatgatgattaattaattaatcatgctagcatgcatatgcagggagaggatgatgatcgagattaatttagctagcaggcggcggacttggcgaaagggctgaacaagtgcggggcggtgggcttgttggtgcggtcggcggcggcggtgggggaagctccggcggcggcggcggtggcgaggcgctcgcaggaggggcagatggagagcgtggcggcggggacggggagggtggtggccatgaagaagccggcggcggtggagtgggtcagagccctgagctgctggagctcacgatggaggcgtcggttctcctccgtcagcgtctcgcagcagcgcttcagaagctcgcaatccacctc

SEQ ID NO: 5484 - DNA, 952 bp, Oryza sativa
  Predicted polypeptide sequence is orthologous to G394
tatctaattattgactaatatattaattaatataatgtaatttatataggaggtagtataacctaggcatcccgtttgcaagcatgcatatatatacaagacagacagacatattacacatggagtagtagtagttgaagaagaatatgcatgataattaatatagagaagctcgatcggtcaagtgcaggacgaagctgaagcagacggaggtggattgcgagcttctgaagcgctgctgcgagacgctgacggaggagaaccgacgcctccatcgtgagctccagcagctcagggctctgacccactccgccgccgccgaccgcaccaacaagcccaccgccccgcacttgttcagccctttcgccaagtccgccgcctgctagctaaattaatctcgatcatcatcctctccctgcatatgcatgctagcatgattaattaattaatcatcatatcagtgtgtagtgtacatatatatagtttatagtagtacatatattaattcttgcatgcatgcttgcatctagtagtaaatatatatggctatagctagttagctcatcgatcagctggctctctcatgcatatgttcaccccctctgctttaattagttagcttcattttttcacaagttaattaatgtgtgaggaggatggactgagcactgccggccgcatctaggatcgatccagaaatcaaacaaaattttaattcaagttgttggttttgcttgcatctagctatagatggtcacttactggtgatgaattttattgtcaggggagttaagagtgttgtagttagatgacgacgacatgacacctagctagctagctagctcacacacatatatatactgtactctgtacgtgatccatgtattatattgatttgtttcagaaatattatatatcaatgtatattgatttgtttaattcttcagagatt

SEQ ID NO: 5485 - DNA, 879 bp, Oryza sativa
  Predicted polypeptide sequence is orthologous to G394
atggctcaggaggacgtcggtcacctgagcgacgccggcctggcgctgggcctgtccctcggcgggggaggaggagggacgaccgacgcggcggcggcgcaccgtggcggctgccggcggccgtcgccgtcgtcgcagtgcccgccgctggagccgtcgctgaccctgagcttgcccgacgacgcggcggccggcgcggccgcgaccgcgaccgcgaccgcgtccggcgggggcggccctgcgcacagcgtgtcgtcgctgtccgtcggcgcggcggcggcggcggccgtgaagagggagcgcgcggaggaggccgacggcgagagggtgtcgtcgacggcggccgggcgtgacgacgacgacgacgggagcacccgcaagaagctccggctgaccaaggagcagtccgcgctcctggaggaccgcttccgggagcacagcacgctcaacccgaagcagaaagtcgctttagcgaagcaactgaacctcaggccaaggcaggtggaggtctggttccaaaacagaagagcaaggacaaagctgaagcagacggaggtggactgcgagttcctgaagcgctgctgcgagacgctcaccgaggagaaccgtcggctgcagcgcgagctgcaggagctccgcgcgctcaagttcgccccgccgccgccgtcctcggcggcccaccagccgtcgccggcgccaccggcgccgttctacatgcaactcccggccgccacgctcaccatctgcccgtcctgcgagcgcgtcggcgggcccgcgtccgccgccaaggtcgtcgccgccgacgggaccaaggccggccccggccggaccaccacccaccacttcttcaaccccttcacccactccgccgcctgctga

SEQ ID NO: 5486 - DNA, 1201 bp, Oryza sativa
  Predicted polypeptide sequence is orthologous to G409
ggcacgaggctcctcgaagaggagtactaccgagcagctcccggagaagaagcggcgcctcacgccggagcaggtagatactccagctagctagctaagctgtaaagatcggcggcgcgcggtgctctgttcccgagttgtgacgtgacgactggatcgatcggcgtcggcgtgtgtgtatgtatgtgcatctgctggagaggagcttcgaggaggagaaacaagctggagccggagcggaagacggagctggcgcggaagctatggctgcagccgcggcaggtcgccgtgtggttccagaaccgccgcgcgcgctggaagaccaagcagctcgagcgcgacttcgaccgcctcaaggcgtcgttcgacgccctccgcgccgaacacgaagccctcctccaggaaaaccaccgcctccactctcaggtgagctagctacgcccgccgcccgcgccaccgcccaaccgcgcgttatcctcgatccgatttggccgggctccttgattctgactgaattcgtggtgatcttgtgccgtcaggtcatgttctttgaacgaaaaactgccagaaaaagaaacaacaaccgaaggcacccccggcgccggccgtaaacgtccccgggctgccctgcgggcgccgaattgaagttccccgtcccggaacgccggaggacaccgggcgttggaggaggcggcggcggctttcgaggagcagcaggagcagcaggtgaaggccgaggacaggctgagcacggggcagcggcgggagcgcggtggtggacacggacgcgcaactggtggtcgggtgcggccggcagcatctcgccgccgtggacagcagcggggagtcgtacttcccgggcggggacgagtaccacgactgcgtgatgggccccatggaccacgccgcggggggcatccagtcggaggaggacgacggcgccggcagcgacgagggctgcagataatacgccgaagacgccggcgtctttttcgcggaccacggccaccaccaccaccaccaacacgcggacgacgacgaggaggacgggccagcagatcagctgctggtggatgtggaactagatttctcgcgcgcgcgcgtcgtcgtgcattcaattctcgtgttaaaaaaaatcgttctctttttcatttttcaaaaaaaaggggggcccggcacccaatccctcccctcccccccc

SEQ ID NO: 5487 - DNA, 1269 bp, Oryza sativa
  Predicted polypeptide sequence is orthologous to G409
tcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggtaaacagagatccaatagagatcgtcgtcgtctccgtctcaggcgagtgacgcgtgttataacgcaggcgtgccggcggcggtgctggggatggatgaatcgcggtcgtcgtcgtcggcggcgggggcgggggcgaagcggccgttcttcacgacgcacgaggaactcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccgaccaccatgccctcctctccgacaacgaccgcctccgcgcgcaggtctcccactgatttttttcacccttctcaattaattaattaccgcagttaatttcttgtgatcgaaggaccgctcttttaaaattcgaacaagttcgggggcttcggtgcaaaatggtagtaccgtagtttaattttgtaaaaatagccccccccccccccccttttgtaaaaatacaaccgcacttgtaaaataagattccactttttggcgccttttcattggatagcgaccagcggcgacccacaactcgatgcgtttttttaagtttttttttaaatcaaactttttaaacagtggttaggaatctaacgaacatatttatgctcgtttcccaaagtctaagcaccgctaatctaagcagcacatgcatatttctcttaattttttttagaatatcctgacgactagatgtactctttgttttgttttttctcagctcgtgtaatcacgtgaattcatatggttgctccgtttcacagttggctactgcttcagccgcggtcaaattttgaaatttagagcttatttttagaattaatttagagattgtttcgtctttgtcagccttcagccttggcttttaaacgctaaaactattttttttcagcgtaggtcaagtgccttttaacttgtaacccac

SEQ ID NO: 5488 - DNA, 1854 bp, Oryza sativa
  Predicted polypeptide sequence is orthologous to G409
gagcaacaaaattcagaagtcaaaaaaatcccaaaaacaaaaaataataaaaaaaaagaaagagagagacatttcgcatctgctgccctgcctcctctcccatcacctgcccattttttcacattgaggcccctctgaagatattatatttacaactaggtccctggccgggccggccggccaccggaaggagcacctcgccggagaaggctttgtctcttctttttcttctcctcctcctcctccatcggcggcggcatggggttctcgctgtaccccatgaagacgtcgacgcgcatgctgtggagcaccagcttcttccgccataaggtcgcctcctccttctaagcccacgccctctcgggcggcggcggcgagccggcggcggagcgcgcggttggtaggtgcgcgtgcgtgcgtgaacgggagagcagcttcgagatcgggttttcttgggttcttggagaagggaggagaagagggggaggagagcatggatcccggccgcgtcgtgttcgactccggcgtggcgcggcgggcgtgccccggcggcgcgcagatgcttctcttcggcggcggcggcagcgccaacagcggcggcttcttccgaggcgtgccggcggcggtgctggggatggatgaatcgggtcgtcgtcgtcggcggcgggggcgggggcgaagcggccgttcttcacgacgcacgaggagctcctggaggaggagtactacgacgagcaggcgccggagaagaagcggcggctgacggcggagcaggtgcagatgctggagcggagcttcgaggaggagaacaagctggagccggagcggaagacggagctcgcccgccgcctcggcatggccccccggcaggtcgccgtctggttccagaaccgccgcgcccgctggaagaccaagcagctcgagcacgacttcgaccgcctcaaggccgcctacgacgccctcgccgccgaccaccatgccctcctctccgacaacgaccgcctccgcgcgcaggtaatctcattaaccgagaagctgcaagacaaggagacgtcgccgtcgtcggcgaccatcaccaccgcggcgcaggaggtcgaccagccggacgaacacacggaggccgcgtcaaccaccggcttcgccaccgtcgacggcgcattggcggcgccaccgcccggccaccagcagccgccgcataaagatgatcttgtgagcagcggcggcaccaacgacgacggcgatggcggcgcggccgtggtggtcttcgacgtcaccgagggcgccaacgaccgcctcagctgcgagtcggcgtacttcgccgacgccgcggaggcgtacgagcgcgactgcgccgggcactacgccctctcgtcggaggaggaggacggcggcgcggtcagcgacgagggctgcagcttcgacctccccgacgccgccgccgccgccgccgccatgttcggcgccgccggagttgtgcaccacgacgccgcggacgacgaggaggcgcagctcggcagctggaccgcctggttctggagctgatcgatggaagcatggagcattggagccatgctatcaatgaatgaatgaatcaaatgaccttgagaccctcctctccgtcctttcttttgccctatttttaatcgctgttatatgttaattatgtgcaattaaagtgtacgtgttttgtcgtaagttgtgtttgttcaaattgtatgttttgaaggtgtcatgtattcatacacgatatgatatatagacgggatcatgaatgatactcggaaagattggaataattccatgtagtgttgagcaataataaacattttcctccgataagatgtttttatgatt

SEQ ID NO: 5489 - DNA, 1710 bp, Oryza sativa
  Predicted polypeptide sequence is orthologous to G409
tttagcttcagagccctccaaaagaaaaaaatattataggaaataaaaaataatttcctggttagaataaacacatttttaaaaaaaccaagaaaagattttcctcttctgttacattccttcttccttctccggccaccggagccgtagccgaattgtgcctcttctccggcgaggggagagggagagagggggtgtgagttttgctccttccggcgagtggtctcctccccgcgcggctgaggagatctctcgggacatcggggttggggcggcgtgcatgatggggttctcgctcacgccgatgaagatctccacgaggcttctgtggagcaccagcttcttccgccacaagatcgccgccaccatcgcgtcctcctcctccttcttataagatcatcttctccgccacagcaatctgtaaatatatacacatcgaacgcgacaagcgcgtttgattgattggatttttctcccctctcctcacgacaagtaattaaggcgcgcgatctcgatctctagcgttgagaacttgatccgcgatggagtccggccggctcatcttcagcacggcgggctccggcgccgggcagatgctcttcttggactgcggcgctggcggcggcggcgtcggcggcggggccatgttccatcgaggggcgagaccggtgctcggcatggaggaaggagggcgcggcgtcaagcggcccttcttcaccacccccgacgagctcctcgaagaggagtactacgacgagcagctcccggagaagaagcggcgcctcacgccggagcaggtgcatctgctggagaggagcttcgaggaggagaacaagctggagccggagcggaagacggagctggcgcggaagctagggctgcagccgcggcaggtcgccgtgtggttccagaaccgccgcgcgcgctggaagaccaagcagctcgagcgcgacttcgaccgcctcaaggcgtcgttcgacgccctccgcgccgaccacgacgccctcctccaggacaaccaccgcctccactctcaggtcatgtcgttgaccgagaagctgcaagagaaggagacgacgaccgagggcagcgccggcgcggccgttgacgtcccgggcttgcctgcggcggccgacgtgaaggtcgccgtcccggacgccgaggaaccggcgctggaggaggcggcggcggcgttcgaggagcagcaggagcagcaggtgaaggccgaggacaggctgagcacgggcagcggcgggagcgcggtggtggacacggacgcgcaactggtggtcgggtgcggccggcagcatctcgccgccgtggacagcagcgtggagtcgtacttcccgggcggcgacgagtaccacgactgcgtgatgggccccatggaccacgccgcggggggcatccagtcggaggaggacgacggcgccggcagcgacgagggctgcagctactacgccgacgacgccggcgtcctcttcgccgaccacggccaccaccaccaccaccaacacgcggacgacgacgaggaggacggccagcagatcagctgctggtggatgtggaactagatttctcgcgcgcgcgcgtcgtcgtgcattcaattctcgtgttaaaaaaatcgttctctttttcatttttccgcttctttgtctgtaatgttgagtttcgatcggctatgagaaggaaggaggtgtatgcatgtgc

SEQ ID NO: 5490 - DNA, 1710 bp, Oryza sativa; identical to SEQ ID NO: 5489
  Predicted polypeptide sequence is orthologous to G409

SEQ ID NO: 5491 - DNA, 2601 bp, Oryza sativa
  Predicted polypeptide sequence is orthologous to G416
gaaggtttcccccaactcaactcccctccccttcgcttcccttcccttctctcctctcctctcctctcctcttctcccccccaaattcgccgccgcctcctctccccctctcctcctacccttccccgcggcggcggcgagaggcggcgcggtgcgtcccctcccctcccccgcactctgctggtgctggtgctgggctgccgttgggggaggcgggagatccgcccgggcccggggttccgtttcctcctcctgctcggtctcaacctgttgtaatactatccatcaccagcaatgaataccccagaaaagaaaccactgtgctatacttctagaagagcactgcaacagaggacagaatcctcttcggaattgatctctgtatcaaaaagagcaacccgccagaatactccacgcaagccggattctcctcccaaacgaacaacaagaagtagcgctaacctggcgaaatgtatagagaacaaacaccatagcagtcctctgaagcggcggcggggttcagatgcggctaccggaaagtctgcaacagggccaacaaggaggaagcataaacagaaaaggaaaaatgatgagagtgatgaggtcagtcgcatggaaaaaagagcaagatatttacttatcaaaataaaacaggagcagaatttgctagatgcatactctggagatggttggaatgggcacagtcgagagaaaataaagccagagaaggagctacagcgtgctaagaaacagatcatgaaatacaaaatcgctatccgtgacgtcattcaccaacttgatttgtgtagttccagtgggagcaaggatgactctgtgattccaccagatgggtgtcacgagtctgtcaatcctgaacatacaatatgttcaaggtgcaaatcccacgagtcatttcctgacaataacattatattctgtgaggggggctgcaaactggcgtgtcatcagaaatgtttggagcctccttttgataaaattcttccaactacccgccatgggcggctttgcaaacactgttcttccaagatgaaaattttagacgccattaatgcccatctggggacaagttttacagtgaagtgtccctccagtgatattttcaaggaagcagctgaacatttcaactctgatgatggactgggccaagattggctatctgagtattcaggtgatgaggactatgaccctgaagaaaatgaggccagcagcagtggtgaagagaataaatctgccgattccaattgttcagggagtccactttattctccaaatgatgatattccagacttcatatcagcagatttcaatgatgctgaaggattctgtcgtgaaagttcaaatctaggaatcgattttggtgaagatggtttggctgagattcttacccaccaaaggccaagaagagatgttgactatacacaacttaatgagcaaatgtttggagagcctattggcaatgacgaacagagtgaagatgaagattggggtcttaacaagagaaagaaaagaagaactggttcaactggtgttgggactaattccgtagagggtcgatcagatgtcaaatccaataagaaagcccaacctcggagaaaacttttcaggattcctcctgcggcagttgaggtgctccgtaaagcttttgctgaaaatgagcttcctgcccggagtgtcaaagaaaatctctcaacagagctgggtatttcttttgaaaagattgataagtggttcaaaaatacacggtgtgctgctctcagggataggaagggtgaaagtcgttattctggtcccagcaaaaggtcaagaacaagcatagaaaaggctgaaacttcagctaaagtggatcaaatggacaactcatgctttcttcccttatctgaaataatcaacgtgcccacacgtctgcagaaaggtcttgataagaagccaaaatcaattaacagccctccaagacctcaggacaatgaaacttgcttgtcgccaactgataaaaccaaggagggtacaccgcctacgatcaagccttccatcacagattctagtcaactgatgaataacaacatcggcactgaggagactgctgtttcttgggtggacacttgggcctctgacgctctgcatttcttggacgtgagcgatgatgaacatttcttcgatgtgatcgagaaggtgtgcggtctcgagaatcggctgcagcggttgaaggagaacatgctatcatcgtcatcgtcaactgacaacaatgtggctgctgagagtggcttgcaaaacgaagttgtgcttgtaccagctgctgagctcaaggataaagcatcttaaccttgcatctgggtcccaatgctttgcttcagttgaccatttgctcataggattttatacatcagaaaatagtacaggaggggctggagtgtagcttgccccgtttatctttgaacttatataccggtgaactggtaccattctatatagggagggacagataattcggattaggttcgtgaggatttgcaaagagttagtttaactgtaatctttcagctggaactttgttcagcgagtaataggtcatggacaattacc

SEQ ID NO: 5492 - DNA, 2342 bp, Oryza sativa
  Predicted polypeptide sequence is orthologous to G416
gtctcaacctgttgtaatactatccatcaccagcaatgaataccccagaaaagaaaccactgtgctatacttctagaagagcactgcaacagaggacagaatcctcttcggaattgatctctgtatcaaaaagagcaacccgccagaatactccacgcaagccggattctcctcccaaacgaacaacaagaagtagcgctaacctggcgaaatgtatagagaacaaacaccatagcagtcctctgaagcggcggcggggttcagatgcggctaccggaaagtctgcaacagggccaacaaggaggaagcataaacagaaaaggaaaaatgatgagagtgatgaggtcagtcgcatggaaaaaagagcaagatatttacttatcaaaataaaacaggagcagaatttgctagatgcatactctggagatggttggaatgggcacagtcgagagaaaataaagccagagaaggagctacagcgtgctaagaaacagatcatgaaatacaaaatcgctatccgtgacgtcattcaccaacttgatttgtgtagttccagtgggagcaaggatgactctgtgattccaccagatgggtgtcacgagtctgtcaatcctgaacatacaatatgttcaaggtgcaaatcccacgagtcatttcctgacaataacattatattctgtgaggggggctgcaaactggcgtgtcatcagaaatgtttggagcctccttttgataaaattcttccaactacccgccatgggcggctttgcaaacactgttcttccaagatgaaaattttagacgccattaatgcccatctggggacaagttttacagtgaagtgtccctccagtgatattttcaaggaagcagctgaacatttcaactctgatgatggactgggccaagattggctatctgagtattcaggtgatgaggactatgaccctgaagaaaatgaggccagcagcagtggtgaagagaataaatctgccgattccaattgttcagggagtccactttattctccaaatgatgatattccagacttcatatcagcagatttcaatgatgctgaaggattctgtcgtgaaagttcaaatctaggaatcgattttggtgaagatggtttggctgagattcttacccaccaaaggccaagaagagatgttgactatacacaacttaatgagcaaatgtttggagagcctattggcaatgacgaacagagtgaagatgaagattggggtcttaacaagagaaagaaaagaagaactggttcaactggtgttgggactaattccgtagagggtcgatcagatgtcaaatccaataagaaagcccaacctcggagaaaacttttcaggattcctcctgcggcagttgaggtgctccgtaaagcttttgctgaaaatgagcttcctgcccggagtgtcaaagaaaatctctcaacagagctgggtatttcttttgaaaagattgataagtggttcaaaaatacacggtgtgctgctctcagggataggaagggtgaaagtcgttattctggtcccagcaaaaggtcaagaacaagcatagaaaaggctgaaacttcagctaaagtggatcaaatggacaactcatgctttcttcccttatctgaaataatcaacgtgcccacacgtctgcagaaaggtcttgataagaagccaaaatcaattaacagccctccaagacctcaggacaatgaaacttgcttgtcgccaactgataaaaccaaggagggtacaccgcctacgatcaagccttccatcacagattctagtcaactgatgaataacaacatcggcactgaggagactgctgtttcttgggtggacacttgggcctctgacgctctgcatttcttggacgtgagcgatgatgaacatttcttcgatgtgatcgagaaggtgtgcggtctcgagaatcggctgcagcggttgaaggagaacatgctatcatcgtcatcgtcaactgacaacaatgtggctgctgagagtggcttgcaaaacgaagttgtgcttgtaccagctgctgagctcaaggataaagcatcttaaccttgcatctgggtcccaatgctttgcttcagttgaccatttgctcataggattttatacatcagaaaatagtacaggaggggctggagtgtagcttgccccgtttatctttgaacttatataccggtgaactggtaccattctatatagggagggacagataattcggattaggttcgtgaggatttgcaaagagttagtttaactgtaatctttcagctggaactttgttcagcgagtaataggtcatggacaattacc

SEQ ID NO: 5493 - DNA, 318 bp, Oryza sativa
  Predicted polypeptide sequence is orthologous to G418
ccgtgatgatggagctgccctggaaactctgtgtggcccatgatgctgacgtgcagatgccacaactgacaactgtgcatgcatgaggctggcacgaatgtgtgcctggaagtgtgctgtgtgatgatgaggagcgctgctgcatggtgtggccatgagatgccacatgaatggtgatgtgagtgatggaaggaacggaggctgatgagcggggaagacgggcaggagccggacaggaggagcccacggggagcgaagggcgcaacggagacagaaggagcgggggacgggacccggaccggaaaaaaaaaaaaaaaa

SEQ ID NO: 5494 - DNA, 800 bp, Oryza sativa
  Predicted polypeptide sequence is orthologous to G418, G965
agaaccccctcaactctcccccgccgaccgcttcgagcaccagcgcaagaaggccaagctcatctccatgctcgacgaggtggacaggaggtacaaccactactgcgaccagatgcagatggtggtgaacttcttcgactcggtgatggggttcggggcggcgacgccgtacacggcgctggcgcagaaggccatgtcgaggcacttccggtgcctcaaggacgcgatcgcggcgcagctgagggggacgtgcgaggcgctgggggagaaggacgccggcacggggtcggggctgaccaagggggagacgccgcggctgcgggccatcgaccagagcctccggcagcagcgcgccttccaccacatggggatcatggagcaggaggcgtggcgcccccagcgcggcctccccgagcgctccgtcaacatcctccgctcctggctcttcgaacacttcctccacccgtacccgagcgatgcagataagcacctgttggcgaggcagaccgggctgtccaggaaccaggtctcgaattggttcatcaacgcccgtgtccggctatggaagcccatgatcgaggagatgtaccagcaagaatgcaaggagctcgagggctcctccggcgccggcgacgacccctccggcgccgacgacacgcactcgccgacgaccaccgccgccgcgcatcatcagcacaggcacggccagctaatggtagagcacggcggcgcgtccagcggcggcggcgccgccatgtcgtcgcacaagcacgagcccggcgtcgtcgcggggccctcct

SEQ ID NO: 5495 - DNA, 2398 bp, Oryza sativa
  Predicted polypeptide sequence is orthologous to G418, G965
ggcttctcccctttattttctctccctttcctctcggtgcgcttcccttcctaggcttagctatagctcatctctcctctcctccacctcgaccttctcttgctttcctccacttttgttgctctcagcttttcgccttttcaccaatccccgcaccgccacagatcgagggagagtgagctctcgcgtgccacggctcgaggtggtcgtgcgtgatttgatcgatatccatggcgcacgatccgagcctagggtacgcggattacttcgcggcggaggtggatggcaccggcgccacggagttgtatgggttgcagcagcatcagcagggggttggggtggcggagatgttcggggtgagggggctcatgccggcagcgcacgcgcacgagcagagcaagggtgtgggcgcgctcgtcgtcggcggcggcggcgtcgatgatggaggcgcgacgacgctgccgacggtccacttcggcgggctcggcgagctgcaccaccaccaacaccggcagagccaggcgccgctgtccctctcgctccacaggccggaggcggccgcgacgtcgctgctgatgcagcagcagcagcagcacctccaccaccagccgtcgccgccggcgggcgcggcgtcgacgtggcagctgcagcagggtgcgtggcatctccgcggctcaaggttcctcctcccgacgcagcagctcctgcaggagttctgcagcctccccgtgaagagcaccaccagcccatcatcggcaagcaaggcaaccaaaccgccgcaagaagaggccgccagcggcggaggctcgtcgtcgtggaccgcgccgacgcagatccagtccatggacgcggccgagctgcagcggctcaagggcaagctctacaccatgctcgaagaggtggataggaggtacaggaggtactgcgagcagatgagggcgctcgcggcgtcgttcgaggcggtggccggggagagggcggcggcgtcgtacacgcggctggcgtcgaggacgatctcgaggcacttccggagcctgagggacggggtggtggcgcagctgcaggcggtgcggaagcagctcggggagaaggacacggcggtgcccgggatgaccaagggcgagacgccccgcctccgggtgctcgaccagtgcctccgccagcacaaggcctaccaggccggcatgctcgagagccacccatggcgcccccagcgcggcctccccgagcgcgccgtctccatcctccgtgcctggctcttcgagcacttccttcacccgtacccaagcgacgtggataagcacatcctcgcgaggcagaccgggctatcacgtagtcaagtggcgaattggttcatcaacgcgagggtgaggctgtggaagccaatggtggaggagatgtacgcggaggagatgaaggacgaggagggcagtggacagtccacgcaggcgagcaacccgcagaaccctaaccctagcagctacacgtcggaggtgcgcggcggcggcggcggcggcgaggaccgcggcgagcagaagccgtcgcgggcgcagctgctgcacgacgccggctcgctggcctccgtcgtgagcatcgggcacggcggcgcgggacggacgatggtcgatcaccaccatcaccagagccttaattttggcacgatggaccagctcgacttcgacgcgtacgaggcggccggcggcgggcaggggttcggcgccggcggcggggtgtctctgacgctggggctgcagcagcagcacgcggacccgcacgacggcgtgaacgtcgcgttcgccgccgccgcggcgccgcccaattcgtccggtgtcgccgcggagtacctattcatgggcggcggcgagcatcagcagcagctgcctcaaaccgcccagttcggcgccgtcatggaaggcgacgccgcgtcgcactaccgtggcctcagcgccaccgccgccgggttccacctcctccacgacctcgccgggtgacccgtcgcacatcaaacaggtggtagaccgatcgacacgcgcgccgtacgacggaaccaattgccggcgacccctcctgtacgcgcgtgcgtgcgtgcacaggccgatcaatgtccaatttcgcgcatgcttggggggtggggattaattgggggggagttagctagctagctctagctaggttgatgtgattgacggggacgcgccaccggcaaagctctcgctctcgcgcgcgggcgcgcgggcgacaccggcattggcgcggcgagagaggggggtgcgcgttgtgtccctctcctgtacaagtacgtatacgctgctttggatttatttttgtagtagcgattagacatctcgtcgctcgatggaattaattaattttcttggcagcgcgtctctgtctacgt

SEQ ID NO: 5496 - DNA, 2112 bp, Oryza sativa
  Predicted polypeptide sequence is orthologous to G419
gtccatggtttaattatttgtagccttatagagagagagaagagaagaagagagagagatcagtgtgaggcaccgacgaagacgaagacgaagacgacgacgacgacaagcacacaacaaatttgcacacacgcgcgcgagcatcgatgatggcggcccatcatcatcatcatgagcaccaccacctcttggacatgtcgtcgcccccaaacgccagcggcgccatcatctcctccttcgaccacgccgccggcctcctctccctccacgacgtcgccgccgccgccgaccaccaccaccaccacctacgaggaggaggagggggtttgcaattgccatcgccgtggtcgcagcagcaggtttccctctccctctacaacaacgctgccggcgcagcaggctcgccgccgtcgtcgttggttgcccatcagcagctggcggcggcgcagccattaatgttccagctgagggggtccaagtacctgggccctgtgaaggcgctgctcgccgagttctgcagcctcgacgttgaggccatggatggcgccaagcagcagagacctcccaatcccaatcccaagattggaaagtgggacgacgtggagggttcaggttcgtggggcaacctgtctctgagctccatggacctcctggatctcgagaggaggaaggccaggatcttgtccatggttgaagaggtggacagacgttaccggcgataccgtgagcagatgagggcggtggaggtgtcgttcgaggcggtggccggcggcggcgcggcgcaggtgtacacgaagctggcgatgcgagccatgtcgcggcacttccggtgcctgagggacgcgttggtggggcaggtgcgcgcgctgaggaacgccatgggggagagccagagggacgccgccggcggcgtggcggcggcggcgcccggtgccaccaagggcgacacgcctcggctgcgggtgctggaccagtgcctgaggcagcagagggcgttccagcagtccggcgccgtcgacagcttcccgtggcgcccgcagcgcggtctgccggagcacgccgtcgccgtcctccgcgcctggctcttcgagcacttcctccacccgtatccaaatgatgtggacaagcacattttggcgcgccaaacaggcttgtcaagaagccaggtttcgaattggttcatcaatgcaagggtgaggctatggaagcctatgatagaagacatgtacaaggaagaaacgaagccggaatcatctgatggcaacaacaaattaaaccctagcgcagccggcaacaaacagcagcatcgagatgatcccaagaagaattacacggcaacgacagcagaagccagcttagtacaacaaagcagctaccatctccaccttcgcagcagcggaaaccgtaactcctcctcgttgatgatccctgcagcagcatcaacatccatcgatcatcaccatgacagcagccaccagctgttgggcggccatagctattcttcagcagcaggattgcatcatggtcatggcggcgccgtgtcgcttactctagggctccagcagcagcagcagccatttgcggcgtcgatgatgcatcagcatcagcagcaccagcaccagcaccagcagcagcagtcattcatggtggaggcggcggaggaagaagaagatgacgtgctcccttacaggaacctcatggagtctcagttgctgcatgattttgcaggagctagctaaggcaggctccagcttagcatgcagctaatttatttgattgttaaaggagattattgcgctcaaaagtttaatttaattaaggagatgtaggtaattaaatattacattattgttcttttatgaccaaacatttcgttacattatttggggatttcttttgtaaaaatcagcccaccacttctgttctggcctagctagcttagcatgcagtgatgtggaacccacccttgcagtcccatctgggcccatgacaagttagttacttagagcacccgcaatggtaaagtaaggtgttatctataaaacatgtacatctcagcaatagactagattaatagtaaaccacttcaatggtatgtctacatgggtatct

SEQ ID NO: 5497 - DNA, 2583 bp, Oryza sativa
  misc_feature (693)..(693): n is a, c, g, or t
  misc_feature (719)..(719): n is a, c, g, or t
  misc_feature (734)..(734): n is a, c, g, or t
  misc_feature (765)..(765): n is a, c, g, or t
  Predicted polypeptide sequence is orthologous to G419
aagaaccacatcttgttttccttcttttccctgccctcccaggacaaagcaagattcctgtgtttctgaggcttagctgaggaaggattcggcctacctgctctcttctcctgcccggccgattgctacgacttgcaacacgcatcaccatagtaatagtatcgtcgtgttcactctccgacgacttaattgtgtgcgtgttgtatttcccaccgtcttgtcacttcatcacacatctggctacatcgatggatcactggtgctactagctagctagctcgctagttactcgattactggctgaattttcgcttctgtctccatctattttacacaaattaaagcttttggcgatcggaggaattgaaacaccgatatggcgcatgatccgaacctggggttcgcggattacttctcggcggcagatgcatcggcgtcgtcggtcacgacgctgatgccggcgatggacgaagcggcgccggagctgttcgggttgcaggccgggatggagcttctcggcgtgcgcggtctgggtatgagtatgatgcccggcgcggcaggcaaggtcgccgcgctggtggccgacgctggggacgacggcggcggcggctccaccatgcgcttcctcagcgagcagcaccaacagccgagccaggcgccgctgtcgctgtcgcgtgtgccgcccggacggcntgctgcacctcggcggcgcggcgcgnccgcagcaccaactngcgcccgcggcgccatggatgacgcaccacnacgcgtcgtcgtcggcgccgcaaggtgcacgcggcgtggcacctgcgcagctcgaggttcctcctcccgacccagcagctcctccaaggattctgcagcctccccgtggacagcaccaagcgcggcaacggcgccaaggcagcgacgcagcaagaagacggccgcggcgacgggtcgtcgtcgtcgtcggcctcgtggaccccgtcgccgcagatccaggccatgaagccctggagctgcagaggctcaaggacaagctctacatcatgctcgaagaggtggacaggaggtacaggaggtactgcgagcagatgagggcggtggccggggggttcgaggcggtggccggggagagggcggcgggggcgtacacggcggtggcggcgaggacgatatcgaggcacttccggagcctgagggatgggatcgtggcgcagctgcaggcggcgaggaaggcgctcggggagaaggacgtgagcgcggccgggacgacgcgggggcagacgccgcggctcagggtgatcgaccagtgcatcaggcaccacaagtcgctgcagggcgtcgccgccatggacagccacccgtggcgcccccagcgcggccttcccgaccgcgccgtcaccatcctccgtgcctggctcttcgagcacttcctgcacccgtatccaagcgacgtggataagcacatcctggctcgacagacgggcctctcacgtagccaggtgtccaactggttcatcaatgcgagggttcggctgtggaagccaatggtggaggagatgtacgtcgaggagatgaagggccaggacggcggcgacggcagcggtggacaggggagcctaaaccctaagcctacctgcagccacgcctccgaggcgcgcggcggccagcagctggtcgtcggcgatggcgacggcggcgaacagaagccgacgagggcgcagcttcgccacgacgccgggtcgctggcctccgtcgtcaacgtcgacgtcgcggccggcgcgggcggcgtggcccggctgcaccaggcggagaacttcggcatcatggaccacctcgacttcgacgcgtacgacgacagccaccaccagcagcagcacggcgggttcggcggcgtgtcgctgacgctcgggctgcagcagcacggctcccacggcggtggcggcgtgaacatcgcgttcggggcgccggggtccgcgcacggcggcgccgggttcttgtacccgggcgagcagatggcgcctgacgccatgcatccggggcacggccaccacgtcgtcggcggacagttcggcgtggccatggacggcgacgccgcctcgcacgcgcaagagcggtaccggagcctaagcgccggcttccacctgctccgcgacttggccggatgatccatgcggcgaactactcagttcatcgcacgtacgcatatatatgcattccgtgtactgtactagcagacgatttggatgtcgcagcggcagcggccgcggcggtggcgactaggtagggatcctcgcgcgcggccggcgctgcggcgtgcattggttgggcaaccgaattaagcgtttttgttggtggtggtccttgattttaccgacctataggtacagttcgtatatatctctcgcgatcgatcgtacaccagcaggggagtagcccagtagatcgtcgtcgatggcgctttcgtgtggttcggaagcgggcagtttattttagcctaccggcccggcatcggttgccgggggttgtgtggtcgtgtgttgtgtagtggagacagcttttatttgtactggaaatctggaatttgattgatggttc

SEQ ID NO: 5498 - DNA, 440 bp, Oryza sativa
  Predicted polypeptide sequence is orthologous to G427
gcgcaagggtatcttcaagacacgtgagcaaatgctggcggagaccaaggatatgaaggaggaggatctggaagcggacaataagtctcgatatctttccgcagagatgtacgagcaccttttggtgctgcgtcgtacctgtctgaaggtgtctcgggcaggtctgagcaccactctcaactcagtggatgcgttctgtgccctgcaagctatcgtcgctctgctgcagtacttgggtgggcctgacaaggagaagctggcggccatctcacgctttcctaccatgagcaagtctgcctccaatatgcttttctatactcgataactggcggactgatcgagtcgttgctacagtatcttcttcttttgtatgatagttttcaattgtgtttcttccacctttaaagcttattgatttcaaaaaaaaaaaaaaaaaaaaa

SEQ ID NO: 5499 - DNA, 1105 bp, Oryza sativa
  Predicted polypeptide sequence is orthologous to G427
gcagcccttcttgtggactctaacatacttctcttaattgcagacacattatgtgttgcttctttgctcattcaaggaacaacttcagcagcatgtgcgtgttcatgcaatggaagcagtgatggggtgctgggaacttgaacagtctttacaaagtctaacaggggcatctcctggtgaagggactggagcgactatgtctgatgatgaagataaccaagtggacagtgaagccaacatgtttgatggaaatgatgggtcagacggcatgggctttggtcccttaatgctgaccgagggtgaaagatccttggttgagcgtgtacggcatgagctgaagaacgagcttaagcaggggtacaaagaaaagcttgtggatattagggaagagatccttcgcaagcggagagctggtaaacttcctggtgatactgcatctatactaaaagcttggtggcaagctcattctaagtggccatacccaactgaagacgacaaggcccgcctggtgcaggaaacggggttacaactgaagcaaatcaacaattggttcattaaccaacgcaaacgaaactggcatagcaacccagcatcctctggtgaaaagaccaagaagaaaagaaacgttacaggtgatggtggtgctgagcaatcgtggtagattggttcaacatgaaactagatgtaaacagtaccttttattgtgaagagtgtagtacattctctcgtgctctggtgtgacaaaatctggagaccggcccattcacaagggaattgcgatcataggcgtaatcactgggcaaagaagtcatctgaaattgtagcataagcgcacaaaactgaggtgggtggtatttgactttcgcagtatagcatcgactgtctgctaatgtgattttgtgaaggaatgttctgtataaccgatgaacggaaggaagaattgtattgtgtatgtaattgtgtatcttatttatcatgtaatatatatatgatattaggagctttaagattcggattggatatgttctctgttttgatgcacgatgcagtgttgaggtgtaacatgttttggtaattcactgtgtataaaaaaaaaaaaaaaaaa

SEQ ID NO: 5500 - DNA, 1540 bp, Oryza sativa
  Predicted polypeptide sequence is orthologous to G427
tcttcgtcttcctcctccacctcgcgcgctgcagcagcagcagcggtgcgcgtgatggcgttccactaccaggaccacgcgctggcgatggacgccgcggctgcggcggcggagacgggcggccaccaccaccctgggttcgtcggggcgggaggagttgtggggggaggaggaggaggagggtgggagcgggagaaggccgccatcgcggcgcacccgctgtacgagcggctgctggaggcgcacgtcgcgtgcctccgcgtcgccacccccgtcgaccagctgccccgcatcgacgcgcagattgcggcgcgccccccgccgctggccgccgccacggccgcagcggcggccgcggcggccggaggggcgccgtccggcggcgaggagctcgacctcttcatgacccattatgtattgctcctttgttcgttcaaggaacaactacagcaacatgtgcgtgttcatgcaatggaagcagtaatggcttgctgggaacttgaacaaactttacagagccttacaggggcatctcctcgtgaaggttctggagcaactatgtctgatgacgaagacaatcaggttgatagtgagagcaacatgtttgatggaaatgatggatcagatggtatgggctttggccccttaatgctgacggagggcgagagatcattagttgagcgtgtacggcaagagctgaaacatgagcttaaacaggggtacagagaaaagcttgtggacattagggaagagatactccgaaagcgaagagctggaaaactcccaggagatacagcgtctactttgaaagcatggtggcaggctcactctaaatggccatacccaactgaggaggacaaggctcgcttggtgcaggaaacagggttgcaactaaaacagatcaataattggtttatcaaccaacgtaaacggaactggcacagcaatcctgcttcatcctcatcagacaaaagcaagagaaaaaggtatcgtgtcgtggacttctaacagaaattccttttacatatttttggtttccattttcctgtctctgtctgtttatgcctagaaaaagaagcaatgcaggtgatggcaaggccgagcaatcttggtagaacgtggttggagaagaagtatatatatgtaaataatgcatccattgtgaagaatgccagtatatttattgctcccaagatggcgattcggacagaagcttcctggggctaatttatacgaaagaaattatgtcatgttataattttagtcatgtgaagctatagtgcgtatatatagtgacttaccagagagtagtttttatgtttgctgttggctagtgtgcatttgtagttgggacgtgctggctgtctctctacagctcggtacaaccatgtatttataacgtgttgtgaagcatatgttgtaaaatcgtggaatgggagtgttctgcgatccccatatgttgttgtaatgttgtatattgatgaccatgctgcaacggcagcatgtttgtaactcgttaaaaaaaaaaaaaaaaaaaaaa

SEQ ID NO: 5501 - DNA, 1493 bp, Oryza sativa
  Predicted polypeptide sequence is orthologous to G427
gccttctcgctggccattagagctagctagcgagagctctagctacagctatacatacgtgtacccaacggccacggtcacccgcgcgagcgagcacgcgcaccaaccgatcgagcccaacaagctcgctcgctcttggtgcgcgcgcgcgcggcgagttcgatcgatcggtgtatacgcgtatcgtgttgtgtatgcaaggcggtgatcacggaggcatggagatgggcgtggggtcgttcaccggcggcggaggaggcggggagtgctcgtcgtcgtcggcgacggcggcggctgctgcggcggctgcggcggcggcggcggcggcggaggcggaggagcggcagctgctcaagggggagatcgcggtgcacccgctgtgcgagcagctggtggcggcgcacgtgggctgcctgcgcgtggcgacgcccatcgaccacctcccgctgatcgacgcgcagctcgcgcagtccagcggcctcctccactcctacgccgcgcaccaccgccccttcctctccccccacgacaagcaggagctcgactccttcctcgcgcagtacatgatgctgctgtgctcgttcagggagcagctgcagcagcacgtccgggtgcacgccgtggaggccgtcatggcgtgccgcgagatcgagcaatccttgcaggacctaaccggtgcaactttggaggaagggacaggggcgaccatgtcggaggacgaggatgagacggcgccgatgctggagggcccgatggatatgggctcggacgggcacgacctcatgggcttcggcccgctcatgcccaccgactccgagcgatccctcatggagcgggtcaggcaagagctcaagattgagctcaagcagggcttcaagtcaaggattgaggatgtgagagaagaaatattgaggaagaggagggcaggaaagttgcctggggacaccaccaccatactcaagcaatggtggcagcaacactccaagtggccataccccacggaggatgataaggcaaagcttgttgaagagactggcctgcagctcaagcaaatcaacaactggttcatcaatcagagaaagcgtaactggcacaacaactcacagacatcaacccttaaatcaaagcgtaaaaggtaaacaaaccgttatccaagtattttatccacagtaatacaatgttgatgtttcagtaattaacaactgaattataacacaaacttcttttttctatatgtaatacaggtaaagggcagaaaaaaatgtatacctgacgtactcgctaatcaaatcaaaagaagacatggtgactcataagtaataagatcatcttaaattgtatatctagttattaattagtcagaggtgacaaattcatgacatacatactagtctgaccactggcatatgcgttgtaatttttgagcagatatgctcaagcaaattcttcttgttggtatagtttttaaaaaaaaaaaaaaaaaaaaaaaaaaa

SEQ ID NO: 5502 - DNA, 1125 bp, Oryza sativa
  Predicted polypeptide sequence is orthologous to G427
gatactcatagctctctacctctctagctagctagctataggtagctagctagtcctcctgctacctaggggggcgacgccgccgccgccggggacgacggccgcgagctcgaccagttcatgacgcactacgtcttgctattatgttcgtttaaagagcagctacagcagcatgtccgtgttcatgctatggaagcagtaatggcatgctgggaacttgaacaaaaccttcagagtttgacaggtgcctcgcccggtgaaggcacgggagcaaccatgtcagacggtgaagatgatcaggcagatagcgaggcaaacatgtatgatccaagcttggatggagcggataacatgggtttcggccttcccacagaaagcgagcgatccctaatggagcgtgtccgtcaagagctaaagcatgaactaaagcagggttacaaagagaagctgattgacataagagaagaaattcttcgcaagcgaagagcgggaaagctaccgggagacacgacttctacgttaaaagcttggtggcagtctcatgcaaagtggccatatccaacagaggaagacaaggcacggctagtccaagaaacagggctacagctaaagcagatcaacaactggttcatcaaccaaaggaaaagaaactggcgcagtaacccatcttcctccaccagcgtcaaaaccaaacgcaagaggtgataacaattcgtagcagatgatcgccgagggctgaacactatgctgggttacagggcaggaggaattcatccaaagcaataggaggacaattgcttagatcaggaaatgttctgcaagatcaggatcaggagccgtatattagagaaccagttatattttatagacaaaactaattgcaagtaaacatatatagttctgtaagcgcttgatttgaagaaaaggggaaatttttccaaaggggttgtataaaatggcgaaatttatatttcagtttctagataccactgggtaatactgctcatagcactggtgttgatgtttttgttctccatgcgtcgtagacaagcggttgaaccgtccgcttcagacgatttttttcacacgtatatatgtatgtattgctgtgggtttatttagctt

SEQ ID NO: 5503 - DNA, 388 bp, Oryza sativa
  Predicted polypeptide sequence is orthologous to G427
ttgataatcgtaccaatcagaattattcaaaacaggactgggagaataccaatcatcaagatgcatacgtttcacaacaacaacaacaacaaccaccaccaccaccccaatcgagacaagaacatattcttcaacaattatcagctattaaagaaaatcttgttcgtcgacaacgagaattggcttcctcaatgagtgctattccagtctaataccttacacattcgccaagcgacttcgtatcatcttctttttttttctctctctctctctctctttacatcgtgtttgtttaatctttttttctttgtgtgtgtgtgtgttacatttaaatatttgaccaataatgttgatggatataaatcattatcactgactattgagaaag

SEQ ID NO: 5504 - DNA, 1273 bp, Oryza sativa
  Predicted polypeptide sequence is orthologous to G428, G1594
gaattcccccatgagcctctgcctccctgcctgcccccgtatgtagcaagaacaagaacaccagcgagtaacacaggctcgctacagtggtactagattaccgcttgtgcgggcatagtgatcgtctatagttgtgaattgcgatgcagcagcataggtggtgagctgctgcggctgctgctgctggtacgtagatggaggatctgtacagcatccacccggggatctcgcgggtcggcggcgcggcgagcgaggcgtccggcgtgggcgtcgtcgtcggcggcggcggcgggtcgtcgtcgtcggatctgacggagctcatgaaggctcagatcgccggtcacccgcgctacccgaccctcctctccgcctacatcgagtgtcgcaaggtgggagcgcctccggaggtggcgtcgctgctgaaggagatcggccgggagaggcgcgccggcggcggcggcggcggcgccgggcagatcggcgtcgaccccgagctcgacgagttcatggaggcgtactgccgggtgctggtgcgctacaaggaggagctgtcccggccgttcgacgaggcggcgtctttcctcagcagcatccagacgcagctcagcaacctctgcagcggcgccacctcgccgccggccaccaccgccacgcactccgatgaaatggtggggtcctccgacgaagaccagtgctcgggggagactgatatgctagatatagggcaagagcaaagctcccgcttagctgaccacgaactcaaggaaatgcttctgaagaagtacagtggctgcctcagccggctccggtccgagttcctgaagaagcggaagaaagggaagctaccaaaggacgcacggtcggcactgcttgaatggtggaacacacactaccgctggccatatcccacggaagaagataagctgaggcttgcagcgaggacaggtcttgacccaaagcagatcaacaattggttcatcaaccagaggaagaggcactggaagccatcggacgggatgcggttcgcgttcatggagggcgtggcgggtggatcgtccgggacgacgctctacttcgacactggcacaattggaccatgaattcatttttgagcaatgccgcctcttgagaaaattggccatttaggcagtaatagtaggacatggtatttggtggtgattgtgtctagctatgatcaatctttcagcaggtcagtgttattcagttcagggtaaagtaattgcctcattgttttggcaaaaaaaaaaaaaaa

SEQ ID NO: 5505 - DNA, 1785 bp, Oryza sativa
  Predicted polypeptide sequence is orthologous to G428, G1594
gaatctttgtttccatgtctgtctgaattctgatctcttcttctctctgcctgcagacacaagcaggtgactcctccatcctcccaaagcaaagcacccatgtatcccgctgctgccgctgctacctacaagtgcaccctgcagaagctgcttctccttctccttctgatctgaggagctgcagctgctgctccagcagcagaggctgcagtgcaatccgctgccaaattcctcttcttctccttcctactagcttttctcttcttcttcttcttcttcttggaaagctggaacttggagctgcttaagcttacacctgctgattcatctccagctgctgctgctgctgattcagtattattatgtgtggagatgtacagtagatgaggaggaaggaagtagctactggatagctagctgagctgagctaagctgagctaagcttcttggctaggtaggtagctagaggtgaggtgaggtgggggaagaggggattggacatggaggatctgtacagcatccacccgggaatctcccgcggcggcggtgggggaggaggaggtgcggccagcgaggcgtccggggtcgccggaggggggagctcgccgccgcatcccccaccgccggcgacgacggcggcggcggcggatctgacggagctgatgaaggcgcagatcgccggccacccgagctacccttccctcctctccgcctacatcgaatgccgcaaggttggtgcgccgccggaggtgaccacgctgctggaggagatcggccgggaggggcgcggcggcggcggcggcgcgacagccggcggggaaattggcctcgatccggagctcgacgagttcatggagacgtactgccgggtgctggagcggtacaaggaagaactcacacggccgttcgacgaggcggcctccttcctcaccggcatccacacccagctcgcctccctctgtggcggcgcgccgccgcccaccgacaactccgatgaaatggtggggtcttcagaggatgagccgtgctcaggagacgccgatgcagcagattttgggcaagaacacagctcccgcttggctgaccatgagctcaaagagatgttgctcaagaagtacagtggctgcctcagccgcctccggtccgagttcttgaagaagaggaagaaagggaaactaccgaaagacgcgcgatcggcacttatggactggtggaacacacattaccgttggccttaccccacggaagaggataaggtgaggctggccgcgatgactggcctcgacccgaagcagatcaacaactggttcatcaaccagaggaagaggcactggaagccatcggaggacatgcggttcgcgctcatggagggggtcaccggaggatcctcctccgggacgacactgtacttcgacaccggcacaattggtccatgatcagattgcactccaaattaaatgtagcaccttgcaacagacattggcaggtattacctgctgctacaccctctgtgaggagcaagggatgatcatatattaaaaggaaaaaaagatgaaatcaatcaataacctcatcattttgtcgaaattattgtgtatatggtgttgtaagagggagttgggatgacctgtaaaaacttgcctgcattcagctaccataacattaattaattgtttgtatccctgacaactgcatccccagttaaaaccattttagacaggaaagagtgaactatgagtaatagtaacatgtagcaataataaagatacttattttttcccttgc

SEQ ID NO: 5506 - DNA, 714 bp, Oryza sativa
  Predicted polypeptide sequence is orthologous to G438
atggtagccgagaagcgtagtgcagcgctacgagctggtccattctcgtatcctgaccggctcgatcgatcgatcgatcgaaatattatacactactgcatgcgtactagcagtacgatttttctaagccgaagctgcacttcgctgcagggcgagcattatccggtcagtccggttcacgccgcggccgcatgcatccaaccgcttataatttgcaggttcgccgccttgttttctcctcggttccgggcgcggccgtcgaacagtgcgggcatgtgtggcgacagtactacagcggtacaaccggttggccatcggcgagagtacgtaccagtctgcgtgcctgtacgtgacgtgacacggtattcgtgcgtgcgtatgcggtacacgctcgcggactcgcctgtcactcgattatcacgggccggtttggctgaattatccgtggacggtggacaaatggatctcgcaccctgcagcgcagtggtccgtccgtccgtcctctttgctgcgctggcgaagtggcaagtcagtgaagtcgcaaatggagatcctcgctgtcattggaccggttgggtgggctggcgtaccatacggccataccaggcaggagtgaaacgaagacgacaagatgtgaatcgttcacggcttcaagcgtggatcatagggaacctgtacacgaagatgctgaagcagtgtgaagatttttactag

SEQ ID NO: 5507 - DNA, 1206 bp, Oryza sativa
  Predicted polypeptide sequence is orthologous to G440, G864, G1421, G1750
cttggatgagatttggggtgacgtcctcgtagcgggcggtggatatgcgtcctccggcgatgtctccggcggactccctcgccgccggcaggagccgccgtgttggggctagcatgcctcggcccaagcgtgtccgcgtctacttcgtggacgccgacgccacggacaccgactcctccggggacgagcgctccaggccgcgcgtccgggaggtcatcgacatcgacgtcggggccgcctcgccggcgccggcgccgaagcacccgaggcggctggttccgacggcgacggcggcgctggcccggcggcgcgcggggatggcggcgagccggcggttccgcggcgtgcggcggcggccgtggggcaggttctcggcggagatccgcgacccgagcctgcagaagcggctgtggctcggcaccttcgacaccgccgaggaggccgccgccgtgtacgacgacgccgcgctccgcatcaagggctcccacgccgtcaccaacttcccctccgactccgacaccccctccgccaaggccaagcagatgaagctccaccctcgccgacacaccaccccggacaagaccccaagctcttccaccgccgccgccgccaaggcctccgtccccgatccgacgccggcgccaccggaggaggaccgcgccaacgacagctcgttcaacccgttcgcgtcgccgacctccgtgctccggtacgcggcagcggacgaggtgaccgcgccatccttcgagcacctcctcgtcgagctgggcgacctctcggcgccgccgccttccaccaaggcggcggagttcgactggctgccgtggtgggaaggggaggacttcgtgacggcggggctgacggcgagcaacgccgtcagcgtgaaatgacgccgctgcccccctccacccatttcgcgctctcggggcgggaaaagttggcgggagacggcgcatcagcagcaaccagcagcaatgttattactactagtattatattaattttattattattatttcgtggcagtaaaaaaaaacccagcggagtttgtactccctagtgaagtgagcagtagtagtaaatggtggtggcgtggggcccaaggcgggcgctcgctttgtgcgtgagctgccttgaatggcacgtctcccgcgtggaaacggaacagtgtaattgcgtggcagatatttattttttctttctttt

SEQ ID NO: 5508 - DNA, 1817 bp, Oryza sativa
  Predicted polypeptide sequence is orthologous to G440, G864, G1421, G1750
aacagcaaccaacaaacacacgcgaagaggcacacatctccgccttcgtgttcctcttcttctctcctcctccccccatccatccatctatcgcaccacctcccccgaaaaaatcccaccaatacctcatcgccttcgtccccttcctcgcttccacgccaaaagtcgttcgcttttccctcccttccttcccccccgtctccttgtgggttttgggaggggtggttcctcgaggtgtaggtgggtggcgcgctggcttcttcttggccgcgagggttttaggaggtttcttgagggttttggagtggtggtggtggaggattggagttggggtctgatgcgagtggagtgatgatgatgtggcctttggagatggaggaggggtttgtggctctcaagaggacggagcatgtcgaggtgacgtccttggcggtggcggtcgaggcgacgccgtcggcgaaggggggaaaggggaaggttgtggtgggtggtggtggcgccggcggcggcgttgggccgacgagggtgagggtgttctgtgatgacttcgacgcgacggactcgtcgagcgatgaggatgaggaggaggtgaccgcgcggcggagggtgaagcgctacgtgcaggagattcggttacagcgcgcggcggcggtggccgtgccgccggtgaaggtgaagggcgaggaggtgttcccggccgcggtgtcggcgaagatggcggaggccgcgaaggcgagggtggtgttggcggctgggaggaagaggaaggccggcggggtggacggcgccgagccgcggttccgcggcgtgcggaggcggccgtgggggaagtacgcggcggagatccgcgacccgtggaggcgggtgcgggtgtggctcggcacgttcgacaccgccgaggaggccgccaaggtgtacgacacggcggccatccagctacgcggccgcgacgccaccaccaacttcaaccagtccggggactcggcaagcctcgacgtcccacccgaggtcgccgagcgcgtcccgcagccgccgggggcgtccaagaacgcctccccggccacctcctacgactccggcgaggaatcccacgccgcggcggcctccccaacctccgtcctccgttccttccctccctccgccgtcgtcgcgaccgccgacacggccaacaagaagcagccgccgccgccgcctctcgtcgtccgcgagaccgacgagtcggtcgacgtcttcggctgctccttctccgacgacggcggcttcgccggcgagctcccacctctctacaccgacttcgacctcctcgccgacttcccggagcccccgctggacttcttgtccaacctccccgtggagcccttctccctggctcccttctccagcaacaatgggtcaccggacctccacctcgacgacgccccatcgccggcggcggcacaagtggacgacttcttccaagacatcaccgacctgttccagatccccgtcgtctagtgcagcagcaagaactgtaaaacaccggattaggagactaatccggcccaattttgtttgcgttttctctttttttttttcttctttattttttcgtttttagaggagaggagagttgagttaatgattccccgtcagtctagctgcggcagaacacccaccaccgcttcgtcaggggggaaagccttgacgaggcgagagagatgagaaagtcaaaagagaggcataaaacgagatcaatgttgttggggttatggtttttttgtaaaccatcgagaaaattaagttatcggtaattagcaaatactactactagtatcatc

SEQ ID NO: 5509 - DNA, 1089 bp, Oryza sativa
  Predicted polypeptide sequence is orthologous to G440, G864, G1421, G1750
cgagtgaagcactagctccacccatcatcttggatcgtgccatgtcccggtcgcgcacggtgcggatcttctgggacgaccccgacttgacagactcgtccggcgaggacgaggggtgcggcggccggagggtggggagcatggtgcgggagctgccgcctgcccagatgcccgtggcgcaggcagccgctgctgctgctttgccggagcagtgcagcggcggggacggtgatatgggaagaagggtcgttggtggcggatgcactgtgggtgtgggacggaggaggttgacgaaggacggagggcctggcgcgccgagcaccaagttccgcggcgtcaggcggaggccgtggggcaagttcgcggcggagatccgcgacccgtggcgcggcgtgcgcgtctggctcggcaccttcgacaccgccgaggaggccgcgcgcgtgtacgacaacgcggccatccagctccgcggccccagcgccaccaccaacttctccgcctccaccaactccgcgggtgcacaagatccggtggcagttggctacgagtccggcgcggagtcctcgccggcggtgtcgtccccgacgtctgtgctccgcaaggtcccgtccctgtgctccctggccgaggacaaggacgactatgaggccggcccctgcgagcccgcaactgccgccggttccaacctcaccgttctcgaggaggaggagctcggcgagttcgtgccgttcgaggacgcgccggtctacggcggcagcagcttctgggacttcgagcccgagtccggcttcctgtacgccgagccgtcgtcgcctgagacgccgtgggacgccggcgccacgtcctccggcgaggcccaagactacttccaggacttgcgcgacctgttcccgctcaacccgcttcccgcaattttctaaaaacgggatcggcttcttcaatcacggaactgcttttttgggtgttgttgagtattcgtgcctactgtgtgtacttcctgtacgtgctcttctggtgtctgcttgtgttgagtgagtcgatgagaaatgtattgtcctgagagtagagtttttttccgaaaaaaaaaaa

SEQ ID NO: 5510 - DNA, 3831 bp, Oryza sativa
  Predicted polypeptide sequence is orthologous to G446
gtgcgcaaagcagccgcggtcagcagcatcacacactgcagcagcagcagcagcagcagcaggagagaggctgggaagccaagaccaagagagagaaggcaaaaggcgcaaaggggaagaggggagcacgaccaccctcctccgtatcattgccatctactgcccccatcctactactactcctacacccgtctactccactccacaacctcttcttcttcctcctcgcgtgcgtccgggcctagctgtagcacgagctcgcctgcccatctctctctcttcgccgctttgcctttgctggcgttgcgcgttttgccacactcgctgcttcttttttatacttcgggtttgggcgggtgccactggagacattcgtggggtgccattgcggcgtcttctcctctctcaggaggcatttgtgacatttggtcgatggtgaagtgtggctaagctgctcgcttggcttagtactctggaattgaggttttatcagaatcttggcattcagattgcagctgttcttgggtttcttggagacatatggcgtcctcgcaggagaaggccaagacgggtgttctgagaaatgccgcagcgctgctcgacgaaatgcagctcatgggagaaacacagggtgccaagaaggtgatcaactcggagctctggcacgcttgtgccgggccgcttgtgtgcttgccgcagcgggggagcctcgtgtactacttccctcaggggcacagtgaacaggttgcagcgacaactagaaagattccaaattcccgcattccgaactacccaaacctgccatctcagttgctgtgtcaagttcacaacatcaccttgcatgccgacaaggacactgatgaagtttatgcacagatgacccttcagccagtaaactctgaaacggatgtattccctattccaactcttggtgcttataccaaaagcaagcaccccactgaatatttctgcaagaatttaaccgcaagtgatacgagtacacatggtggtttctcggtgccacgaagggctgcagagaagttgttcccacaactggattactcaatgcaacctcctaaccaggagcttattgttcgagatttgcatgataacatgtggacattccgtcacatttatcgtggacagccaaaacgacatcttctaacaactggatggagtctctttgttggggcaaagcgtctaaaagcaggggactctgtcttatttataagggatgagaagtcacaacttcttttgggtgttaggcgagccacgcgacaacaaacaatgttgtcatcttctgttctacctactgatagcatgcacattggcgttcttgctgctgcagctcatgccgcatcaagtggtagttcatttactatctactacaatcctaggacaagtccttcgccatttataattcctgtagcaaggtacaacaaggcaacatatatgcaaccatcagttggaatgagatttgcgatgatgtttgagacagaggagtcaagcaagcgcagatacacaggtacagttgtgggaataagtgactacgaccccatgagatggcccaattctaaatggcgcaacttacaggtcgaatgggatgaacatgggtatggagaaagacctgagcgtgtgagcatatgggatattgaaactccagaaaacactcttgtgttcccttcgtcgaccttgaattcaaagcggcaatgtcttcctggttatggagtttcagtgcctgggatggaaattggatcagcaaatatgtcatcatttccaagggctcagggtaatccctatggcagtttgcagcacattccagctgttggatcagaattggctatcatgcttctcaaccaatctggtcaaacccttgggagtccccttagttttcaccagtcctcatattctagtattatccaaaatgtgaagcaaaattatatccctcctctaacagttagcacttcagcttgtttgacaaagcaagaaagcctgccttcagatgatgcccagcaccagttccatatggcaaatatgcagaatggtgatcttgaaggctctgaagtccagcctgtcattgattcgatttctgagtcaaagttgaatgctacatcaagagatccaagaaacacagattcatacacaagtcgaagtacttcggagcaaaacagtaagggtgagcctagaggcaagactcgtaggagtaagaagggcttgcctcacaaaaccgtttcagagaaatctgacctttcttcagccccttcttggatctgtgacaatcagcaggttggtttagaatcgaaactggttggttgtgatgaacaagtaaactgtggaaatattgaagattcatcaggtgcacttactcaaggtaattttgttggacagccgcatggccatcaggttgaacaaaagggagtgctgtcgccacaaaaggtagaatcatcaaaatcacctgatggaggaaagtctgtcaattcgtttccaaaccaagggtgtttttcgcggttcattgatggtcttgattggatgactcagccttcctactaccaagactccaatgtaattcaaccagccggtgtgtcagagaacattttcagttcttctgcagatatacctccctcaatgattgctgatactatggagacttttcaggcttcatgtctttctgattgccttcctaattccatacaagaattcatctccagcccagatctgaattcactaacctttctttcacctgacatgcaaaatttggaggtccaactccagcatgatggaagcaatttgccaagcacgtccaactcgtttgtacagatgagtttttctgaagagagtgcaagtcagagtgcaaacttaagtggacttcacatggaatctacacacagaagcataaacaccacttcatgctctcaaccaatgtctactgggggctttgatgcagggatgtactcaaagttgccacgtttaaaagaatcccaaatcttgtctttgccagagattcataccaattccatgggaacatcagcttgcagtatggatgcaaccgagtacagccttgaccgaagtgcgaagccgatgaaaccaccagtgcggacatatacaaaggttcaaaagcaaggatcagttggaagatctatcgatgttacagggtttagaaattaccatgagttgagatctgccatcgcttgcatgtttggtctccaggggaaattggagcatcctggcagttcagagtggaagcttgtatatgtcgactacgaaaatgatgttcttcttgtcggagatgatccatgggagtaagtagacatgtcttcgaattggtgtctcctgttctttctactcctggtcagcatattaattgacactcatacctatgtgcttttgcttctacagggaattcatcaactgtgtccggtgcatccggattttgtcaccttcagaagtacaacagatgagcgagaatggcatgcatgttttgaacgactgtattcaagcagcttagtagtaccattttctggatgaagctctatatcgacatgaaggccacaagagaaatgcacatccgagaagctgtagttctctgaatgcgttgcattactgaatgttaagctgatttgttgacacttgacagtagtgtttgtggtagagacttacaggaaaaaaaaaggctcatcttttgcaagaagaccaggtaggaaagcccaagctgtggaaaatagtgtgcagtgattactcatgctttgatgcatttccaacttccactgtatgttgcgagctatgtcgaatcagaaacttatttggttccttacttcactcagtatacattcc

SEQ ID NO: 5511 - DNA, 3291 bp, Oryza sativa
  Predicted polypeptide sequence is orthologous to G447
ggggcgaccaaggtgaaccaggagctgtggtacgcgtgcgcggggccgctcgtctcgctgccgccgcaggggagcctcatcgtctacttcccccagggtcacagcgagcaggttgcagcatctatgcgaaaggacgcagatgcgcaaattccaagctatccaaatcttccatcaaagctgatatgcatcctccacagtgtcaccatgcttgctgatcctgacacagatgaggtttatgctcgaatgactctccagccagttagcaattgtgacaaggagacattgctagcatcagagcttgcgctgaagcaaaccaggccacaaacagaattcttttgcaaaacactgaccgccagtgatacaagcactcatggaggtttctctgtgccacgccgtgccgctgagaggatttttcctcgtcttgacttctccatgcagcctcctgcccaggaactgcaggcccgggatttgcatgataatgtttggacatttcgtcatatataccggggtcagcctaaaaggcatttactgactacgggctggagcctatttgtcagtggaaagagattacttgctggtgattcagtcttgtttattagggatgcaaaacagcagctcctcttggggatcagacgagcaaataggcaacctacgaacctctcatcatctgtcttatctagtgatagtatgcatattggaattcttgctgcagcagcccatgctgcagcgaataacagccaatttacaatatattataacccaagggccagtacttccgaatttgtgattccttttgccaaataccagaaggcagtgtatggtaaccaattatctcttggcatgcggttcagaatgatgtttgaaactgaagagtcaggaacaagaaggtacatgggtacaataactggtataagtgatctggatccagtaaggtggaaaacatctcattggcgcaatattcaggttgcatgggatgaagcggcaccaactgagagacgcaccagggtttccctctgggagatagagcctatcattgctccattcttcatctacccctcaccattattcaccgcaaaacgtccaaggctacctgggatgacagatgacgagactgaaatggacggtcttctcaagagggccatgccatgggttggtgaggagatttgcaagaaagatctgaatattcagaacagtgtagtgcctggtctaaatctagctcagtggatgaacatgcagcacagctcctcgcttcctggcacggttgtgcaaccagagttactaaactcattaagtggaaaacctgtacaaaatttggctgcagctgatttatcaaggcaaatcagttttcacccgcagttcttgcaacaaaacaacatccagttcaacactgcgttggtacctcaacaaaaccaacagacagaacaattagcgaaagttatccctacaccaaaccaattgggaagtgttataataccgcagaaggtggttcaggattgcaactctgaacaaaggcagcatgtggttactcaaccagtgcaaggcagccagccaaacataaacattccacagcctcagcttgttgttcaggctcagcttcagcaaccgcaagtcattctccaggcgcaactgcagcaacctcaagttgttgtccaggcccaactccagcaaacgcaaccttcggtccaaagtcacactgtcttacaaggaggtcttcaacaaatccagcttctccagcagcaacagccacatgtgcagcaccagcagataccgcaacagttacatcatcagcagcagcaaacacaacagttgcaacctgtccagcaggttcagcagtcagtacaggaacatcagcaaataaagatacaacctgttcatgtttccatggatgcaagtatgaatacgcaggtggcagatcatcaaatgaaactacaactactcaaggctttacagccacagcagcctctgatctcagagcagcagaagatgcttttggatttgcagcagcaagtgataaattcacagtcagctcctcagcagtgtgtacaggtaacaaaccaagctattagtttacataacagtaacactattcaatacccgacacagcaaaaggttcagtctcaccaagttcaagacttaactgggaatgtcattcctaattcaaaatcagacatcgctacttccatgggtgctagttctttgcatgtagctggtggacgccaattattgaagacagatgatgttccgtctacttcaacatcaccatccactaacagcaatcctgttcttctgcaatccatcccaagtagctccaagaaccaaagtttaactacagcaggaaagacatctcaatcatctgttgtgttgggtcctacgatcgaacaggacacaaagccatatcaaaatgtaaagcaaacagttatgattcccaagacgacagaacaaaggccagctactggacaagactgcataaataacaatcctcaaatggattacttggacacatcctcttcagctacttcggtttgcctttcccaggctgatggatcattgcaacaaaactttccaccttcatccttccaccagcatcacttgctaaaagacacagttccagatagcgagtttgaggttacagatccaagaaataaccttctatttggggtgaatattgatggtcaactgggtttaccacttaatgcagacctgcttgcgaatgacattggaaccgataaatacatggatcagttgccaggaaatggcatttctaacttcatttcatcaaaggattctcaacaagagttatcatcttcaatgatttcacattcatttggagttgctgatatggcattcaattctatagattctgcaatcaatgataccccattcttaaatagaaattcccggtctgcagcaggtcctgcacatcaacggatgagaacctacaccaaggtacacaagcgtggtgcggtgggaagatcaattgacatcaatcgatattctggatatgatgagctgaaacatgacgttgctcggatgtttggtattgaggggcagcttggtgatcaaaatagagttggctggaagctagtatatgaagatcacgagaaggatgttctactagttggtgatgatccatgggaggactttgtgaaatgtgtacgatgtatcaggattctttctccacaggaagaaatgcagatgagattagtcggcgactttggagacagctttctacccaaccaagcttgcagcagctctgatgggggtcatccctggaggataaccggcgactag

SEQ ID NO: 5512 - DNA, 2643 bp, Oryza sativa
  Predicted polypeptide sequence is orthologous to G447
cggtggtccaaatccaagggggactggttctccctctccatattctgcctatagaggttctggtggttcaccaagtccttatggagctccccgtggcaacccctatggaggccaagcctaccaggcaccgaatcgcaatgcttaccaacctccgactcagaaccaatatcagcaaccccagaatcagccgcagccgcaggaagaacagcctgctgaacagccgcagtaccaagaacagccgaacgattacgatcagcaattgcagcaacaacaagcgatgcagcagcaacagatgctcgctcagcaacaagcccaacagcaagccgctgagcagcagcgccaacaacagatgcagcaacagcagatgatgcaacagcagcaaatgctcgcccagcagcagcagcagcagcaagcgatgatgcaccagaaccagcccgaacaggcggcgagcgagtacgatggcggcaacgacgcgtctggcaaccaggcctacgaggacgcgcagtaccagcaggaccagcaggcgcaggacaattacgatcagcagcaacaagatcagcacctgcagaatcagcccgtcgacaaccattacgagcagcaacagcgctaatatgaccagcagcagcaaatcgctcagcagcagaatcaatacaatcagcctcagaatcaccaccagccggagccgcagtaccaagagcaaccgagtcagtacgatcagcaacaacagcagaattcgcaatacgagcaacagcagaacaaccagggcgcctatgctgatcagcagaatcagtttgaccagcagcctcaggccactcagtcgcaatacgaacagccgcagaatcaatacgaacaacagcaaccgcagaacaatcaataccagccgccaagccctcaccagcagcaaccgaacaatcagcctactcaacaacagccgcagcctgtgaacaaccagcagcaacagccgaaccaaccgacttcgcaccagggcggctaccagccaatgcatcagccaacgacgggctatggcggcggcgtgtcctcgccttcgactggcggcggctatggcggctatggcggctatggcggtggctctccgtctgcctatggtggctaccgtggtggcagcatgtacagcccgacgccgcgcccgaccgcgccgacaacgagcgcctatggcaactatggcgccccgcgtggcggcatgtcgcaccagtactccttccgcggcggaccgactggcaacgcctatggtggtggtggtggccagccgaacaactcggcgaacaacaatccgaatgccggcaatccaaatggcggcggcgcgaatccgtctggcaacaacaacatgcctgtcttgcccaaggcgccgaatatgccgcaggtgccgcagatcccgcagagcaatggctacaatagtccgcagcagaatcagtacaacgcgcaaaacaacgcgactgcgcagaacgatggatcctcgagcgacccttctcaacccacacaagaaggatctccacagagccactcgtcgaatcctcctccacgctcgatctctgtctcgcgcgagaatccaaattatgcgacgacccctaccggcaaccgtactgccacgcccagctatgcgactggaaatggcatccgaggcacgcagcctccaatgggcggcacccagacctatggcatgtacggcacggcgccgcgcccctccaccaaccagctcgtgcagcctgagccagcgcaggagccgccacaggacaaatcgaacgcctactccactgaatctgacgacaagagcaaccagccgactaagactgaaaaccgcaattctggtcctacgcttgtgagctcggcggacaaagggaacaaaatgaaaatgccgacgatgacgaagagcggtggcaacactggcagctcccagccactcgccaagccaatgaacaacaaaaacatctacaagattgtgattgttggaggcggtggcgttggaaagtcagccattactattcaattcattcaaggcttattcgtcgaagattatgatccgactattgaggactcttaccgtaaaacctgtactattgacggcctggttactgtgattgatattctcgacacggctgggcaagaggaatacgctgcgatgcgtgatacctacattgctggtggcgagagttttctgcttacctatgccatcaactctttacatagctacgaagaaaccgcaagtttttacaaacaaattttgcgaatcaaagactgtgactccttccctattgtgctggttgccaacaagtgcgatttggagaaacagcgtcaggtgcctgaagaacaagcgagacaacaagcgaagcagtggaaagttcaattttttgagacgtctgcctatatgaagatcaatatagaagagatattttttgaagccgtgcgagagattcgacgttacgacgcggccgctgagtcggcgaggaatggtggaaagcctccaaaatcgagttctggtggaaagaagccgtcctgtactttattttagaatcgacactgacacctgatgaatatctgatggtctgcacatagttcttgctcgttcccattttattgatgatatgatgtacatagtgctagtaataaatactgttcaatttccgt

SEQ ID NO: 5513 - DNA, 3086 bp, Oryza sativa
  Predicted polypeptide sequence is orthologous to G447
gacagcgccatggcttgccccaacggctactgacgcaaatcactccaacctccctctctctcgcgggtgtcgactcgtttctgcctcgctcatgctacgcccaagcctccacgtccacctgccctagtcctgccctcggcccctcgtgctctcgtgctctcgcaatcatgttgcccaacaacgcattccacatgcagccgcacatggctcagcagcagcagtcgcaacagcagcaacagcagcagcatccaggcgccatgcaaaacgccgccaactttgcaatgcagccttcggtctatgcacagcagcaatcgcagcagatgcagcctccgccatcgcaccaacagcagctccagcaacaccagcttcagcagcagcaccatcaacaccagatgcagcagcagcttcagcatcagcagcagcagcagcagcagcatcagcagcacctcgcacaacaccatcagcagcaaccgaatcatccacatcagcatcagcctcagccctcggtcgtctacgctggcggacctccttctgcggcctcggtgaaccaacccgtgcacatggcgaacccgtccgctggctcttccgcttatcaccccaccatgcagcagcaccaggcacagatggccaggatcgcacaggcgtctcagccacagctcggcaacccgcaacagcagcagcagcgtccaccccaaggctctgcactcacaccgcagcagcaccaacaccagctccaacaccagcagcagatgcagctcatgcagcagcagcagcagcaccaaatgcaaacgccgcagcaacagcaacacgccgctcagcaccaacaccagcaagtcatgttgcatcagcagcaacagcagcaacaacagcaacaacaacagcaacgccagcaacagcaacagcaacaactccatcatcctcatcagcatcccgcacagccccaaacaccgcagcctcagcagcctcagcagcagcatcagccgcagcagcacatgcccagtcactcgcaggtcacgctgcaatcccatcctcaggcgcagcaggctcagcaggctcagcaacagcaagcgcagcagcagcaagcatctctggccgcaccctcgctgcatcgtcaaaactcgctgccaccatctgcacagggacatcacagcaacaacaactcgcagcccaccaccgccaacaactcgcctctcccctcggcactcgcccatcgcgccgcacagcctggaccgcatcgtacgccgacgcccatctcgcatgccgctcatccgatgcagtccaccgcctcggccgcctcggcacctcccaacgccgcctcctccatgcccagcccacaggtcaacgctcccatgcccctccgccaagcttcggtgccgctcaatcatccaggacctcccactcccacgcacacccgccctccctcggctgcacccacgcccgcgctccagtccgccaatccaccggcgtcggccatgcccatgccgcgacccaacagcacctcgcccaacgcaagccagatgctccacaaagctgccgctcaagccttcgccacgcctgtcccggcaggcgccaacggtgcggtttcgatgggctcgtcgaacgtggatagcatggcgggcgcacccggcccgaatccgcatctccagtcgcacttcccaccgggagcgggcgtgctgaggctgctccaatactcggaagcgctagggagcggcgcgaatcggagcgacattgactactggcagacgtttgtcaacgagttctttgtgccgacgggcgtgtaccgtctgatcctctggaacgccacctcgcgcgaacaaaagggcttcgagatcccgacgtgcgtgctgccgcgcttcatgctgaccaactacgtctccggactgcgttcgtcgcagctgcagctcgagacgcctcgagagtaccagacgggctggccaccggtgaagccgctgccgcctctgccggcgtcgcacaagtttgtcaacagctttccgtcggccaacgtgacgcatcacgtggacacggagcaggcgacgtttgtgtcgagcttcgagagcggatggcaggtgcagatgtcgggacggctgcgggcgtcgtttgtgccctgggcgctcgagcagccgggcgaaccgggcaagatggatgtgcagctgcgtctggagtcgctcgacttcacggtgcatgcacatgcaggctatctgccacgcgtggccatccaaatgtccaaggtggatcacccgctgccctcgagcctggtggcgagcattcgaagcacatcggacaaggcggggagctcgcttcccaacggcaccaagaaggggcaggcgcgaggcactgcggctcgcaaggaagaggccaaggacgactcgaatcggggcgacgagggggcgccggcgatcaagctcgaggagggcacggggacgagctcggacgacgatgccaagagccagagcgggttcagcgtggcggtggaaaggacgttcgtgcccgactaccctgtcaacgagtatgggatcagcctgcgagccatgcggtgtctggagattacggagagcgtgtgccagctgcgcgatctgatcgacatgagcatgcgcgacaagctgggccccatcgatgcgctgcgcaagtttgcaggccagtatcgcgatatgcaatcgggccgagccacggcgcaagtgggagcagcgggcggcgcgctgggcgacgccaatggcaatggcaatggcaatgcagcgagtgctcagcagcagcagcagcagccagcggtcaactcggccgccacgccagggccgccgccgatgggacgatcgccaagcgcacacggccggccgctggagaacggaacgggctcgaaccatgcatctccagtggttgccaacggcgtgacgagcctgaagcgcaagggcaagacggcacccagtccgagtcccaagctggcggccaccgccaacccagccaagaggcaacggtgagccgccctccccccccaggctgtgttcgtttttgattgttctttgtacttgtatcctttgtcgatggtgtagcctgcaatttcccacgtcacctctgcccagagctgtattctc

SEQ ID NO: 5514 - DNA, 4166 bp, Oryza sativa
  Predicted polypeptide sequence is orthologous to G447
gggcttcctcctccacttgcttcgtcgtcgtcgtcctcctcctcctctctctactctctctctccgaaccatccttcccacccggcacgccgccgcgcgctgttcccgacggcggccggtggccggagtgagaggctgggtgtactgtccgctgatgctcgtgggaggcggcggcggcggcggcggcgtgtgatgagcggaggccgcgtgggcgagaacctgtcgcgtcggcacggcggcggcggcggtggcgagggctcgtcaggcttggccacgctttgctcccttcgcagtggcgctcccctggtgccgaatattatactcgccgccgcctcgtgccgcctactttaggcggaaagggggagagctctcctatcctagctgctgctgctgccactggctaagttggtaaaaggtggaggaggcggatattcgtgtatccggaggagagatttggatcgggatctcgccgggatgaaggatcagggatcatccggtgtgtctcccgccccaggggaaggggagaagaaagccatcaattcggagctatggcatgcttgtgccgggcctcttgtgtcgctgccgccggtgggcagtctcgtcgtgtacttccctcagggtcatagcgagcaggttgctgcttccatgcacaaggagctggacaacatccctggttatccctctcttccgtctaagctgatctgcaaacttctgagtctcaccttacatgcagattctgaaactgatgaagtttatgctcagatgacacttcaaccagtcaataaatatgatcgagatgcaatgctggcatctgaactgggcctgaagcaaaacaagcaaccagcggagttcttttgcaaaacgctgacggcgagcgacacaagtacccatggtggattttcagtgccacgtcgtgcggcggagaagatatttccaccactagactttaccatgcaaccaccagcacaagagctcatcgccaaggatctgcatgatatttcatggaaatttcgacacatttaccgaggtcaaccaaagaggcaccttctgacaactggttggagcgtctttgtcagcacaaaaaggcttctagctggtgattcagttctgtttataagggatgagaaatctcagcttctattaggcatacgtcgtgctaccagaccccaaccagctctatcgtcatcagttctatcaagtgatagcatgcacattgggattctagctgctgcagcacatgctgctgcaaacagtagcccatttactattttctacaatccaaggtattatagttcttacttgatatcccattatcccaatgcactctctgctaccctttgggactatgaactcattgttgttattctgatagggcaagtccatcagaatttgtcattcctttagcgaaatataacaaggctttgtatacacaagtatctcttggaatgcggttcagaatgctgtttgagacagaggattcaggggttcgaagatatatgggaacaatcacaggtattggtgacttggatccagtgcgctgggagaactctcattggcgaaaccttcaggttggttgggatgaatcaacagcatctgagaggcgcactcgtgtttcaatatgggagattgaaccagtcgcgacacctttttatatttgtccaccaccatttttcaggccaaaacttcctaagcagccaggaatgccagatgatgaaaatgaagttgagagtgctttcaaaagagccatgccatggcttgctgatgactttgccctgaaagatgtgcaaagtgcattatttccaggtctgagcctagtccaatggatggctatgcaacagaatcctcagatgctaacagctgcgtcccaaacagtgcaatcaccgtacttgaactccaatgcattggctatgcaggatgtgatgggtagtagcaacgaggacccaacaaaaagattgaacacacaggcacaaaatatggttttacctaatttacaggttggctcaaaagtggatcaccctgtaatgtctcaacatcaacagcagccacaccaactatcacaacagcagcaggtccagccatcgcagcaaagttctgtggttttacagcaacatcaagcccagttgctgcagcagaacgccattcacttgcagcagcagcaagaacatctccagcggcagcagtcacaaccggcacagcagttgaaggctgcttcaagtctgcattcagtggaacagcacaagctgaaagaacagacttcaggtgggcaggttgcctcacaagcacaaatgttaaaccagattttcccaccatcttcatcgcagctacaacagttaggtttacccaagtcacctactcatcgccaagggttgacaggattaccaattgcaggttctttgcagcagcccacactaactcagacatctcaagtccagcaagcagccgaatatcagcaggccctcctacagagtcagcaacagcaacagcaactgcaactgcaacaactatcacaaccagaagtacagctgcagctgcttcaaaagattcaacaacaaaacatgctatctcagctgaacccacaacatcagtcccagttgattcaacaattgtctcagaaaagccaggaaattctacagcaacaaattttgcaacatcaatttggtgggtctgattctattggtcaactcaagcaatcaccatcgcagcaagctcctttaaaccacatgacaggatctttgacgccccagcaacttgtcagatcacattcggcacttgctgagagtggggatccatccagttcaactgctccatccaccagccgtatttctccaataaattcgctgagtagggcaaaccaaggaagcagaaatttaactgacatggtggcaacaccacaaattgacaacttacttcaggaaattcaaagcaagccagataatcgaattaagaatgacatacagagcaaagaaacagtccctatacataaccgacatccagtttctgatcaacttgatgcatcatctgctacctccttttgtttagacgagagcccacgagaaggtttttccttccctccagtttgtttggataacaatgttcaagttgatccaagagataactttcttattgcggaaaatgtggacgcattgatgccagatgccctgttgtcaagaggtatggcttcaggaaagggcatgtgcactctgacttctggacaaagggatcacagggatgtcgagaatgagctatcatctgctgcattcagttcccagtcatttggtgtgcctgacatgtcctttaagcctggatgttcaagtgacgttgctgttactgatgccggaatgccaagccaaggtttgtggaataatcaaacacaacggatgagaactttcactaaggttcaaaagcgtggttctgtggggagatcaattgatatcacaagatatcgagattatgatgaacttaggcatgatcttgcatgcatgtttggtatccaaggtcaactcgaagatccatataggatggattggaagctagtctatgttgatcatgagaatgatatccttcttgtcggcgacgacccttgggaggaatttgtgggctgtgtgaagagcatcaaaatactctcagctgctgaagtacaacagatgagcttggatggtgaccttggtggcgtccctccacaaacacaggcctgtagtgcctctgatgatgcaaatgcatggagaggttgaggttcctgacagtaaatactaaattatccttaccattctttttaaggatacttgagagactcaaggatcaaatacacacctagggatctagagccaactcactgacaaattgatcaaaatgcttcgattaggcggaggatgttcagtgaaccgccttgttatggagctcttgacattttgttcacactaaaactggcaacctatcctcatagtcagattaatttcttcttttcttttcggcatacagaactgattttcagtttcataagctacctatgtttatctgggacttgttcattgtaatcttacaagttcataaacaatctgaccgtatatacatgctgttgtatctcccaatgtaatactcggatgattctattggtgtttacactacagaagtaaaaagttgtatggccaaaggcgttctattgtctg

SEQ ID NO: 5515 - DNA, 3550 bp, Oryza sativa
  Predicted polypeptide sequence is orthologous to G447
gtcagcatcaccaccaccctactctctctctctagctagggttgcgctgcttcggtctcggtcttggcgccgcctgcctcgcccttcttgctcgcccctgctcccctgtccctctcgtgtcggggcgacggacggacatcctcacccgcgcgcacgtacgggtgatcgatcgattgattcctgctccgacgaagacggcggcggcgccggtgacctcgccggacatgcgcggggcccgctgaggtctttgttgccggcgaaaggggtggagtgattgactcggtcggtgtctgcctgtctggtctgaggtcatgatgaagcaggcgcagcagcagccgccgccgccaccggcgagctctgcggcgacgacgaccaccgcgatggcagccgctgcggcggcggcggtggtggggagcgggtgcgaaggggagaagacgaaggcgccggcgatcaactcggagctgtggcacgcctgcgcggggccgctggtgtcgctgccgccggcgggcagcctcgtcgtctacttcccccagggccacagcgagcaggttgcagcctctatgcaaaaggatgttgatgcacatgttccaagctacccaaatctgccttcaaagttgatttgccttctgcataacgtcactttacatgcggacccagaaacagatgaagtgtatgcacaaatgactcttcagccagttacttcatatgggaaggaggccctgcagttatcagagcttgcactcaaacaagcgagaccacagacagaattcttttgcaagacactgactgcaagtgatacaagtactcatggaggcttctctgtgcctcgtcgagctgcagaaaagatatttcctccactggacttctcaatgcaaccacctgcacaagaactacaggccagggatttgcatgataatgtgtggacattccgtcacatatatcggggtcagccaaaaaggcatctgcttaccactggctggagtctatttgtaagcggcaagaggttatttgctggagattctgtcatttttatcagggatgaaaagcagcaacttctattaggaatcaggcgtgctaaccgacagccaactaacatatcatcatctgtcctttcaagtgacagcatgcacatagggattcttgctgctgcagcccatgctgctgccaacaatagcccatttaccatcttttataaccctagggccagtcctactgaatttgttatcccatttgctaagtatcagaaggcagtctatggtaatcaaatatctttagggatgcgctttcgcatgatgtttgagactgaggaattaggaacacgaagatacatgggaacaataactggcataagtgatctagatccagtaagatggaaaaactcgcagtggcgcaacttacaggttggttgggatgaatccgcagccggtgaaaggcgaaatagggtttctatctgggagattgaaccggtcgctgctccatttttcatatgtcctccaccattttttggtgcgaagcggcccaggcaattagatgacgagtcctcggaaatggagaatctcttaaagagggctatgccttggcttggtgaggaaatatgcataaaggatcctcagactcagaacaccataatgcctgggctgagcttggttcagtggatgaacatgaacatgcaacagagctcctcatttgcgaatacagccatgcagtctgagtaccttcgatcattgagcaaccccaacatgcaaaatcttggtgccgccgatctctctaggcaattatgcctgcagaaccagcttcttcaacagaacaatatacagtttaatactcccaaactttctcagcaaatgcagccagtcaatgagttagcaaaggcaggcattccgttgaatcagcttggtgtgagcaccaaacctcaggaacagattcatgatgctagcaaccttcagaggcaacaaccttccatgaaccatatgcttcctttgagccaagctcaaaccaatcttggccaagctcaggtccttgtccaaaatcaaatgcaacagcaacatgcatcttcaactcaaggtcaacaaccagctaccagccagcccttgcttctgccccagcagcagcaacagcagcagcagcagcagcaacaacaacaacaacagcaacaacaacaaaaattgctacaacagcagcagcaacagcttttgctccagcaacagcagcaattgagtaagatgcctgcacagttgtcaagtctggcgaatcagcagtttcagctaactgatcaacagcttcagctgcaactgttacaaaaactacagcaacaacagcagtcattgctttcacaacctgcagtcacccttgcacaattacctctgatccaagaacagcagaagttacttctggatatgcaacagcagctgtcaaactcccaaacactttcccaacaacaaatgatgcctcaacaaagtaccaaggttccatcacagaatgatggacttctacatcaaaatttccctatgtccaacttcaaccagccacagatgttcaaagatgctcctcctgatgctgaaattcatgctgctaatacaagtaacaatgcattgtttggaatcaatggtgatggtccgctgggcttccctataggactaggaacagatgatttcctgtcgaatggaattgatgctgccaagtacgagaaccatatctcaacagaaattgataatagctacagaattccgaaggatgcccagcaagaaatatcatcctcaatggtttcacagtcatttggtgcatcagatatggcatttaattcaattgattccacgatcaacgatggtggctttttgaaccggagttcttggcctcctgccgctcccttaaagaggatgaggacattcaccaaggtatataagcgaggagctgtaggccggtccattgacatgagtcagttctctggatatgatgaattaaagcatgctctggcacggatgttcagtatagaggggcaacttgaggaacggcagagaattggttggaagctcgtttacaaggatcatgaagatgacatcctacttcttggcgacgacccatgggaggaatttgtcggttgcgtgaaatgcattaggatcctttcacctcaagaagttcagcagatgagcttggagggttgtgatctcgggaacaacattcccccgaatcaggcctgcagcagctcagacggagggaatgcatggagggctcgctgcgatcagaactccggtaacccttccaatggttcatatgaacaattcgaatgaccaaattcaccagtccatattgtcatgctgcgccggtgtaagtagacaatcaccggagtgttgttgtagatgttatcagcttacatccgggagcgcaaatggctcggcggatcagtagtgttttttttgtctatatgtgtagtttctcacacatcaaaagggagtagggatggtaaatgaaacttacctagagtttcttaaggttaggcgaaagatgattgtactgttggaaaggcagttctgtagtaaaatgattcttctcc

SEQ ID NO: 5516 - DNA, 1548 bp, Oryza sativa
  Predicted polypeptide sequence is orthologous to G447
tcgcctcaaacctcaattcgacaaatccatctcccgctccacccaaaacccctcgtcctctctcccggcgacaatggcggcggcggcggcgccgctcgccgacgacggcgacgggatcgtagaccgtggcatgtggctcgcatgcgccgccccgaactccggccgcctccccgccgtcggctcggtggtcttctacttcgtcgacggccacgccgctcagttttgccagttccccgcccctctcctggagcagctcgccgtccccggcccccgcgtcttcctctgtacggtggccgccgtccgcctccgcgccgacgccctcaccaatgaggcctacgccgagatcaccctcgacccggtcgccgaccacgacgtcccgcgcctggcccccgctcccgctcccgcacccgccgccgccgccggtggccagcagttgcgttacttcgtcaagacgctgatgatttccgacttcgacttccgcatccgcttctccgcccccatggctgacgccaaaggcgtcttcccgccgctggtcgacgccaaagcggtccagcccctcctcgtcaaggacctccatggatctccgatgacgttcgactacggcaggaagggcaagagagtcacgctcgccaaggtctggaagaaatttcgggacgacatggacttcgtcgacggagacagcgtcatcttcatgcgtcgccgcgacgacgacgacgacgacggcgagctgtacgtcggggtgcggcgccagcgcacgctcgaaaggccactcaggaatacgatgcgccggtacaggcctccgaccccgccccaggcggccgtgcaggaggcggtactagccgcggcgggtcacgcggcggccggcgagcggttcacggtggcgtaccggtcgcggaaggacggcgacgagttcgtcgtgccacgcgaggcggtggaggaggggctccgcgccagactcacctcgctggcggaggtggagtttgtgtgggccgtcgaggacggcgcgccgcccgtcgtcgggccacggggcaaggtcaccgccattgccaccggacagctgtggcgaaatctcgagattgtatgggatggaaactcggagatggacatgagtgccaacttttggcaagttcgacctgttgaggaagttgatatttctccttctactcctcctccgaagaggctcaagaattgtgagattgatgataccgcctctacttctgtttccgtcgacaatggagatgagcaagttccaacgatgaggcaacggctagaggcgctgattcctgataacatctgaggccaagtacacctgcttgtgactaactcaagtaaaaattagttctgtcacttgcgagttgtgactttgtgagattgggtccgtcatgaatcagctttggtctgcatttagtttgaaggttattccgaatagtttcaaaattcggggaacaagtttgcagtgttaaatgtccattctaaatctgacggaataggaaaatggtgtacctgaaatctgatatctgaagaacacgaacagttcagatcgagatg

SEQ ID NO: 5517 - DNA, 2289 bp, Oryza sativa
  Predicted polypeptide sequence is orthologous to G447
atggcggcggcggcggcggcgctcgccgacgacggcgacgggatcgtagaccgtgccatgtggctcgcatgcgccgccccgaactccggccgcctccccgccgtcggctcgatggtcttctacttcgtcgacggccacgcagagcagttttgccagttccccgcacctctcctggagcagctcgccgtccccggcccccgcgtcttcctctgtacggtggccgccgtccgcctccgcgccgacgccctcaccaatgaggcctacgccgacatcaccctcgacccggtcgccgaccacgacgtcccgcgcctgctccccgctcccgctcccgccgccgccgccggtggccagcagcagcagttgcgttacttcgtcaagacgctgatgtcttccgatgccgagtaccgagaccgcttcgccgtccccatggatgttgccaaggacgtcttcccgccgctggtcgacgccaaagcggtccagcccctcatcgtcaaggaccttcaaggatctccgatgacgttcgactacggcaggaacggcaacagggtcacgctcgccaaggtctggaagaaatttcgggacgacatggacttcgtcgacggagacagcgtcatcttcatgcgtcgccgcgacgacgacgagctgtacgtcggggtgcggcgccagcgcacgctcgacaagccactcaggacgcgccgatccaggcctccgacaccgcttccggtggccgtgcaggaggtgatagctgcagcgggtcgcgcggcggccggcgagcagttcactgcgacgtaccgctcgcggcaggacggcgacgagttcgtcgtgccacgcgaggtggtggaggaggggctccgcctccgctccagattcactcccgagatggaggtggagtttgtttgggcccttgaggatggcgcgccgcccagcgtcgggccacatggcaagatcaccgccatccacgacactacatggatgtggcgatcagtcgagattggatggacgggaggttcagagatgaacaagtacgccaacttctggcaagttcgattggttggttcggacgattttgcttctgctgctcctccccctcctctttctccaaagaggctgaagagttcagagcagtgcccgtcgcgtccaccagagccccttccaggcagggtgtttctatgtaaagtcacagctgtccgcttggatgcaacaagaaatgagctctttgcgaccatgtccctcatcccagtcgccagagaccaagccatccagcctcaggcgcccgctgatccaggtccaagctcccctcaagtgcagactactcttgtttcatttgtgaagcctctcacgtgcaccgatgctgtcaagaatcggtatcggttcatagtgcccaagagagagaccgccatgggtgttctaccccagctccaattgaacgaacacgtgccgctctatatcaaggacatgcacggaaaggagtgggtgattaattatacatggaaagagtacacccacatgctttccagtggctggataaaattcgcgaatgccaaccgccttgtcacaggtgacaacgtagtgtttatgcgcagcatggacagtggcgagagatacatggggctgcgtcgcaccctcaagccggagccagtgtcagttgacgaagtgattgaggccgtatggagggcggcgcgtctcgagccgttcgaggtgacctacctctcgcgccaggacggcgacgagtttgttgtaccgtgtgggattgtacataatgctctacgagcgaagtttaccccaggaatggtggtaaacttcgtatgggctgttgaggaggacaggctgccgaatgttgggccacagggaaaggtcattgccatagagaactatgcaacctcaatctggaggatgattcaggttgagtggccatcctgtgcaggaatgaacagatatgttaatttttggcaaattcgtgaagttcttggagagagttcctttgaggcatccacttgcattgtgagaagtcaagattactcgccggcaccacagaggaatttagttaatgcgcttcagcttcctgacggaacaaaacagcttcagcaaaacaagaagtctgtttcctcgtcatccaccttccgactctttggcaaaaaaatgacacctggcgtgccaccaagaagagacaccagtggtctttctggacaggtatcattattcagccattatcttccccatgatgaggacgatggacaagttccaacgatgaggcaacggctagagacgctgtttcctgataacatctga

SEQ ID NO: 5518 - DNA, 3420 bp, Oryza sativa
  Predicted polypeptide sequence is orthologous to G447
atgaagcagcagcagacgccggcgagctccgcggtgaccgcggcggcggcggcctcctcctccgccaccgccgccgtggccgcatgcgaaggggagcggaaggcggcggcgatcaactcggagctgtggcacgcgtgcgccggcccgctcgtgtcgctgccgccggtgggcagcctcgtcgtctacttcccgcaaggccacagcgagcaggttgcagcttctatgcaaaaggatgtggatgcacatgttccaagctacccaaatcttccctccaagttgatatgtcttcttcacggtgtcaatttgcatgcagacccagatactgatgaagtttatgcacagatgactcttcaaccagtgaatacatatggaaaagaggcgttgcaaatatcagagcttgcactaaaacaagcaaggccacaaatggaattcttctgtaagacactcaccgcaagtgatacaagtacacatggaggattctctgtgcctcgccgtgccgcagagaagatattccctcccctggacttctctatgcaacctccagctcaagaactgcaagctagagatatacatgacaatgtgtggacatttcgtcatatatatcgaggtcaaccaaaaagacatttacttactactggttggagccttttcgtgagtggcaagaggttatttgctggtgattctgttattgttgtgagggatgaaaagcatcaacttctactaggaatcaggcgtgctaacagacaaccgactaatatatcatcttcagtactttcaagcgacagtatgcacataggagtccttgctgcggctgcccatgctgctgccaacagtagcccttttaccatattttataaccctagggccagtcctactgaatttgttatcccatttgcaaaataccagaaggcactgtatagtaatcagatatctttaggaatgcggtttcgcatgatgtttgaaaccgaggaattaggaacaagaaggtacatgggtacaataactggaataagtgacctagatcctgtgagatggaaaaactcccaatggcgcaatttacaggttggctgggatgagtctgcagctggtgaaaggaggaacagagtttcaatctgggagattgaaccggttgcagctcccttttttctatgtccccaacctttttttggtgtgaagcgccccaggcaattagatgacgagtcagagatggaaaaccttttcaagagggcaatgccttggcttggtgaggaggtatgcataaaggatactcaaaaccagaacagtacagcacctggtctaagtttggttcagtggatgaacatgaacaggcagcagagctcatcattggctaacaccgctgcgcagtctgagtacctgcaagctctaggtaaccctgccatgcaaaaccttgctgctgatgaacttgcaaggcaactatatgtccagaacaatctccttcaacagaactgcatacagtttaattctcccaagctccctcagcaaatgcaaaccatgaacgatctgtccaaggcggcaattccgttgaatcagcttggtgctatcatcaatcctcaagatcagaaacaagatgctgtcaaccatcagagacagcagaactccatacaagtgattcccctgagccaagctcaatctaatctcgtccaggctcaggtgattgttcagaatcagatgcaacagcagaagccatctccaactcaaaacccgcaaaggattaatggccagcggctgcttttgtctcatcaacagaaggatcaaaatttacagctgcaacagcagcttttacttcagcaaaaacaacagttacagcagcagcagcagcagcaacaacagaatcagcagcagctaaataagtcccttggacagttggtaaatctggcaagtcagcagtctaagttgtttgatgaggagcttcagttgcagatattacagaaactgcagcagcaatcactgatgtcacaatccacatcaacactctcacagccacctctgatccaagaacagcaaaagttaatcacggacatgcaaaagcagttgtcaaattcacattcacttgctcagcaacaaatgatgccccaacaagaaatcaagccttcattgcaagcaacaccattgctacccacggtccagcaagagcaacagcagaagcttttacagaaacaagtctcacttgcagatgtgtcaggagttgcttttcaaccaatttcatcaaccaatgtgatccccaaaactggaggtgctatgatcatttcgggtgctacacaatctgtagttacagaggaaatgccctcttgttcaacatctccatccacagctaatggaaaccactttacacaatcaaccaaaaacagacattgcatcaacacagaaaggctgccaccgtccactgctccaatgttgatcccaacctccattgacgctgtaacagcaactccactaatgaccaaggaattgccaaagccgaataataatgtgaagcaaagtgttgtcaactcaaaattaccaaatgttgctcctggcccacaaaattgtataaaccatgcattgcaaacagacaacttggaaacatcttcatcagcaacttcattatgtccttcccgaacagatggacttgtgcatcaaggtttcccctcttctaacttcaatcaacaccagatgttcaaagatgcacttcctgatgtagaaatggaaggtgtggatccaagtaacagtggcttgtttgggatcaacaatgataacctgttaggattcccaatagaaacagaggacttgctgataaatgcacttgattctgtcaagtatcagaatcacatatcaactgatgttgaaaacaactacccgatgcaaaaggatgctctgcaagaaatatcaacctccatggtttcccagtcatttggtcagtcggatatggcttttaattccattgattctgcgatcaatgatggtgccttcttgaacaaaaattcctggcccgctgcccctctgctgcagagaatgcggacattcaccaaggtgtacaaacgaggagctgtaggccggtctattgacatcggcaggtactctggatatgaagagttgaagcatgctttggctcgcatgtttggtatagagggtcaacttgaagatcgacagagaataggctggaaactggtctacaaggatcacgaggatgacatcctgcttcttggtgatgacccatgggaggagtttgtgaactgtgtaagatgcattaggattctatcacctcaagaagtgcaacagatgagcttggatggtgatctggggagcaatgtcctccccaaccaggcttgcagcagctcagatggggtgaatggttggaggcctcgctgtgaccagaaccccgggaacccttccatcggcccgtatgatcaattcgaatga

SEQ ID NO: 5519 - DNA, 600 bp, Oryza sativa
  Predicted polypeptide sequence is orthologous to G447
ttctgaacaaaaattcctggcccgctgcccctctgctgcagagaatgcggacattcaccaaggtgtacaaacgaggagctgtaggccggtctattgacatcggcaggtactctggatatgaagagttgaagcatgctttggctcgcatgtttggtatagagggtcaacttgaagatcgacagagaataggctggaaactggtctacaaggatcacgaggatgacatcctgcttcttggtgatgacccatgggaggagtttgtgaactgtgtaagatgcattaggattctatcacctcaagaagtgcaacagatgagcttggatggtgatctggggagcaatgtcctccccaaccaggcttgcagcagctcagatggggtgaatggttggaggcctcgctgtgaccagaaccccgggaacccttccatcggcccgtatgatcaattcgaatgacctgacttagaggttcattcacatatgaaatatttgacatccctgtcttattttgcgtccattatgaattcagaatgggatcagaagagatgcaatggctacaaaaacccagcataactatcatcaaatccgtggcctaaaaggctat

SEQ ID NO: 5520 - DNA, 385 bp, Oryza sativa
  Predicted polypeptide sequence is orthologous to G447
tcgtactgctgaattaattggaaatacatattcacaattaaatggtggtcaaacaccaacaacaccatcaccagcaaatacaacaacaggttctactgatacaacaacaacatcaactacagatcaaacaacagcaacaacaaccactgcacaatcatcgtcaacaacaagtggtgatgttcttccatggacagtaaacaaattctacaatgttggcgatcgagttagttatcaaaacaaaatctatcaatgtatcgaagcacatacatccctatcaacatggacacctgatgtcactccagcattatggaaacttatttcatcttaaaaagtgtttctgttttgaaagaattcaatcaataaacatggatttcagtgtaaaaag

SEQ ID NO: 5521 - DNA, 580 bp, Oryza sativa
  misc_feature (45)..(45): n is a, c, g, or t
  misc_feature (81)..(81): n is a, c, g, or t
  misc_feature (90)..(90): n is a, c, g, or t
  misc_feature (196)..(196): n is a, c, g, or t
  misc_feature (274)..(275): n is a, c, g, or t
  misc_feature (281)..(281): n is a, c, g, or t
  Predicted polypeptide sequence is orthologous to G450, G456
tggcgcctgtgagaagtgttgttctacgttgggctttcacccaancctggccaaaggatgggctttattctggagagccgnccaaagganggctgcaataatggtgcgtgacttgatgaagaccataggatggaggactggagtgcttgtgttggccgatgtttccactggggagaatcgttgtcccacaactctntgtcgcagactcaggatcatgaaaggttcagatgcaattggacttgctcacaagggcagttgataagtccctaatatnnccgcantactagaatggtttctggccccacaagtcaaaagccaagatggagtatcaaatgactgtagggaattttgctgaaaaccaagaagtgctgaacacgttttaagatggagtgctgcgccttatgggctgtactacactggtttgctattggtgaaagttaaaaaaaaaaggtgtcttgttatgttagcttcgccaaatctccctagggacataaactctatttggattgtgcccaagtcgtttgtacgtgtgttaatgctattcgtgtaaatggtttggtaaaaaaaaaaaaaaaaaaaa

SEQ ID NO: 5522 - DNA, 1118 bp, Oryza sativa
  Predicted polypeptide sequence is orthologous to G450, G456
attttgctttgctttctttgctttcctctcctctctcgccgcccacctcgccgtcgccgccgccgcgagggccaacgccggcgaagtccgcgagccgaagcatcacacagctgcgccagcgatgtcggtggagacggagcggagctccacggagtcgtccgccgcgtcggggctcgacttcgaggacaccgccctcaccctccgcctcccgggctccctcgccgccgccgccgcacctgaccccgaccgcaagcgctcctccccctcctcctccgacgccgccgacgccgcagacaactcctcccccctcgccgccgccgccgatgctccccctgctcccaaggcgagggtggtggggtggccgccggtgaggtcgttcaggaagaacgcgctggcggccaagttcgtgaaggtggccgtggacggcgcgccgtacctgcgcaaggtggacctcgaggcctactccggctacgaccagctcctccgcgcgctccaggacaagttcttctcccacttcaccatccggaagttcgccgacgacgagaggaagctggtggacgcggtgaacgggacggagtacgtgccgacgtacgaggacaaggacggcgactggatgctcgtcggcgacgtcccctggaagatgtttgtggaaacttgccagcgccttcgtctcatgaaaagttcagaggctgtcaacttagcaccaagagccgctcaatgaggcattcccggtgcccatgaccgtgtggttggattgaaagaaagtggaagctttgccccgccgatgttcgcccacgtgtgatatgaacatgtacagttgtctcctactacttttggttccttgatgatgctgagttgagaaaaaggttgtagtttcgttactcgtctgtagtctctccatatatagataatgaagcactgaagcttgaaatatacacctacagtttgtctctttatgaataagaccatatacgcaaaaaaaccgatgttctttgctgcggctcgcgtgtcgtcaggctatatgcagttttttgtcgcaccataggcgatggacatctctggccttatactttcgtaaaaatcttatcatgttaagcgatggtcttgctttggagttc

SEQ ID NO: 5523 - DNA, 1204 bp, Oryza sativa
  Predicted polypeptide sequence is orthologous to G450, G456
gatataatctcctccgccgccgcacctcgcagagagagagacgccgccgccgtcgccgccgccggcgaccggagagaaagagagagaagagcaacgcccacggcttcgccgccgctgccggcgaccatgtcggtggagacggagcggagctcgacggagtcatcggcggcgtccgggctcgacttcgaggacaccgccctcaccctccgcctcccgggctcctcctcctcctcctcctcctcctcgtcatcctcctcctcctcgtcgccgtcggagcccgaccgcaagcgcgcctccgccaccgacgacgaccccgacaaccgcctcggctccaccgccaccgagtcccccccttcccccaaggcgcgggtggtcgggtggccgccggtgcgcgcgttccggaagaacgcgctcgcggcgttggcggcggcgtcctccagcaaggccaagttcgtgaaggtggccgtcgacggcgcgccgtacctgcgcaaggtggacctcgaggcgtaccggggctacgaccagctgctcgccgccctccaggacaagttcttctcccacttcaccatccgcaagctcgggaacgaggagatgaagctcgtcgacgcggtgagcggcaacgagtacgtgccgacgtacgaggacaaggacggcgactggatgctcgtcggagacgtcccctggaaaatgtttgtggagacctgccaacgtcttcgtctcatgaaaagctctgaagcagtcaatttagcaccaagatctgcttgatgagtcgcaaatctctgctcctgtctttgagaagcatgagaggaagccatctttgcttgctgaggtttttccatgtctgtgagagaaatgtgtacagtcatcgacttcgacttttggttccatcgtgctattgagtttcagaaaagaaatggtttttagcttgtagctttgttaccagtcagtagtctctccatatagatgagcgaagcggtgatgctttaaaatacacccatagattgttttctcgataaataaaattggtctcactcactgagcccctgttcttcgacatgctttctaccactagtttgttcgataatgtgatgtgcatgtgaggcctgtgatggtgcaagaatcatataacttgtcatgttaataactattttgttgtaagattatgtttactgcatggtgttataagctatttaaagtttactcc

SEQ ID NO: 5524 - DNA, 1097 bp, Oryza sativa
  Predicted polypeptide sequence is orthologous to G450, G456
gatctcatcacagccaacgcatcgtcttccttcttcgtcgtcgatagatcggctctcgagctcacaaccacatcgatcgtctccggcaagccgacgtacgtacgactagctagctagagaggaagcgagaaatggaagccgccgtggggtacgccgccgacagcctcatcaaggccaccgagctcaggctgggcctgcctgggacagccgacgacctgccctccacgcccaggggcaagaagcgcgccgccgcggcggaggacaacaacgccaacgccgccgccgccgacgacgacgagcacgacgccgtcgaggccgcgccgccggtagccaaggctcaagtggtcgggtggccgccggtgaggtcgtacaggaagagctgcttccagcaacagtcagcggcggcgagcaagagcaaggccgccgtgagcagctgcaacaacaaagacgagcccatcaccaagaacgcggcgccggcgccggcagcctcctcggcggcggcggccaacggcgggtcgctggtgaaggtgagcatggacggggcgccgtacctgaggaagatcgacctgaggatgtacaagggctacagggagctccgcgaggccctggaggccatgttcgtctgcttctccggcgccgccgacggtgccaacccgtcggagttcgccatcacctaccaggacaaggacggcgacctcatgctcgtcggcgacgtccctttcgacatgttcaccagcacatgcaagaagttgaggatcatgaagagatctgaagccacagggctaggatcaccaaggcaaatgaagatctaatctaagagcgacaagagatcgatcgatgcattccatcaacttttcatttctttttattttttttcctcccaagccaaaaaggagatgagcttgggggcatcaaagcaaacacatggatgtgcttctgctttgtttccatctttaaaaactagtaggttttaattttatgattttagcagcacaaaggagatgtggagatttgggttcaactctccatgtgtatgtacaaacgaaacagttattatatattgattgttggttactactactatactacttcaaacc

SEQ ID NO: 5525 - DNA, 1230 bp, Oryza sativa
  Predicted polypeptide sequence is orthologous to G450, G456
gaccaccacacccctcgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgacggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagatgttcgtcgagtcctgcaagcggatccgtctcatgaagagctccgaggccgtcaacttatcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatcgttgttgttgctgttgttgactttgttctgtccattgatgcattgcaaggtcaaatataggagcacaataatctgcc

SEQ ID NO: 5526 - DNA, 1545 bp, Oryza sativa
  Predicted polypeptide sequence is orthologous to G450, G456
ggctcctttacatcacatttctagccaccctctcatcatcaccatcaagctcaaaccaacaagaagagagctagcttttggtactattagccactagtagatagccaagaagaaaccaagaaattctttgagctatctaattagctaggtccattgattcatcatcatctccattgatccacttagctttgaagaagaagaagaagaagacatttagttagctagctatattgaggtgaggtggcggcggcaatggcggcggacctggccttcgaggcgaccgagctccggctcggcctgcccggcggcggcggtgatggagacgccgcggcggcggcggcgaggagctcctccgggaagaggggcttcgccgagaccatcgacctcaagctgaagctggagccggcggccgcggcggtggacgacgacgacgacaaggaggaggcggcggctgacgaccgggagaagaaggtcgacatcgtcggagctgacaacgacgacgcctcgccgccggccgccgccgccgccggcgggatgaagcggtcgccgagccagagcagcgtcgtcaccgccgccgccgaccccgagaagccaagggctcccaaggcacaggtggttgggtggccgccggtccggtcataccggaagaacatcctggccgtgcaggccgacaagggcaaggacgccgccgacggcggcggcgacaagtccggcgccggcgccgccgccgccgccttcgtgaaggtgagcatggacggcgcgccatacctgcgcaaggtggacctcaagatgtacaagagctaccttgagctctccaaggcactcgagaagatgttcagctccttcaccattggaaactgtgggtctcatggggtgaacggcatgaacgagagcaagattgctgatctgctcaacggctctgaatatgtgccaacctacgaggacaaggacggcgactggatgctcgtcggcgacgtcccatgggagatgtttgttgaatcatgcaagcgccttaggataatgaaaggatcagaagctattggccttgcaccgagggcaatggagaaatgcaagaacagaagctgagaaagaagaacatgtcgccatcaaaaacggatggatcatcatcagatgcaacaatctatctatagcttttcttaattgcagctttgcctcatccctgtatcatactcgcttgctgtcctcatctccaagtctgtacctttcctgatcagtgaaagtcattttggtgttgtggtcagtttctgttctgttgcagtcattaagttcctaagtgtgtcatcttgtcttatacataagaaagaagccaagaacatgtaccagtagtacctgtcccataattatgtcttttttgctctccctgttcttccctttctatctgtttttttttaccttaatggcacaaaatgtaaaggcaccctgctcaaagggacctcaatgtattttgtccatgaaaaggttgtttaattatcttcatggtgtatccatcaaacaaataattattactgcaaggtgttatgtgtt

SEQ ID NO: 5527 - DNA, 1241 bp, Oryza sativa
  Predicted polypeptide sequence is orthologous to G450, G456
accaccacacccctcgtctccgcaaactcgacgcgccactcgacagcgaccccgcagccgatccatcccgccgccgaagcagcagcaaccgccacggtgcgccgccgccgccggtaccgatgtcgacgagctccggcgccgactcgtccccgcccgtctcgggcctcgactacgacgacaccgccctcaccctcgccctccccggctcctcctcctcctcctcctccaccgccgaccccgaacgcaagcgcgccgcccacgccgaccacgccgacgccaagccgccttccccaaaggcgcgggcggtggggtggccgccggtgagggcgtacaggcggaacgcgctgcgggaggactccgcgagggcgaagctggtcaaggtggccgtggacggcgcgccgtacctgcgcaaggtggacctcgcggcgcacgccggctacgcgcccctcctccgcgcgctccacggcatgttcgcctcctgcctcgccgtccgcggcggcggcggcggcgacggcgagggtacaaagctcgtcgacttggtcaccggcgccgagtacgtgcccacctacgaggacaaggacggcgactggatgctcgtcggcgacgtcccctggaagtaagcaacgcgtgtacacatctcaatcagttcttgccgattaattcaccgaaatcaaatgcaaaatctgatccgatcaatcaacacaggatgttcgtcgagtcctgcaagcggatccgtctcatgaagagctccgaggccgtcaacttatcgccaagacgatcatccagataatcgatcctaccacacgcaacgatgcaatgccgcaattgatctgtctgtctgtctgtctgtctgaattagttcgtctgaaagtgtgtgcaatggaagaggcttggctgtacaggtcctccatgcatatgtacctataccgtagtaggatcagtgatcgatgagccaaattggtgtgtgtactgtacaggccacaagaacgaaaatatcctctctctttaattcaggtgtgctccctgctgccggatcacggccggcccggtttggtttttggacgacggcggcgaggatcgatccaagggaggcgccgccacgccgccgcggcggtgtactttaattttcaagttgtcagctactttctgtaatttgtttcatgatggttcggtttcctgtgacagccagcacttttgttgtatgtcaaatgcaatgtatacatgatataccggttgttatc

SEQ ID NO: 5528 - DNA, 1180 bp, Oryza sativa
  Predicted polypeptide sequence is orthologous to G450, G456
tcctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagatgtttgtcgagtcatgcaaacgcttgaggatcatgaagggttccgaagccattggtcttgcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggtatctggt

SEQ ID NO: 5529 - DNA, 982 bp, Oryza sativa
  misc_feature (62)..(62): n is a, c, g, or t
  misc_feature (200)..(200): n is a, c, g, or t
  Predicted polypeptide sequence is orthologous to G450, G456
cccccctcgtccggcccctcccctcctccccctcggcgcgctcgcgtcgaacgggatccggncttatggccggggacgcggcggcggcgggcgccgacgagaagatgtcgatgaagaggtcggcgagccagagcagcgtggtcaccgcggagcccgatcccgacaagccgcgcgcgcccaaggcgcaggtggtggggtgngcgccggtccggtcgttcaggaagaacgtgctcgccgagaaatgcaaggcggcggcgctggtgaaggtgagcatggacggcgcgccgtacctgaggaagatcgacgtcgccatgtacaagagctacccggagttgtccatggcgctccagaacatgttcacctccttcaccatcggcaagtgtgggtcccatcagcagctgaaggagagcaataagctgagagatgacctggagtacgtgccgacgtacgaggacaaggacggcgactggatgctcgtcggcgacgtcccgtgggagatgttcgtcgagtcgtgcaaacgcctccggatcatgaaagggtctgaagccattggccttgcaccaagggcagtggagaaatgcaagagctgaagctgatcaaggagaattaattagcgccgcatccagatttattaactttcacggatattatattatattatattatattatattatatcgcatgcatgcattggatctccctgtatatacaagttcaggtaatagatactggaatagcgtagaaaacagggtactagatcgtacggaatgagataccgaggagccctgtatgcagggctattgacaacgctatatcacacacgttgcggcgccatatacatagcgcatactctgtactatctgagctgtgatgtattgatagtacgtaatcatacgcgtgcgcacaacgatacaaatccgaccacagagtctaaccagtcacgagcacatagacagatagcgagactagccagatacgccaa

SEQ ID NO: 5530 - DNA, 1379 bp, Oryza sativa
  Predicted polypeptide sequence is orthologous to G450, G456
ctctctcttcttccaacacctcctaatcaccacaaaggcttaaaaatctccagtctccatagagagaaagagagagaagagaaggcagcttgatttggggcgaggagacgcgatagccgcgataggctaagcagctggcagcggcggctgctgcgatggccggcgccgacgtggacgtcgggacggagctccggctggggctgcccggaggtggcggcggcgccgccgaggcggcggccaaggccgcgaagaggggcttcgaggagaccattgacctgaagctgaagctgcccaccgccggcatggaggaggccgccgccggcaaggcggaggcgccggccgccgagaaggccaagaggccggcggaggccgccgccgccgacgccgagaagccacctgctcccaaggcgcaggcagtgggttggccaccagttcggtcgttccgcaggaacatcatgaccgtccagtcagtgaagagcaagaaggaagaggaagctgacaagcagcagcagcagcccgctgccaatgccagcggcagcaacagctctgccttcgtgaaggtcagcatggacggggcaccctacctgcgcaaggtggacctgaagatgtacaacagctacaaggacctctcccttgctctgcagaagatgttcggcaccttcaccgcaactgggaacaatatgaatgaggtgaatggctctgatgctgttacaacttatgaagacaaggatggtgactggatgcttgttggagatgtcccgtggcagtatgttactacttcattcttgtgcccccttaactgttttccttattttccacctcatgattagaatgcggtttagcgataccacgttcaagtttctcgcattagctgattggttactctgcaggatgtttgtcgagtcatgcaaacgcttgaggatcatgaagggttccgaagccattggtcttggtcagtatcttcagctaaaatttgctttcgtgtcaagatttatatcttaattcacaccccttgtgtgtgtggtttttcttccagcaccaagagcaaaggacaagtacaagaacaagagctgaaaatgttgcagtattaagatgctgagcatggtgccataagaatggtgttcttgcagtgtgttatggtttccttagaaatataaggttttacttgtttagctggattaaaagaaggaagagttgtcatgtttaatttgtttatggaccagaagcaataatctatttgtgtgtagctggattggtgttatgtgatgtcccctaccgtgtgtcccaagatctacttgatgattttattccaatgttgttaatttaagtttgtgtgattgtgaagtaaagggtatcaatgagactattattattatggt

SEQ ID NO: 5531 - DNA, 471 bp, Oryza sativa
  Predicted polypeptide sequence is orthologous to G450, G456
tttttttttttttttgacgtaaggatgacattgttgttacgtatatatatactccatgagcataacaagatggagctaacccacatgtaaatacatcaaaatcccttagaaaaactgagatgacacaagcttaactgacactgaattacagtaaactaattacttgatactagtataatacaggcaggagcaaagcatgcatgcaatataatataatataatataatataatataatataatatccgagaaaattaataaatctggatgcggcgctaattataagatctccttggatcagcgtatcagcgtcttgcattactccactgcccttggtgcgaggccactggcttcagaccctttcatgattcggagcgtcagtgtgtacgactctactaaaatgtcccacgggacttcgccgagtagcatccagtcgccgtccttgtcctcggacgtcggaacgtacgtccga

SEQ ID NO: 5532 - DNA, 1120 bp, Oryza sativa
  Predicted polypeptide sequence is orthologous to G450, G456
cgcgaggtcggtcggaattccgggtgaccacgcgtcgcatcgatcgatcgatcacaactactagaaatccagccaagaagatcgagaccggatacagctagcaatccatccaagaagatcgagagagcggatacagctagcctagctacgcgaaggatcagatcatcggcatggagctggagcttgggctggcgccaccgaattccggtcatctcgtcgtcgacgagctcagcagcagcagcagcagcggcggcggcagcggcagcgcgccggtgtctgcctcgtcggccgggaagaggggattcagggaggcgttccaggagacgctgctgctcttcgacgacggcagctgctgcaacaccagcgacgacgattgcaggaggaggaagaagacggtggtggggtggccaccggtgagctcggcgcggcgggcgtgcggcggcgccaactacgtgaaggtgaagaaggaaggcgacgccatcgggaggaaggttgatttggccctccattcctcctacgacgagctcgctgccacgctcgcccgcatgttccccaccaacgaccaccaaggcgagaagaaaatggccaatgatgatcatggcgatgccgctggacctgtggtcacctacgaggatggtgatggggattggatgctggttgggggacgtgccatgggatgattttgcacgatctgtgaaacgcctgaagatactggtaactgaatgaaggaaatgctgcttgattgaggagccagtcgggttgttgcagacattgtttggttacgaagtttatgtgtccaacacagagtgcgagagaaactcggaacaaatagcaacataagcgggacactgccggcgtgatgaacaggtacatataggagtactaaaaaaggcgatagttatataggagacaagcgaaagaagaaaaagaatcattagtaacattatacaataacgatgattaagacagaagaggagtctagagatccaagcatagagaagactaaagaagcaagtaagaagaataataatagactgatagtacgagaatacatgacaatagacaacagattaacgtagcacgagaagaaaacaaagaacaaaaacgatcaacgtcagaa

SEQ ID NO: 5533 - DNA, 480 bp, Oryza sativa
  Predicted polypeptide sequence is orthologous to G450, G456
tcggcgacgtcccctggaagatgtttgtggaaacttgccagcgccttcgtctcatgaaaagctcagagggctgtcaacttagcaccaagacccgctcaatgaggcattcccggtgcccatgaccgtgtggttggattgaaagaaagtggaagctttccccccccaattttcccccacgtgtaaaatgaacatgtaaccagttttctccaacaacttttgttcccttgataatgctgagttgagaaaaaggttttagtttcgtaactcttctttattctccccaaaaataaataatgaaccactgaagcttgaaaaaaacacctccactttgtctcttaatgaataagaccaaaaacccaaaaaaaccgatgttctttgctccggctcgcgtgtcgccaggcaaaatccagttttttgtcccaccataggcgatggacatctctgccctaaaactttcgtaaaaatctaatcatgttaacc

SEQ ID NO: 5534 - DNA, 605 bp, Oryza sativa
  misc_feature (201)..(201): n is a, c, g, or t
  misc_feature (280)..(280): n is a, c, g, or t
  misc_feature (503)..(503): n is a, c, g, or t
  misc_feature (520)..(520): n is a, c, g, or t
  Predicted polypeptide sequence is orthologous to G451
agacccccaaggatggtgaatatgtctgacttatgaagacaaggatgggagactggatgcttgttgccgatgtccatgggagatgtttcccaactcttgtcgcaagactcaggatcatgaaaggttcaagatgccacaattggacttgctcccaaggcagttgataagtccctaaaaccgcaaactagaatggttttctgnccccacagtccaaaaagcatagtatgggagatcaaaatggactgtagggaattttctgaaaacccaagaagtctaacangttttaaagatggagtcgcccttagggtctggtactacatgggtttgctattgtgaaagttaaaaaaaaaggtgtcttgttatgtttagcttccccaaatctcctagggacaataaactgctatttgattggtgcccaagtcttgtgtacgtgtggttaatgctattcagtgtaaaatggttttggaacaccatggtggctactgctatgattgagcaccccnacctacttgtgcaaaangttgtcaatgaactgtttgttcgctacataaatgttcaatgaagctggcaaatgtattgtccaccaaaaaaaaaaaaaaaaaaaa

SEQ ID NO: 5535 - DNA, 1164 bp, Oryza sativa
  Predicted polypeptide sequence is orthologous to G451
ggtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacctaagcttggtcatttctccacaccaaagattccttgtttctctgtgttcatatcataaatacagtaccaagccagtatttgtc

SEQ ID NO: 5536 - DNA, 1165 bp, Oryza sativa
  Predicted polypeptide sequence is orthologous to G451
gacgaagacaaagtcagaggtcacacagctcatcgtctcgagctacctagctggaagaagaagaggaagaagaggaggaggagctcgtcggagtttagttggtgagttcgccggagagatcgatcatggagaatctgaaggcgacggagctgaggctcgggctgccggggacggaggaggaggcggcgccgccgccgtcgacgcccagggccggaagcaagcgcgccctcgccggcgagcctgatcaggccaagatcaagcccgccgccgccgccaaggcgcaggtggtgggatggccgccggtgaggtcgtacaggaagagctgcctccagccgacgacgacgacgacgaagagcaagccgccgccggctgccgcggcggcggagacgcagcagaaggaggatgtcgccggcgccggtgggctgttcgtgaaggtgagcatggacggagctccatacctgaggaagatagacctcaaggtgtacaagggctaccgggagcttcgcgaggcactggaggccatgttcctctgcttctccggcggcgccgccgccgacgccgccgtcaacccgtccgacttcgccgtcacctacgaggacaaggacggcgacctcatgctcgtcggcgacgtcccattcgagatgttcattagtacgtgcaagaggttgaggatcatgaaggggtctgaagcaagaggcctaggagcaacaaggggttaaaaactgaacaacaacaagaagaaatcatcatcatgtgtgcatgagcaattcttttgttctttttgggttctccaagacatgcaatcatctcatctcctcattgcaaccttcaagaaagagagagagagaaagaaaaggaaagcaaaaaaaaaaaagatgcagtgaaaaaaatatgtgaagcttaattggagtcatcagattgcaaagcatgcatgcatgtgtggatgtgtggctttaatttgtttttttcctcttaattaggtgttagaaaacacagaaggaatggaggttcgagttgagcctccatgtgtgtttgtacaaagcaaacatcttttttcttttacatgaatggttgattacttttgtaactggagggaagaagaatgcatgtatgcatgggctgtgtgtacttctccctctggcttcaatgctttgatttccatccg

SEQ ID NO: 5537 - DNA, 1128 bp, Oryza sativa
  Predicted polypeptide sequence is orthologous to G451
gacgacgaggtcagtgtcgcagcgacgaacgccgacgagctagctctctctctcgatcggtggccatggcggcggagagcatcgacgcggagctgcgcctcgggctgcccggcagcggcggcggtgacggcgtggcggcgaagaagcggcggtcggcgtcgtcgacggtgaagagcgaggcctccggcacggcctgctgcggcggcgccggcgcccgggacgtcgaagacggcgcctcgccggcgtccaaagtgcaggtggtggggtggccgccggtggggtcgtacaggaggagcacgttccagtcttcgtcgtcgtcgacggcggcggcggcgaaggggaagggcggcggcgagacggatcaagggaggaagaataagggaggagggctgtacgtgaaggtgagcatggacggggcgccatacctccgcaaggtcgacctccggatgtacggcggctacagggagctcagggacgctctcgacgcgctcttcggctgcttctccgccgacgcctccgcctccgccgcccacttcgccgtcgcctatgaggacaaggacggcgacctcatgctcgccggcgacgtgccctgggacatgttcatctcttcttgcaagaagctgcggataatgcgaggatctgaggcgagatgatatatatcgaaatcgaaaggcgtcgagctgaagaaaaaattttcgccgatgcatgcatggagtagacatctcacagaaaaaaggcttcatgcatgagagagatgagatctatccgtggacatcgtcatgcatggcgatcggacggctggccaagaaggacacttacacgtagatgcatcttgtttttgttctacgtagatgtgtagatgagatatccaaggatctgaattctaaaaaagttcaggattcagttggatcggagttggtgaggaggaggatatgatcgatcgagcagagctgcagtactcctatgtacagaataatctagctgagattttggttgttggaaatggcaactgctagttctgcagatttgtgtacacatgccttttttttaaagctttttttttctagcttctgttgtgtcactgaagaaatctgagagctgaagaaagagaaacttggaagtttggtc

SEQ ID NO: 5538 - DNA, 1164 bp, Oryza sativa
  Predicted polypeptide sequence is orthologous to G451
cgtcctcatctcatcttctcctccaaattcctcttccacatttcctcctcctcctcttctttctctcaagaaaatcagtagctagccatggcgtcttcttcttctctcaggagcaccagctgcctcgcctccgccgcggagaccgacgccgacaacctctgcctccgcctcggcccgccgggaagcagcatcaccaccaccaccaccaccggcggcgccgacccggcggcgaagaggtccctcggggcgaagcggtcgctggagagcacggacagcatggcctccggcaccggaacttccgccgccggcgacgagcacgacgacgacaccgccgcaccggccaaggcacaggtggtaggatggccaccagtgagggcataccggaggaacaccttccatcaggccgccgccgccgccgccgcaaccaagaagggtggtgatgagaaacagaagcagcagcagcagggaggagggctgtatgtgaaggtgagcatggatggggcaccatacctgaggaaggttgatctcaagatgtgcaagggctacagggagctgagggaggcactggatctcctcttcaccaagtgcttctctgcaaccgcctctgacggatgcagcgatggccagttcgccattgcctacgaggacaaggacggtgacctcatgcttgttggagatgtgccctgggaaatgttcatctcttcctgcaagaagttgaggatcatgaagggctctgaagccaggtgatggtctgatggatgatcaaaggagacaaatcacaggctaggacacaccacatgagaagatggatgatgaatcagagatcatgaatcacatggcatgagatgaatgggatcaagaagggagcagaggactagaagagccctgatggcttgtgctcttcgttgctgtacagagagagtttaggcactgccttgtttcagtgtttctgaatccaagagggacaagatgtatgaactgtgtatatagtcttttaattaggctcatttcttttttcagtttgagttttgtactgtatgagcgaaggctggaaaatatgaaaaaagggagaaatttgacttaagcttggtcatttctccacaccaaagattccttgtttctctgtgttcatatcataaatacagtaccaagccagtatttgtc

SEQ ID NO: 5539 - DNA, 860 bp, Oryza sativa
  Predicted polypeptide sequence is orthologous to G468, G2866
ggcttgtttttttctcaactcgatccatctctctctctctctcgatctctccattaatttctacgtaagcattcgtagctatggaggagtgcaagggcggtggcatgtcgccgtcctcctccatggatagcagcacccacccggcgctgtccacgacgtcgtcggcggcgacggcgaggcgggacctcagcaccgatctccggctagggcttagcctctcgacgtcgtcgtcgtcctccctccggcggcgctcgccgacggcgaacgctgttcgtgaaggtgtacatggagggcgtcccgatcggccggaagctcgacctgctcttgctggatgggtatgacagcctcctcatcaagctctgccacatgttcaagacgcccatcacctatgctgatgttatggagtgccatcaacaagttcctggccagaaggctgcccatgtcctcacctatgaagaccaggacggggactggatgatggttggggacgtcccatgggaactcttcctgagcagcgtaaagaagctcaggattgcaaggatggataaatgctaaaacagttgcatttgaatttctctttgtttcttcttttttttttcccattggagggagggcccttattatatgtaggttagttgaaaaagatttttgctgaagctgagattatacttactagcagtgtacattatagtaaagaagtgtagcattatcagctacctaccgtatagcagaactgattattatttttcctctacttctttaactggtttgtaaatatcatgtattcgttaaagagagtagagaagttgataacacaaaggttccattttacctcagtggaatcaaattttgtggccttt

SEQ ID NO: 5540 - DNA, 1006 bp, Oryza sativa
  Predicted polypeptide sequence is orthologous to G468, G2866
gcgtttctctagtgatcttctttttcttttcttttgttttctgtctctagcgaactactagttcttggatccgatcgaccgaccctaccacccttgatttcatggagtgcatggcgagtactgaagagtctctcccagcttcttcctccatggatagttgcagcggcgaactgccgacgacgacgacgacggcgccggcgcaatccacggcgtcttccggctgccgaccgccggcgacggcggcgaagcggcggagtctgatcagcacagatcttcgcctcgggctcaccctctcctccgtcgtccacatcgacggcaacaacccttctaccccaaggagttccctcacgacggcgacagtgacagctgatcgaggcggcggcggcggcggccatggacggcgacggtcactgttcgtgaaggtgtacatggagggcgtccccatcggcaggaagctggacctgctgccgctagacggctacaaaggtctcgtcgcacggctcgcctccatgttcagagcatccatcacctatcatcattgccatcgacagttcgccgtcgtcgggatgaagacgaacaaggttcatcatgttctgacatacgaagaccaggagggagactggatgatggctggagacgtgccatgggagctgttcctgacaagcgtgaagagattgaggattgcaagagcggatgacaagtactgctatagctgttgaataattggttaaccaggatggtcaattaattcttccagagttcttggatttcattcattcttactttgctcattttggtggagcaatttagatttgagatgattgttttcgggagcggaaatttactagtaaaagcatagtgatattgagcagaggatattgtacaaaatatattgtacacactagtaaaagaaaagaaacatatatatagaaataccattttacttctcagtctagaataatttattccgaactggcaattttactgtatgaaaaataattttctc

SEQ ID NO: 5541 - DNA, 3151 bp, Oryza sativa
  Predicted polypeptide sequence is orthologous to G470
gtatgtactccctacaaagagaccaccaccaatccggctaccccatcccccctcctctttctctcctcttctcctctccacaaaaacatttctactgcttgctcgtctagtattccccacctccctttccttgccttcctcgctgcctcctcctcttcctcctccgtctccgctagggtttccgcgccgccgccgccccgatccgagatgccgccggccgccatggctccccctcccccgccgcagggctcctccacaggggatccgctctacgacgagctgtggcacgcctgcgcggggccgctcgtcaccgtgccgcgggtgggcgacctcgtcttctacttcccgcaggggcacatcgagcaggtggaggcgtccatgaaccaggttgccgacagccagatgcgcctctacgatctgccctccaagctgctttgccgtgtcctcaacgtcgagctcaaggcggagcaagacaccgacgaggtctacgcgcaggtcatgctcatgccggagcccgagcaaaatgagatggcggtggagaagacgactcctacgtccggccctgtgcaggcaaggccgccggtgaggtccttctgcaagacgctcaccgcgtctgacaccagcacgcacggcggcttctctgtactccgccgccacgctgatgagtgcctccctcccctggatatgacccagtcgccacccacacaggagctcgtggccaaggatctgcacagcatggactggcgcttccgtcacatctttcgcgggcaaccgaggaggcatctccttcagagtggttggagtgtgtttgtcagttccaaaaggcttgttgctggggatgctttcattttcctcagaggagagaatggtgaactccgtgttggtgttagacgagctatgaggcagctgtccaatgtgccttcttcagtcatatctagccaaagcatgcacctgggagtccttgctactgcatggcatgctatcaacacgaagagtatgttcaccgtctactacaaacctaggacgagcccttcagagttcattataccatatgatcagtatatggagtccgtcaaaaacaattactctgttgggatgaggttcaggatgaggtttgaaggagaagaggcaccagagcagaggtttactggtactataattggcagtgagaatctcgacccagtgtggcctgaatcaagttggagatccctgaaggtgcggtgggatgaaccatcaactattccgcggccagatagagtctctccttggaaaatagagcctgcttcatcacctcctgttaacccccttcctctttctagggttaaaagacctaggccaaatgctcctccagcatctcctgaatctcctattcttacgaaagaagctgctactaaggttgacactgatcctgctcaagcacaacgaagtcaaaacagtacggtcttgcaaggtcaagaacaaatgaccttgaggagcaaccttactgagagtaatgactctgatgtcactgctcataagccaatgatgtggtctccatccccaaatgctgcaaaagcccaccccttgacatttcagcagagaccccctatggataattggatgcagttgggaaggcgtgaaactgactttaaggatgtccgttctggctctcaatcttttggtgattccccaggcttctttatgcagaattttgatgaggctcctaaccgtcttacttctttcaagaaccagtttcaggatcaaggttctgctcggcacttctctgacccatactactatgtatctccacagccttccctaactgttgaatcaagcacacagatgcacacagacagtaaggagttacatttctggaatggccagagtactgtgtatggtaattcgagagaccgaccacagaatttcagattcgaacagaactaatcaagttggttaaatcagtcatttgcccgacctgaacagccaagagtgattagaccgcatgcatcaatagctccagttgagttggaaaaaacagaaggcagtgggtttaagatttttgggtttaaagttgatacaaccaatgctcctaacaatcacttgagctccccgatggctgcaacacatgagcctatgcttcaaactccatcatcattgaatcagttgcaacctgtacaaactgattgcattcctgaggtatcagtaagcacagctggaacggcgactgagaatgagaaaagcggtcagcaagctcaacagagttcaaaagatgttcaaagcaagactcaggttgcttcgacgaggagttgtacaaaggtccataagcaaggcgttgcacttggcagatctgtggatctttcaaagttcagtaactatgatgaactcaaagctgagctagacaagatgtttgaattcgatggtgaattggtgtcttcaaacaaaaactggcaaattgtttatactgataatgagggtgatatgatgcttgttggagacgacccatgggaagaattctgcagcattgtgcggaagatttatatttacaccaaggaggaggtccagaagatgaattcgaaatcaaatgccccaaggaaagatgactcttcagaaaatgagaaaggtcatctgccgatgcccaacaaatcagataactaggttcagtgaagcgagatgatacaagaggtagatcgcatggagtcttgagagagagatgccattctgcgggtcccagtcaagtaaaccccctgatgtgttggtgatcacccctgcccccccttttgcttatctgatggctgatgcaatgcaaaccctatggctttagctagtatgagatgtagactgcctattgtttatccttttgttcctttttcttctcttggcagaaagatttagggccaagatttatcattattgctattgcccctctcaactcctcccaactctctgatgtaaatatttatctacgtagccagccacccagccagaagtagagcagtagtagtagagttaccccctaccttgtattaaccagcagcctattcccccggataaatttgtgtaagctctgtagctcgagataaaaaaaaatggcgatcgaacgaacgaacaaatggcgtatgtattgtctgatctttgatataaatatttatcaatgaatgtatcatagatggat

SEQ ID NO: 5542 - DNA, 3981 bp, Oryza sativa
  Predicted polypeptide sequence is orthologous to G470
gggaattggactcggctcgtccgcacccctattaaaaccacgcgaggaagttttcttccccgtcgtcacctcccgcttcgcgaaccacccacccgtccgtttctcgcctcgcctcgcctcgccctccctctcttccttcttaacaatggcggtacaggcccagtacccttccagtctcctcttccacgataggtgcggcttgtctcctcttcttcgttagggcggctacgtgttttaaaggtttggcctcctttgggctgatggattattcgtcgtctggtttacagaggtgagccggagaggacgaaggagatggacctgcccaggccgcagatgttcgccggagtctcgccggaggtgtactttcccagcggaggaggtgggtggtggtgactgactgattgattgatagatagatagcctgatgttgaaggagttcaaggtcgcgccatggcgccgccgcactacggttcttggattgtgacatgggcgtatgtggttttggtttctttgcagcgagtgggattaatcggaggaataagcgctcgagggaggccattgccatggcgccgccgccggccaaggaggagttggtcaatctgttcacgctccagccgcagcagtctacgtcgtttgtcaacatggcgcagctccacaacagggtatcggcgtcgccgtcccgcgcgccggcggcactcgtgtccactggccttcgcctggcattggatgagcagcagcagcagcagcagcaacaacaagagagcaaacgcctgaaagccttgtgctactcgtcgtcgcccatgccgttcgtctcgttctccgacgagcttgccggacagatgaagcggcaagatgaggagctcgaccgattcatcaaagagcaggtaatcgacgattttgccccccacacgatccgtttgtttcggtggttcgttttttccgtggcgtgatgtgccggcacgttcttggacagggcgagcagctcaggcgggcgatggccgatcgggtgcggcgccataacagggcgctgcttgtcgcggcagagcgatccgcggcgcgccggctcagggagaaggcgttggaggcggagcgcgaggcgcggcgcggcgcggaactcgaggagcggctggcgcgcctccgcagcgaggcggcggcgtggcaggcgaaggccctctcggagcaggccgccgccgtgtccctccacgcgcagctccagcaggccgcggccgcggcgcgggcgtccggcgatgagctccgtggcggcgaggcgggcccggcggagtcgtcctcgtcggcgtacgtggacccgcgccgcagcgggtctgaccgcgcctgcctcacctgccgcctgaggccggccaccgtggtgctcctcccctgcaggcacctcagcctctgcggcgattgcttcgccgccggcgacgtggacgtggccatggcgtgccccgtctgccattgcgtccggacagggggcgtggaggccatcctctgttgagctgtcgtcgtctcatctcggcacacatggcggcttctcggtgctgcgacgccacgcggacgaatgcctcccaccactggatatgagccgtcagcctccaacacaagagctggtggccaaggatctgcacggtgtggaatggcgctttcgtcacatattcagaggtcaaccacgaagacaccttttgcagagtggctggagtgtgtttgttagtgccaaacggcttgttgctggggatgcctttatctttctcagaggtgagaacggggaactgcgtgttggagtcaggcgtgcaatgaggcagcaaactaatgttccatcttcagtgatatcaagccacagcatgcatcttggggttcttgccacagcatggcatgctgttaacacagggaccatgttcactgtctactacaagcctaggacaagtccagccgagtttgtggtcccttacgatcgctatatggaatcactgaaacaaaattactccattgggatgagatttaagatgaggtttgaaggtgaagaggctccagagcaaagattcactgggactattgtcggaatgggggattctgatccagctggctggcctgaatcaaaatggcgctcccttaaggtgagatgggatgaagcttcttccatacctcgccctgaaagagtttctccctggcaaatagaacctgctgtaagccctcctcctgtcaacccactaccagttccaagaaccaagaggcttcgtccgaatgctaccgctttgccggctgactcttctgctatagcaaaagaagctgctacgaaagttgtggtcgagtctgaaccaaatggtacgcaaaggaccttccagacacaagagaatgcaaccccaaaaagtggtttcggcaatagcagcgagttagaaagtgctcagaaatcaatcatgcgtccatctggatttgatcgtgagaaaaataacactcccatacagtggaagctaggttcagatggtcggatgcagatgagcaagcctgagagttacagtgagatgctatctggatttcagccacctaaagatgtacaaatcccacagggtttctgttctttacctgagcagattactgcaggccattctaacttctggcacacagtaaatgctcagtatcaagatcaacagagcaatcacaatatgttccccagctcatggtccttcatgcctccaaatactcgccttggattaaacaaacagaactattcaatgattcaggaagctggtgtgttgtctcaaaggcctggaaatacaaagtttgggaatggagtttatgctgcactgccaggccgaggtactgagcaatactcagggggttggtttggccatatgatgccaaattcccacatggatgatacacagccacgcctgatcaagcctaaacctctggttgttgcccatggtgatgttcagaaagctaaaggtgcttcatgcaaactatttggaattcaccttgacagcccagcgaaatctgaacctttgaaatctccatcaagtgttgtatatgatgggacgccacaaacaccaggtgctactgaatggcgccgaccagatgtaactgaagtagagaaatgttctgatccttctaaggccatgaagccacttgatactccgcaaccagactctgttcctgagaagccttcttctcagcaagcttcacgaaacatgtcgtgcaaatcacaaggtgtatcaactagaagctgcaagaaggtccacaagcaaggcattgcacttggcaggtctgtggaccttacaaagtttaatggctatgaagagttgattgctgagctggatgacatgtttgatttcaatggtgaactgaagggtcctaagaaggagtggatggttgtctacactgacaacgaaggtgacatgatgctagttggggatgatccctggattgaattctgcgacatggttcacaagatcttcatctacacaagagaagaggttcagcggatgaatccgggaaccctgaactcaagatcagaagatagtcatgctaattcaatggaaaggggctcagtcggcagagaaatgcgaggctgcttgtcaacctcgtctcttaattctgagaactgctaatgctttcccatctggtaacgtcttttgaagtaacatgggagacaagaacgcgatgcatcgttataagaaaatgcatttcgtagtggagttaatgctttttttccccctttgatgtattggataagctcaaagtaccctatttgtagatggtgcttgtccttggtggtcaagttgcactcttatttgctgcagttttggttttctattttggtgaggtaagttgtcagccgccagtcctaccatataaatgttggtatgcgtagaaaagtaagctcagccctcccaccctgcacttcctctctctcagcactaagctgccacctccttgtaaatagcccctgtttaattgagtctaatatattatctaccttaactgacg

SEQ ID NO: 5543 - DNA, 3265 bp, Oryza sativa
  Predicted polypeptide sequence is orthologous to G470
gggagaagagagagagagacggacacaagccacgcagcagcagcagccagcagcggcagcggcagcggcagggacacaaactgacgtcgccttcatcgtcctcctcctccgcctacataaatcccaccccgacctcctccgccgcttcctcttctcccctccgccgcaggtgtgggggttcaccggtgagcgagcttggacgtggcggagggcggaattgtgggggttctttcagttctccgagcgattcggggaagggggagaggagaggtggtggatgtgagatccgatggctgctgcagcgacggcggcggcctcgccggttgaggggctcaccggcggcggcggcggtggtggtggaggagtggacgggctgttcgtggagctgtggcgcgcgtgcgcggggccgctggtgacggtgcccgccgtcggggagagggtcttctacctcccgcagggccacatcgagcaggtggaggcatcgacgaaccaggtcgccgagcagcagggggctccgctctacaatctgccatggaagatcccgtgcaaggtcatgaacgtcgagctcaaggctgagcctgatacggatgaggtgtatgcgcagctcaccctgcttccggagaagcaggatgggaatgggagtggtaacgggaatgtgtccaaagacaaggtggaggaggaagaggtggtgccaccagctgcaactgagcggccccgggtgcactccttctgcaagacgctcactgcgtcggacacgagcacgcatggtggcttctcggtgctgcgccggcacgcggatgagtgcctcccaccactggatatgagtcagcatcccccaacacaagagctggtggccaaggatcttcatggggttgagtggcgcttccgtcacatcttccgaggtcagccacgaagacaccttctccagagtggttggagtgtttttgtgagtgccaaacgccttgttgctggagatgccttcatatttctcagaggtgagaatggggaactacgagttggagttcggcgtgcaatgagacaacaagctaatattccatcttcggtcatatcaagccacagtatgcatcttggtgttcttgcaactgcatggcatgcagtgaacactggaaccatgttcactgtgtactacaagccaaggactagtccatctgaatttgtggtaccacgtgatctgtacaaggaatctctgaaacgaaatcattcaatagggatgagattcaagatgacatttgaaggcgaagaggctgcagagcaaagattcactggcacaattgttggagtaggtgattctgacccatctggttgggctgactcaaaatggcgttcccttaaggtgcgatgggatgaagctgcttctgttcctcgtcctgatagggtttctccttggcaaatagaacctgctaacagcccttcccctgtcaaccctcttccagcaccccgaaccaagcgggctcgtccaaatgttttagcttcctcacctgacttgtctgctgtaaacaaagaagttgcttcaaaagtcatggcaaactcgcagcaaaatggtcttccaagggccttccacagtcaagaaaacatgaatttgagaagtcgttttggtgatagcaatgagctaaatacttcccaaaagcttaccatgtggtcttcaggaagcaatcaagagaaaaataatgtttctgtccagagggagctaggttcacagagttggatgcagatgagaaggcctgatggttcctctgagatattatctggatttcaaccactgaaagatacgcggaaccctctgagttcatttcctagtcagatatctggaaaccgttcaaatacgtggaacacaatcaatgttcattatcccgaccaaaatgccaatcataatatgtaccctggcacatggtctcttatgcctccaaacactggttttggtgtgaatcagcagaactacctaatgacgcctgacatcacactccctcaaaggtctcttaatgccaagtttggtgggaatggagcattcacttcgcttcgggcccatggcatagatcagcgctcctctggttggcttgggcatattgagccaagttctcacattgatgatgcctcatcgagtcttatcaagccacagcctttggttattgatcacaatgttcagaaagctaaaggctcttcatgcatgctatttgggatttctcttgacagccctgcaaaacctgaactattgatatccccaccaagtgttgcatttgatgggaagctccaacaggatgcacttgaagaggatgaatgctctgatccttccaagactgtgaagccacttgatggagctcagcacgattctgctagagagaaacatcagtcatgtccagatggtaccaaaaacattcagagtaaacagcaaaatggttcctcccgaagttgcaagaaggtccacaagcaaggaatcgcactcgggaggtcaatagatcttacaaagttcacttgctatgatgagttgattgctgaactggaccagatgtttgacttcaatggtgagctgaacagttcaagcaagaactggatggtcgtttacactgataatgagggtgacatgatgttggttggtgatgatccttggaatgaattctgcaacatggttcataaaatcttcatctacacgagggaggaggtccagaagatgaatccgggtgccctaaactcaaggtcagaggatagccggtctacttccgtggaacgagggctagttggcgaagggctccaaggtggtctatccaccccatcactgaattctgagaactgctaattcgttcggtcactgaggtcttttgtggtttgcaagaacagaagacgacatatccatggtaggaaggaatcttttcgtggtgtagtagtagtagctggtgctttatatgtatcgggtaagccccgcagtaccccatttgtagatggtgcttgtcctggtatcagttgcccgctcttcgttttcgacaagttttgggtgtgctttgttgaggttttaagttattgtatgatatgccccgtagtagtgaaaggtgctgaggccaagctgccgcgcccggtgcgcttgcttgcttgcgctcttcctccctcctaagccttgtaaatagctttgcttccccccctttcttcagtcagttctaatatgttgcgaactgcggtaatcggtgtacccctcaagaaggcaaggcaatttgaccctaaaatgttgccattttaacatcctgtttgtttgccc

SEQ ID NO: 5544 - DNA, 411 bp, Oryza sativa
  misc_feature (42)..(42): n is a, c, g, or t
  misc_feature (75)..(76): n is a, c, g, or t
  misc_feature (95)..(95): n is a, c, g, or t
  misc_feature (202)..(202): n is a, c, g, or t
  misc_feature (252)..(252): n is a, c, g, or t
  misc_feature (374)..(374): n is a, c, g, or t
  misc_feature (376)..(376): n is a, c, g, or t
  misc_feature (381)..(381): n is a, c, g, or t
  Predicted polypeptide sequence is orthologous to G478
ctgtgctgattgcttggatgcaatcacggggcacagggcacncgcccacgcagatcaacacgctgtgttggctcnngcgcctatgtacgggatgngattgcagcggcacaggggaattgggaatgataagaaggggtgagtgagctgcggcaccgaatgaaaaggatgtggggaaagatggcaaaagtgtgcttgatgaatntgtgtggggatgggatggctggcgtgcaatggtgtactgtgttggttganatgtgtgtgcggagtggatgtgatgcaacactggtgacactgaattgaaatgggttgtgatgtgggattgatgtgggcggtgttgatgactgaaacgatacaaaattgaataccatacggtntntttgngattgcaaataaaaaaaaaaaaaaaaaaaa

SEQ ID NO: 5545 - DNA, 1791 bp, Oryza sativa
  Predicted polypeptide sequence is orthologous to G478
ggccctcctgctcgatccatccatccatccacccgaaccctagatagatgaaaaagggcaaaaccatggcatatgccgcgcgatccatctctgcgcgctgctgatataagagatccatcgagtagtagccctgttagctagagcgagctcgatcgatggagaggatgatggtggtgtccttgccgcgtcctctcttccattcctagtcctttccgtgtgtgtgcgactgcgtgagtagtgagggatagataaaggagggaggaggagacaggccgcgaggatgatgaacgttccatccgccgctgccgcgagctcctgcgatgatttcggctacaacgccaccccgccgccgccgccgtcgcttctcccaatcatggaccaggacggcggcggcggtagcatccagagggatcaccaccaccaccacaaccaccagcagctcggctacaacctggagccgagctccctagctctgcttcccccttccaacgccgccgccgccgcagcacaccacgccaccatcgcccacgcctccccacatgacctcctccagttctacccgacctcgcactacctcgccgctgccggcggcgccggtggcggaggcaacccctacagccacttcacggcggcggcggcggccgggagcaccttccagtcgtactaccagcagccgccgcaggccgcgccggagtactacttcccgacgctggtcagctccgccgaggagaacatggccagcttcgccgccacccagctcggcctcaacctcggctaccggacctacttcccgccgagaggcggctacacctacggccaccacccgccgcggtgccaggccgagggctgcaaggccgacctctccagcgccaagcgctaccaccgccgccacaaggtgtgcgagcaccactccaaggcgcccgtcgtcgtcaccgccggcggcctccaccagagattctgccagcagtgcagcagattccatcttcttgatgagttcgacgatgccaagaagagctgcaggaagcgactcgccgaccacaaccgccggcggaggaagtcgaagccgtccgacggcgagcattctggtgaaaagagaagggcgcaggcgaataaatcggcagctactaaagacaaagcaggaagtagcagcaagaacgcaggcattggagacggtttcgagacacagctactggggggtgcacacatgtccaaagatcaagaccaagccatggatctgggagaggtggtgaaagaagctgtagatcccaaaggtaaggcatcgatgcagcagcagcagcagcaagcacatcatgggattcatcagcagagccaccagcagcatggcttccctttcccttcgtcgtctggctcgtgcttattccctcagagccaaggagctgtctcgagcactgacacatcaaatatagctcaagtgcaagaaccaagcttagccttccatcagcagcatcaccaacacagcaacatccttcagcttggacaggcgatgtttgatctcgacttcgatcactagtataattaatatttatcaatcatctcgatctctccttctctctctctctctctctctctctctctctctctctctctctctctctctctctctctctccctcgtacgtgtgtgtacgtccagacatctcttttcatcttgtctctattaattactgtaatttggatataataatgatagcttatgcgttattgtcatgtgtactggcagttttcctcgttggagaagctggttaattagccggtacatcaaatttagtgc

SEQ ID NO: 5546 - DNA, 1418 bp, Oryza sativa
  Predicted polypeptide sequence is orthologous to G483
cttcccccacctccgcctctctctcgatccatctcccccctctctcctctcctctctctctccgttcccaatctgcggaggcggaggcggagctagggcgcggcgtcgccggcgaggagttccgcaggcgcggtgtggacggggctcctctgcttccgcacacggcgggcggcgacggcgagcagggttggaggggcggcgcggcgacctcctcgttcctgccttgcctgcctccatctggtgttggaaatatcataagttttgggacaagcaagagaggacatggagccatcatcacaacctcagccggcaattggtgttgttgctggtggatcacaagtgtaccctgcataccggcctgcagcaacagtgcctacagctcctgctgtcattcctgccggttcacagccagcaccgtcgttccctgccaaccctgatcaactgagtgctcagcaccagctcgtctatcagcaagcccagcaatttcaccagcagcttcagcagcagcaacagcgtcaactccagcagttttgggctgaacgtctggtcgatattgaacaaactactgacttcaagaaccacagcttgccacttgctaggataaagaagatcatgaaggcagatgaggacgttcgcatgatctccgcagaggctcctgtgatctttgcgaaagcatgtgagatattcatactggagctgaccctgagatcatggatgcacacggaggagaacaagcgccgtaccttgcagaagaatgacatagcagctgccatcaccaggacggatatgtacgatttcttggtagatatagttcccagggatgacttgaaggaggagggagttgggctccctagggctggattgccgcccttgggtgtccctgctgactcatatccgtatggctactatgtgccacagcagcaggccccaggtgcaggaatagcgtatggtggtcagcaaggtcatccggggtatctgtggcaggatcctcaggaacagcaggaagagcctcctgcagagcagcaaagtgattaagaagagtaaatgatccctgtgaattgtcaagaagcttaccacctgattcagaattttacttttagccaggttgtcgtctattctgaatttatgaataggattaggattctctcatggtagttgcatttctgctgtagtggaaaaggatttatgacatgagagtatgagactaatgggtttcagttactataccgtttcctgtcaatccaaaagttggcctttgcgaggccattgatattgaacctaatgtggttgaactgcccatgccaacgtttgtaagctctgatgtgggtcattctgtatttcatgtttgcatggtttcatggaatcttctttgtttagacaatgaaaatgttttacattcgtggcatctgccataacac

SEQ ID NO: 5547 - DNA, 660 bp, Oryza sativa
  Predicted polypeptide sequence is orthologous to G483
atggtagaaccatcagccgctgctgccttccctccagctccccaggttgctccagcctatccagtgaacccaatgcagcttccagagcatcagcagcacgcaatccagcaagttcagcagctccagcagcagcagaaggagcagctccaggcgttctgggccgaccagatggccgaggttgaacagatgactgagttcaagctccccaacctcccgcttgcaaggatcaagaagatcatgaaggccgatgaggacgtcaagatgatcgcgggcgaggcaccggcgctcttcgccaaggcctgcgagatgttcatcctggacatgacgctgcggtcctggcagcacaccgaggagggcaggaggaggacgctgcagaggagcgacgtcgaggcggtgatcaagaagaccgacatcttcgatttcttggtggatatcatcactgatgataagatgaaggatgatggcatgggctctcaggctgcatccatggtttcgccatatacctcaggaggaatgggattttcctttgatctgtacccgaaccagcatcacctcgcatatatgtggcctccacaagagcagcaggagcagtggcctccacaggagcagcaggagcagaagcagaagcaggattctgatggtggtggacaagatgaatga

SEQ ID NO: 5548 - DNA, 780 bp, Oryza sativa; identical to SEQ ID NO: 2003
  Predicted polypeptide sequence is orthologous to G483

SEQ ID NO: 5549 - DNA, 1310 bp, Oryza sativa
  Predicted polypeptide sequence is orthologous to G484, G2631
gttaggtgtcgcgcctggagacgcggagatggatccgatggatatcgtggggaagtccaaggaggacgtctccctccccaaatcaacaatgtttaagattataaaggagatgttgccccctgatgttcgagtggcaagagatgcacaagatcttcttgtggaatgctgtgtagagttcatcaacctcctatcttctgaatccaatgaagtttgcagccgagaggacaagaaaactattgctcctgagcatgttcttagagctctgcaggatcttggctttagggagtacattgaagaggttcaagcggcctacgaacaccataagcatgataccctggattctccaaaagcaagcaaattcactggtgtggagatgacagaggaacaagctgtagctgagcaacagaggatgtttgctgaggcccgagcaaggatgaacaatggtgccgccaaaccgaaggagccagaacctgaagcgcagcaacaaacacaacagccaccacagcctcagctgcaccctcaaccacagcaacccctgcagcctcaacttcagctccatcctcaaccacaacaacagccctcacagctacatcctcaacagctgctgcatcctcaatcgcagcaaactccgcagcctcaacctcaggtccaccctcaaccacagcagcctccacagctgcaaccgcaacctcagcttctccagcaaccgcagctgccccaacagctgcagccgcaatctcagctccccccacaaccgcagcagcccccacagctgcagctgcaatctcagctccacccacaaccgcagcagcccccacagctgcagccgcaacctcagctccatcagcaaccgcagccgcaggcagagctgcaatcacagtcacaaccacaaacagaacatggcttggacagttcatgattcagattccatgttgtgtagcctcagtataaggaaaagttggtgtacttccgctggcatttactaggactctgtgtgccccttgatagttttaggtttccatgcttcatgtacaatgtaaatccagtgtgatttcagttaccatgttgctaataatctgaagctctcttttgtcactgatgttattacttttccaaacaccctttctctgactctatgactgtagtagtatcatggcatgtatgatgccttgtcaaaagggactccattagcagtgtaacttgactttttccggtggcggttgtggtttccgtggcttttttaaaaaaaaaaaaaaaaaaaaaaaaaaaaaaaaaaaaaaaaaaaaaaaaaaaaaaaataaaaaaaaaaa

SEQ ID NO: 5550 - DNA, 1250 bp, Oryza sativa
  Predicted polypeptide sequence is orthologous to G484, G2631
acttataaaaaaatattttaaaagaaaatttagacaaagagaagtgaataaagaagagaaaagagaaaatagaagtgggacgagaataagacgatgatgtcagacaacgacgacgagttctgcatcccgcgctcggccatgtacaagctggtgaaagagctcgtgccacaagtgcgtctcagcggcgaggcgaaagacctcatcgtgacggcttgcaacgagttcatccacctgctagcgaccgaggcgaatcaggtgtgcgagaagcagtccaagaagctcatcctgcccgatcacgttctgtgcgcgctcgacaatctcggcttcggcgagtacaaagaggactgcgtcgaggtgatgaagcagatgcaagaggagaccgacaagcgcaagaagctgcgcaatcggctcgaaaagcccggcattccggaggaggagctcctccgtcagcaaaaccagctattcgccgaggcgaaaaagcagcagcaggccgccgacgaggccaacgacgagtggacccgaatgcagcacgaagccaaactcgctctccagcggcaggcttctaccgccgccgccgctgccgcttgctccacttcatacgatgaatctgccgcggctactgctcaactagccgccaacaatggaaaacccggtggaaaagacgacgacgatgataattacgattaatattcaactcttacacattcccttttttcttaatcttaagaacaaatttctttttatatatatgtttacacagggaactatatgctgtttttttttacacggtgatgaggaaaaaattataatgaaatttcaattttctatttttctgaaaacaaacaaaacactaaaactaaatcggtacgctttattttactattttattgtcaatcgtctatttatattattatttcattttattaaacaaacgtttttaaaagattttaacatcatctctatcaatcatcatctctttttatgtctaatgtacaaatgtagaaaatgaaatatatagcacacaatctctctaattttaagatttactagaataaaattaaataaaactaatttaaatttttttttcgtctctctcttatgttagtatgtcaataaaattaaaaaatgtgtgtgtgataaatcgattgattgatgtatcttatacatatatatataatatatatttgattttttgttgttaatttctttatatatttttttcatcaagaataaaatttattaattaaatg

SEQ ID NO: 5551 - DNA, 841 bp, Oryza sativa
  Predicted polypeptide sequence is orthologous to G502, G519
atgcacgagtaccgcctcgccgacgtcgaccgctccgcccgcaagaagaacaccctccggctagatgattgggtcctgtgccgaatctacaacaagaaaggcggcgtggagaagccgagcggcggcggcggcggcgaacgttcgaatatgatgagccacggggagaccgcgtcggcgggctcgccgccggagcagaagccggccgtgctgccgccgccgccaccgccgtacgcggcggcggcgccgttctcggagctggcggcgttctacgacgtgcggccgtcggactcggtgccgcgggcgcacggcgcggactcgagctgctcggagcacgtgctgacgacgtcggcgtcgtccggcggcgtcgtcgagcggccggaggtgcagagccagcccaagatcgccgagtgggagcgcacgttcgccggcgccgccgccccggctggcgccgtcagcacggccggaccgattctgggccagctcgaccccgccgccgccgtcgccggcggcggcgacccgctcctccaggacatcctcatgtactggggcaagccgttctgacggctcggctcggctcggcggcttgagccgggagggatgaatgatctgatattctatcggggtggctcgggcgagccgctggaatcgatcggtggccgttggatggcggccgagttattggtagccgtcagatgggagatggaatggcattagttagttactagtatccgtatggacggcggcgatgaaacaggggagccccgagatgcgtgtaggaaggagatgcatggtactgtactcgagaattataagccgtgtgtatatgcgaaattggttggct

SEQ ID NO: 5552 - DNA, 1361 bp, Oryza sativa
  Predicted polypeptide sequence is orthologous to G502, G519
gtcactgcagtgcctttgagctttcgttctctagagtgtctagggtgaatcttgagcgagtgagcgagcgatctctgtgttgtgtagtttgtgagctagggtgatggctaacaccggacttagcatccccatggtgaatggtgccacaatccacctcctccctggtttccggttccgtccaactgacgatgagctagtcatcaaatacctctacccccgtgcttttcatgtgccactgccctgtgcgatcatcaccgatgttgacatccatcatcacaacccctgggacatcgtcccagtggcggagagggagaaagggaagcacttcttcacaagaaaggaggtcaagtaccctggtagccgccgtagcaaccgtgttgctggtaatggcttctggagagcagcaggctcggaggtgcccatctattacaaaccagaaggtgctgctaacgacatgctagttgggatgaggcggactctagtgttccactacggaaagtcacgatctgcagagcgcactgaatgggccatgcatgagtttcagcttgctggtgctggtctccttcctcaccctatgatgaggcatgcaaccagcaatggttcagagccaccctgtggctgccttgaagcgacaatcgctaagaaaagtgatggtctctctgcaactcttcgtgccaagcgtgattctgcccctcttatgagaatcatggtagaacccgatagctcatgggtgatctgctgcatctacaagaagaggcagcgtgccccgcctgttgttatccctcctgtcattggcgatgtaggggaagctatcatccctcatgctattggcgatgcaagggaaggccaacttcacttcattgacttcctggggcagccagctcgcaatgatccatcctcgccccatagctgcaccattgacccctcctctttggaggaagggagtgatgagtctgccggtgatggtgaagataaggatggtgatggcatgaatgaagcaaattgatcgagtgtgaaggaagtgaactgagtctcaagaataaaaactgcaagtatggcgctccattccatggaagacctgcatgcatcctatatatgtgcttttatgttcaagttggagaactatgtgtgttgtctttaagttggagtactctaagctattcgatctggagattatgctgtttttaataaaagtttgaagtgtatctgtcctgtttaattagtttcaagaaagccaagcgtgtttgggttctaggatgaacaaagtcgtccaagatgcaagaagttctagagaggtagctacatttctggaaattgttgcatcttcctttcttcaatatatatatattgtcctatttcat

SEQ ID NO: 5553 - DNA, 1319 bp, Oryza sativa
  Predicted polypeptide sequence is orthologous to G502, G519
tattcttaccccgacgcggcgtctcctcccctctcctctccccttccctccatcgcatctcctcccgctccttcgatcccaaatcggccgccgccgccgctccgccatgtccccctcccgccccgacgaggcggaccccgccgccgacttcggctcccaccccaccgaccaagagctcgtcaccaaatacctacgccgccacgtcgactccggcgggaacccgtggcggtacgtccacgaggccgacgtgtacgccgccgatcccgacgacctcaccggcaagtactccccggccgtcgccagcgacgggtccagggcgtggtacttcttcaccaccgtgcggtccaagagcaccggcgggcagaggagggcgcgggccgtgggcgacggcgggtgctggcactccgaggccggcgccaaggacgtcgtcggaggcatccgcagcccccgcccgatagggcggcgccagttcttctcgttcgtcaacaaggagggcccccggcgggtgcggtcggggtggatcatggtcgagatcggcctcaaatacgcccagcagaacgcctcctccgacgagcttgttctgtgtaaggtgtaccggagcccgcgggcgccaccggctgccgccgccgccaacaaatccatggccgccccacctcccaccgccacgaaatccaagacggaggaggctacaccacctcccgatgacgtgaaaccggtggtggcggctgcgcagactcccgacaccaaaatactcagggcggcgaaggaggcggccgcgactggatgcaagaggaaggctgacgtgaagagctctggtgcaagaaggggcaagcggctctgctcccgctgccgggcggagacatcggaatcggacagcgagacggcggtacttgacaggtcgccgtccatcgaagacgaaacggcggactcttcagaaatccatggaagcagtgatggcaaattcatcaggttcttgtgatttagttcgatctggagccccgagggtgctagcctagattggaatcagcgtgtaccaacaaaatggatagagctgctgtagttctcattttgagttcttaagccctagtataatgcctaccccaaatcatgcgttacccgcaaatttcagcatgatacagacaaggtaagcatttattttcagtatcagttgcaccgtatggtgcacttgtagatagaagttactacagcatggagaaatttggagattaacatatagacattagacattttctttcatgtaatatagtagtagaacacacaagaggttcaagcttgaatgattagaaaagcttcttgcc

SEQ ID NO: 5554 - DNA, 1255 bp, Oryza sativa
  Predicted polypeptide sequence is orthologous to G502, G519
gacccaacaacccaccaccctcattccctcaagtcccaagatcgaacacctcgtgtccatggcggcggcgaagcggcgagtgcgcgacgcggaggcggacctgaacctcccgccgggcttccgcttccaccccaccgacgaggagctggtggcgcactacctctgcccgcgcgccgcgggccgcgccgccccggtccccatcatcgccgagctcgacctctaccgccacgacccatgggacctcccccaccgcgccctcttcggccgccgcgagtggtacttcttcaccccgcgcgaccgcaagtaccccaacggctcccgccccaaccgcgccgccgcctcgggctactggaaggccaccggcgccgacaagcccgtgctgcacaacggcaggacggccgggatcaagaaggcgctcgtgttctaccacggcaagcccccccgcggcgtcaagacggagtggatcatgcacgagtaccgcctcgccaagaagggcggcgccgccgccgccgcgggcgcgggcgcgctcaggctggatgactgggtgctgtgccggctgtacaacaagaagaacgagtgggagaagatgcagagcaggaaggaggaggaggaggccatggcggcggcgcagtcgtggggggagacgcggacgccggagtcggaggtcgtcgacagcgacgcgttcccggagatggactactcgctgccggcggcgtcgttcgacgacgccctgctgcccaaggaggaggcgcgcgacgacgactggctcatggggatgagcctcgacgacctccagggcctcggctcgctgctgcaggccgacgacctctccatgctcgcgccgccgccggcggcgaagacggagccgctcggcgcgccattcttctgagctctctctctctctctctctctctctctctctgtgactgcaccactgtatataaattcagagttttcagacatgttcagtattcagagttctcaggcaagttcagaattcagagatggttaaggattagtggcttatgagcagtatgatatgcaggttagtttctagtttagcagtgttactccagattggagatttgattaatgatttgattctaattaatgtagtatactgagtgttactcatcatcacagattcatcagagctgtgtcaagtgacaattctttttttttttatttcctggatcaagttcaccatgttgtgctcaagatttgtggataaatgcacatccatccttgaattggc

SEQ ID NO: 5555 - DNA, 1529 bp, Oryza sativa
  Predicted polypeptide sequence is orthologous to G502, G519
gccaagccctcctctcctcttcccaacactagtaggataaagccacagagagagcagtagtagtagcgagctcgccggagaacggacgatcaccggagaagggggagagagatgagcggcggtcaggacctgcagctgccgccggggttccggttccacccgacggacgaggagctggtgatgcactacctctgccgccgctgcgccggcctccccatcgccgtccccatcatcgccgagatcgacctctacaagttcgatccatggcagcttccccggatggcgctgtacggagagaaggagtggtacttcttctccccgcgagaccgcaagtacccgaacgggtcgcggccgaaccgcgccgccgggtcggggtactggaaggcgaccggcgccgacaagccggtgggctcgccgaagccggtggcgatcaagaaggccctcgtcttctacgccggcaaggcgcccaagggcgagaagaccaactggatcatgcacgagtaccgcctcgccgacgtcgaccgctccgcccgcaagaagaacagcctcaggttggatgattgggtgctgtgccggatttacaacaagaagggcgggctggagaagccgccggccgcggcggtggcggcggcggggatggtgagcagcggcggcggcgtccagaggaagccgatggtgggggtgaacgcggcggtgagctccccgccggagcagaagccggtggtggcggggccggcgttcccggacctggcggcgtactacgaccggccgtcggactcgatgccgcggctgcacgccgactcgagctgctcggagcaggtgctgtcgccggagttcgcgtgcgaggtgcagagccagcccaagatcagcgagtgggagcgcaccttcgccaccgtcgggcccatcaaccccgccgcctccatcctcgaccccgccggctccggcggcctcggcggcctcggcggcggcggcagcgaccccctcctccaggacatcctcatgtactggggcaagccattctagacgaccaaaaaaaaaaaaaaacaaccgcattggcagcaatggtgtcactgaacaccgtgcaggctagctagcttcatggccggtgaactttgactcaggcgagccgccggagttgactcaaagataattaaaagaagtgttttaagtggattggattggattagacagaggagatgaggactcgagaaaggcggcgatgagaccgtggttggggggaccctggcctggactgaacgacgacgaggcagcagcagaaagatggtgcaattgcatcgggtggcatgtcagtgtgtgtgtatagtggcatgtacatagtacatggtgattgattcggtatacagggggctagctttcctgtttctgtttcttcattggttaattattactcccattataaggtcttcttcagggttgctagcttaattaattaattaattagcccagtggttgaagtgtaagtcaaaattcatcaagtcagagactggaataatacaatacagtactgc

SEQ ID NO: 5556 - DNA, 1868 bp, Oryza sativa
  Predicted polypeptide sequence is orthologous to G502, G519
attccaaaactttcgaaagcttccattagcgactaatccagccttcgttaagggtgattagaatttgattaatttcaaggcctcagatcggagattgaatggagtgcggtggtgcgctgcagctgccgccggggttcaggttccacccgacggacgacgagctggtgatgtactacctgtgccgcaagtgcggcggcctccccctcgccgccccggtgatcgccgaggtggacctctacaagttcaacccatgggatctccccgagagggcgatgggaggggagaaggagtggtacttcttctcgccgcgggaccggaagtacccgaacgggcagcggccgaacagggcggcggggacggggtactggaaggcgacgggggcggacaagccggtggggtcgccgcgggcggtggcgatcaagaaggcgctcgtcttctacgccgggaagccgcccaagggcgtcaagaccaactggatcatgcacgagtaccgcctcgccgacgtcgaccgctccgccgccgcccgcaagctctccaagtcctcccacaacgccctcaggttggatgattgggtgttgtgccgaatctacaacaagaagggagtgatcgagaggtacgacacggtggacgccggcgaggacgtgaagccggcggcggcggcggcggcgaagggtggtcgcatcggcggcggcggcggcgcggcggcgatgaaggtggagctctccgactatgggttctacgaccaggagccggagtcggagatgctgtgcttcgaccggtcggggtcggcggaccgcgactcgatgccgcggctgcacaccgactccagcgggtcggagcacgtgctgtcgccgtcgccgtcgccggacgacttccccggcggcggcgaccacgactacgccgagagccagcccagcggcggatgcggcgggtggcccggcgtcgactgggccgccgtcggcgacgatggcttcgtcatcgacagctccctcttcgagctgccctcgccggcggcgttctcccgcgccgccggcgacggcgccgccttcggcgacatgttcacgtacctgcagaagccgttctaattaacggaacgtgacgcctctgcaaacgctaattagctcactaaccactgtcaggtcgatcgtgtaattcttttaccagtctagggtacagccaaaaaaccaaaaattaaccgtgctcgatcgatcgatcgatccatggatcgatgatcgcctccaccggcagatcaaaatcgaagcaaaaaatcagggagaattcttggtacttccagtacctctcgtcgacaccacgtgtcgggttttctgcaccgcggatcctcgctggccgcatcgtaacggcgagcgaggttaaaaatagtggagaattcaagaacacatccctgatttttgtttctgccggatggggagtaccgtgagcatggtagaaatgactggtaaaattttcgttgatgataggtagccagagtcgatgtaaccagtcgatttttttttttttttggttttagttgacatgccttcctgatagattcagaacaaacaatagagaagagaggagaaaaaaacacagaggagaaattcagagaccaaagttcaaagttttggaattttcaggggcgccagcagctgatggtattgtcagtcgtgtctaggttcgtagaggaaattaaaatgtagaagaacgggtacttcagttcacttcaggttcgttcgtgccaaacaggtctctgacactttagttaggttttgatttttttttctctttttttctggttttttgtcgtttggtaatgtaatgtaagggtgattgcgacatggtatttatgtgattagagtcgctttcagttg

SEQ ID NO: 5557 - DNA, 969 bp, Oryza sativa
  Predicted polypeptide sequence is orthologous to G502, G519
atgagcggcggcggcgaaggggcggcggcggcggagaggcaggagctgcagctgccgccggggttcaggttccacccgacggacgaggagctggtgatgcactacctctgccggcggtgcgccggcctccccatcgccgtccccatcatcgccgaggtcgacctctacaagttcgatccatggcatctcccaagaatggcgctgtacggcgagaaggagtggtacttcttctcccctcgggaccgcaagtacccgaacgggtcgcggccgaaccgcgccgccgggtccgggtactggaaggccaccggcgccgacaagccggtgggcacgccgaggccggtggccatcaagaaggcgctcgtcttctacgccggcaaggcgcccaagggcgacaagaccaactggatcatgcacgagtaccgcctcgccgacgtcgaccgctccgcccgcaagaagaacaccctccggctagatgattgggtcctgtgccgaatctacaacaagaaaggcggcgtggagaagccgagcggcggcggcggcggcgaacgttcgaatatgatgagccacggggagaccgcgtcggcgggctcgccgccggagcagaagccggccgtgctgccgccgccgccaccgccgtacgcggcggcggcgccgttctcggagctggcggcgttctacgacgtgcggccgtcggactcggtgccgcgggcgcacggcgcggactcgagctgctcggagcacgtgctgacgacgtcggcgtcgtccggcggcgtcgtcgagcggccggaggtgcagagccagcccaagatcgccgagtgggagcgcacgttcgccggcgccgccgccccggctggcgccgtcagcacggccggaccgattctgggccagctcgaccccgccgccgccgtcgccggcggcggcgacccgctcctccaggacatcctcatgtactggggcaagccgttctga

SEQ ID NO: 5558 - DNA, 1332 bp, Oryza sativa
  Predicted polypeptide sequence is orthologous to G502, G519
gccacggaagcgcagcatcaacaaaggcagcagcagcagcagcagcagcagcagcgttggtggtggtggtgtgtcatcaccaacattttcacgagaggagaaggatggaaatggcggcggcggttgggggcagcgggaggagggacgcggaggcggagctgaacctgccgccgggcttccgtttccacccgaccgacgaggagctcgtggtgcactacctctgccgcaaggttgcccggcagccgctccccgtcccaatcatcgccgaggtcgacctctacaagctcgacccctgggatctccctgagaaggcgttgttcgggaggaaagagtggtacttcttcacgccgagggaccggaagtacccgaacgggtcgaggccgaaccgcgcagcggggagagggtactggaaggcgacgggagccgacaagccggtggcgcccaaggggagcgcgaggacggtggggatcaagaaggcgctcgtgttctactccgggaaggcgccgaggggggtcaagacggactggatcatgcacgagtaccgcctcgccgacgccgaccgcgccccgggcggcaagaagggctcacagaagctggacgagtgggtgctgtgccggctgtacaacaagaagaacaactgggagaaggtgaagctggagcagcaggacgtggcctccgtggcggcggcggcgccgcgcaaccaccaccatcagaacggcgaggtcatggacgcggcggcggctgacaccatgtccgacagcttccagacgcacgactccgacatcgacaacgcctccgccggcctgcggcacggtggctgcggcggcggcggcttcggcgacgtggcgccgccgaggaatgggttcgtgacggtgaaggaggacaacgactggttcaccggcctcaacttcgacgagctgcagccgccgtacatgatgaacctgcagcacatgcagatgcagatggtgaatccggcggcgccagggcacgacggcggctacttgcagtccatcagctcgccgcagatgaagatgtggcagacaatcctgccaccattttgagatggatggagcaagaaaaaggttgctgtagataaagggcggaaataggagtgatggctagaaaattattagatttactagaacgaaaatgattagaaatctggcaagcatgattctgcaaatgtggtggtagatgcttgcagtatgtaattcatttgttcagtatatgcatttggtaatctgcaaaacatctccttttgttctcatatcctaagcgaaacatatatgattttatccttcaaaaaaaaaaaaaaaaaaaaaaaaaaaaaaa

SEQ ID NO: 5559 - DNA, 1312 bp, Oryza sativa
  misc_feature (1168)..(1168): n is a, c, g, or t
  Predicted polypeptide sequence is orthologous to G502, G519
acattttcaaacaacgcaaagcagtagcagcagcgagaagcaagcaagaagcgatggggatgaggagggagagggacgcggaggcggagctgaacctgccgccggggttcaggttccaccccacggacgacgagctggtggagcactacctgtgcaggaaggcggcggggcagcgcctgccggtgccgatcatcgccgaggtggatctctacaagttcgacccgtgggatctgcccgagcgcgcgctgttcggcgccagggagtggtacttcttcaccccgcgggatcgcaagtatcccaatgggtcacgccccaaccgcgccgccggcaacgggtactggaaggccaccggcgccgacaagcccgtcgcgccgcgtgggcgcacgcttgggatcaagaaggcgctcgtgttctacgccggcaaggcgccgcgaggggtcaagactgattggatcatgcatgagtaccggctcgccgatgctggccgcgccgccgcgggcgccaagaagggatctctcaggttggatgattgggtgctgtgtcggctgtacaacaagaagaacgagtgggagaagatgcagcaggggaaggaggtgaaggaggaggcgtccgacatggttacgtcgcagtcgcactcgcacacccactcgtggggcgagacgcgcacgccggagtcggagatcgtggacaacgaccccttcccggagctggactcgttcccggcgttccagcctgcgccgccgccggcgacggcgatgatggtgcccaagaaagaatcgatggacgacgccaccgcggccggcgccgccgccgacaccatccccaggaacaacagcagcctgttcgtggacctgagctacgacgatatccaggccatgtacaggcgcgctcgacaatgctgccggcgggcgacgactctactcggtcgtctcgcgtcgcgcgggtgaaggtgagaagcacgcgccgcgccggatgggatggcccgtctgagggacgggaacgacgaccgggtggacaagctgaagggttaatatacgcggggggcagaagcctggtatccccgcggtctacatgtccggacataatcactatccccgggcaaaccggtcgtctctttcacccggggctgttcaacgggcgcactgctgactcttcactctcacgagancgaacatctcagcatgtacactgtcacagatcactcacggctagcgtcgtctcatcgcacatatctacactatacgagtcattcacagactgatgctgcagtagtctctgatactagagctgtgctctcatgtcacgtctagac

SEQ ID NO: 5560 - DNA, 1336 bp, Oryza sativa
  Predicted polypeptide sequence is orthologous to G504, G1425
atcctccacaagagaaactaggatcttcaagtatagctagcattgcgccctcatttcatccatggcaatgcagctgtccttgcctgtcttgccaacgggttttcgtttccatccaaccgatgaggaactagtcatcaactacctccagaggcgtgctaccgggctatcgtgccccatccccataatcgcggatgtcgaaatatacaacttcaacccgtgggagcttccatccatggctctatttggggaacatgagtggtacttttttacactacgcgaccacaggtaccccaatagtgtgcgccctagtcgctcagcggcgtcaggcttttggaaggccaccggcactgacaagcccgtccaagttgctaacatgcaaagcactcctgtagctatgaagaaggcacttgtattctatgttggccgcccgcccatggaaaccaagactacatggatcatgcatgagtaccgtctcacaaacacgggagggtccactgcctcccacccatccttgtcttcatccaccgcacacccttctgtgaagctagacgagtgggtgctatgcaagatcttcaacaagtccccagagccggacaacaccgcaccaccatcaaacgtcgtctcacggttacagtgctcgccgccgctgccgccgccggcggcaccgcccggcaactacccgccgctgccggtgggtgcgacgaacgacggcggcgtgttcgcctgcgccggcgacatgctcttcaccatccaagagcaccaggagggaacaccatcgatgctgccgccgatccctaaccttgagccaccggcggcaacaattgggaattcctctctcaatggcactgctgctgctgctgctgctgctgatggccatggccgccttgaggaagaggacaccagcgcctacaccttcaccgaccaggaaatggagcagatgctcatggacctgatggaccaggatttctttggcaatgatcaaccccaggagtgaactgtgtggtggagtgattttcatatcattccatagctctgatctgtgctggagagtgaatttagtatctattgtaccagatagaataaaaccagaaaagaaataaaagaaggccaaagaaaaaagcaaaaagaaaattgtataattactaggtttggatgccgtctgtagaaccttgtgtgctatgtaacttttttctttgtattttggcattttcatcatattgtgtcataaataaagcagggctttcttttgtagtttgccatctcaatcttgcaccgtgatgttataaaaaaacaaaattaattattgtgctacactgtacttttggctgtgttcggc

SEQ ID NO: 5561 - DNA, 2717 bp, Oryza sativa
  Predicted polypeptide sequence is orthologous to G504, G1425
ggcttccgcctctcctcgcctcctcccttcctttcccccccaaaccctagaattcccccccacaaaaccctagaattcgcgcgatcgaggcggctatggcggcggccgcggatgggcttccgccgggcgtcaggttcgaccccgccgacgacgagctcgtctcccgctacctgctccggcgcctccggaagcagcccatcccgctccacggcgtcatccacgaggcggatcccctcggcgcgccgccatggatgctcctcgccgctcacggccggggcggcgacgaggccttcttcttcgccgaggcgcgcgccaagaacgtcagggggaagcggcagaagcgtaccgtcgagggtggggggttctggcaggggcagcgggtgtgcatcgacggcgagaggctgcgcgtccccggcgacggcggcggcggcgaagtcggcggggaattggagatcgagtggcggaagtacatgctgagcttcttcgccgagggggagaggggcagctcggggtgggtgatgcacgagtacgccatcacggcgcccgctgacctcgcctcgtcgccgatccggctttaccgcgtccggttcagcggccacggcaagaagcgcaagcgggagccggaacgcctgggcgcccgcgtccacgacgacgacgtcgacggtggagaacgcgccgcgccccggcgcgccgtggcagagaccgccctgttcgtgcagcagtcgagcgccgtggattgcgccgaatccgccgatcagagcttctccggcgtgatcgagcctgtgttccacgatctccccgacatgatgccagagcaagctgatgccggagacactgcagagactacagcagcggtggtgaacctcacggacgccatgaccgagcagcccgttcttccgctagcagcagatggcgacgatcagagctcctacggtgtcatcgatccggcgttccgcgatcttgctgacctgatggtcctgccacctgtgctcgcgcagcaggagcctccgctcgcgcccgtggcaatggtggatctccctcctggcaatgctgattgcgccgatcatcagagctgctctggcgtgatcgacccggcgttccgtgatctccccgacatgaccgtgctgccaccagagcaagctgacaccggaggcggagcagagactaccacagcaatggtgagcctcacggacaagctgaaatactcctcctccatggacggcgaggcagcgccggcgtggtgtgatttcgattttccagagagcactgatgaggtgctcagctacatgaacttcaccgccggtgcccacgacaacaatgacggcagtgtgggacgcgccgcgccatggcgtcccgtgtcagagatcgccatgttcgagcagccgagcgccgtggatctccctcctggcgatgctgattgcactgaatccgccgatcagagcttctccggcgtgatcgagccggtgttccatgatctccccgacatgatccgtgagcaagctgatgccggagacaccgcagagactactgcagcggtggtgaaccagaactactccatggcgttgtgtgatttcgacagcggcattgacttcaccgccggcgcccacgacagcggcatggaacgcgccacgccctggactcccatgtcagaggccgccctgttcgagcagcaagggcctccgctcgctcccgcggcagtggtggatctccctcctggcaatgctgattgtgccgatcatcagagctcctacggtgacatgatcgtcctgccatcagagcaagctggcgccggaggcggagcagagactaccgaggccctgttcgaccagcccgttccgccgcttgcagcagattgcgccaatcagggctcctacggcgtgatcgacccggtgttccgcgatctcgccgacttgatcgttctgccaccagagcaggccgacgccatggacggcgaggcggcgccggcgtggtgtgatttcgattttccggagaacattgatgaggcgctcagctacgtcgacttcaccgccggcgcccacgctgacaacgacggtggcgtgtcagagaccgccatgttcgagcagccggggtctccgccacagcacgatcctctgctgatggatgctgatggcgccgatcagagctcctcctccggcgcgctgatcgacacggtgttcggtgatcacgccgaaccgatcgtcctgccactggagcaagctgacaccggaggtggtgcagcagcggcggtgaaactcatggacaagcagaagtactcctcctcctccatggatggcgaggaggcgccggcgtggtgtgattcggatttcccggagagcattgacgaggtgctcagctatgtcgacttcagcaccgatggcgcgagctgcgacttctccatggacgagctcttcgatcttgcagattagttagcatcctggagatagcaagccaccaagaacactggcattgacattgtctttctaagaagagctgtaatcagtagcgcaaaggcgagatttgttgatattctggtgtaatctgtagactagaggcagagtagatagatgttccttagtttattgactaatctatgcatagatgagttatttgtttattgattgaactcaatgtaagtaacattattgtaagtaatgaatatactcccttttcaatcattatattccctattcaaaatcaatatactgcattgatctgcc

SEQ ID NO: 5562 - DNA, 1654 bp, Oryza sativa
  Predicted polypeptide sequence is orthologous to G504, G1425
gatttcaatccttcctcttccttagcttattagcttccttccttcactagtgccagttttcctcctacctaatctaagctagccaggtcgtcatcttcttccttcagctcacgctgaccaaacaccatctgttattctgtttgtttgtttttttaaaaaaaagaaaaaaaatctagctaggcgagccgattgaaggagctgagcatgccgagcagcggcggcgccatgcctgcccttccaccaggcttccgcttccaccccaccgacgaggagctcatcgttcactacctcatgaaccaggccgcctccgtcaagtgccccgtgccaatcatcgccgaggtcaacatctacaagtgcaacccatgggaccttcctggtaaggctttgttcggcgagaacgaatggtacttcttcagcccgagggaccgcaagtaccccaacggcgctcgccccaaccgcgccgccggctcggggtactggaaggccaccggcaccgacaagtccatcctctccactccgaccagcgacaacatcggcgtcaagaaggccctcgtcttctacaagggcaagcctcccaagggcgtcaagaccgactggatcatgcacgagtaccgtctcaccggcacatcagctaacagcaccaccaccacaaagcagcgtagagcgtcatccatgaccatgaggaatccacaagaagagcaacgacttcaattcctctgaccaacacgaccaagaacccgaggaatcaaccgtcgaacagcttgaagacatccatgacaacaactcctctgaacaacctccagctccagctgacatgaacaaccaacagtcagatttccagcccatgacggcgatgagcatgagcaagtcatgctccctcaccgatctcctcaacaccatcgactgcgccgcgctctcgcagtttctcctcgacggctcatccgacgccatcgctgagcctcctgctcctcccagccccctaatatacacaacacctcatccaaattaccaaacactaaactataacattaacagcaacagcagcatgccacacgccttcgagtcacgcctagatcatcacgatggttacgttaacaattataatgttaatggcctgaggaggaagagaatgatggcgtgtagtgcaacttcctttgatgatggcagcagcagcaatgactttgtgcatgccgttgtcaagaaaccgcagctgctgccaagtgattcgaggggtagtggttttggaggaggttactgcaaccagcagctttcagagactgcgactggctttcagtttcagaacggcaatctgctgagccatccatttcctctgaacaatcatctgcagatgcagtagtaggcgtctagatcccgtttaccgatcgatctgaagagaggtgaattaatttcaacgaatgaaactacagattcagagaggaagatactgattgttccatttgtgatttattttgaggagttgcatgggcagatagacaaacagacggaattcttgatgtaaccgatgcaaggaaagattcagatttcttcctatggcattaatttgtgagtttttttttgttttcattttcatgtacaagaatgtaaattataaatggtaatatcgtgcaagctagtactcaagccaatttatatg

SEQ ID NO: 5563 - DNA, 1524 bp, Oryza sativa
  Predicted polypeptide sequence is orthologous to G504, G1425
gaacacccaaccccctctctctctctatctctctcctctctctctctctagctctagctctagctcgtcgccgccatgaacgttccaagcaaatgcatggctcctgcaaagtaaaaaaagaagaagaagcagcagctgcagcttctcttcagtatcgatctttaactgtatcgagctagcttagcttagcttagctctctgccattaacttgtgcttcactgagcttgagctagctagcttcttggctgtgtgactgagtagctctagctcctcgtcgtcgtcgtcgtcgtcgtcgtcgtcggcgtcggtggtggtgtgaattgatagaattgatacgatggagagggcggctgcggcggcgccggtggtggtgaggcatggaggagtggtgttgccgccggggttcaggttccacccgacggacgaggagctcgtggtgcagtacctccgccgcaaggcgttcggcctgccgctccccgccgccgtcatccccgacctccacaacctcttcaagctcgatccctgggacattcctggtgcgagcagcgacggggacaagtacttcttcgccgtgcggccacctgcggcgagggggaggaggcagcatgtgacggcgagcggtgggtgctggaagccggcgggcgggcgggacaagccggtggtggtggcccggtgcggcgggagccacctcgtcggcgtcaagaagggcatggtgttcgtcccacggcaagggaggaaggcaccggcggcggcggcggcggccgccggcggtggctgctgggtcatgcacgagtacagcctcgccctgccgatgcacaagaagggttgcttggctgaggctgaagaatgggtagtgtgccggatatttcagaggagcagcagcggcagccggtcgccgaggaggcctgacaacgacgtgaggcgaacgatgccggccgtcgccgagctcggccggtcgccgtcgccatcgtcgtcgtcgtcgcaatccagctgcgtcacaagcagctccgaccaggaagaggtcagcagcggctagctagctgaagaagaatgcaggcagcagcagcaagcagctaagctgcctctcaaagagaggcttgagtgttagcctagctaagcatatatatttatagccggccaaaccctctgaaagtgatctgcatcaatgcatgcccccctttaatttcttcttcctccttaattattttttcccaaccatgtaatgtaatgtaatttaatgtaatgcagtgtaatgtaacgggaaggaagcactgaattaatcaaattaaattaacaaatgaagagtgctcaaaagtccaaggaagcttctaaggttcaggagccagatattatctacttaattaattaattatgggcacatatctgtagttgctagctagctgcatatgcatctcgtcgttgtcgatccatttgtaacttgcaagttgtgttggtgtaatattgtaatatttttctccgatggttgagaaattaatctgaaatccattatagcaattaattgc

SEQ ID NO: 5564 - DNA, 1650 bp, Oryza sativa
  Predicted polypeptide sequence is orthologous to G504, G1425
atcgatcgatcgatgagcactcgctttgattcgatcaatcgattgatcgagctataggtagccaattacaagctaattaaagcagtaaccgtattagatcgtcgatggagatgacgatgtcgtcggcggcgacgtcgctgccgccggggttccggttccacccgacggacgaggagctgatcctgcactacctccgcagccgcgccaccgccgggcagtgccccgtccccatcatcgccgacgtcgacatctacaagttcgatccatgggacctgccatgtaagccttcttcctcgatcatatcgatggatcgattgagttggtcgttcggtcaattgctactggttaattaattgcagcgaaggcggtgtacggggagagtgagtggtatttcttcagcccgcgagaccgcaagtaccccaacggaatccggccgaaccgcgccgccgggtcggggtactggaaggcgacgggaaccgacaagcccatccacgacagcgccaccggcgagagcgtcggcgtcaagaaggccctcgtcttctaccgcggccgccctcccaagggcaccaagaccagctggatcatgcacgagtaccgcctcgccgccgaccctctcgccgccgccgcaaacacctacaagccctcctcctcctcccgattccgcaacgtctccatgaggctggacgactgggtgctctgccggatctacaagaagtccggccaggcgtcgccgatgatgccgccgctcgccgccgactacgaccacgacgagccgtccggagtccttgacgacgcctacagcttctacgcgccgccgatgatcagcaccacgctcatccccaagctccccaagatcccctccatctccgagctcttcgacgagcacgcgctcgcccagatcttcgacaccgccgccgacccgccggccgaccaccatcagcatgccctcgccgtccacccctccctgaaccagctcctcggcgtcggcgacaacttcctcgcggagtgctacccgtcgacggcgtccacggccaccgttgccggcggcaagcgcaaggcgagcccggccggagactacgccggcggcggccacacgccggcgaagaggctcaacggctcatgcttcgacgtggcgccgcagtccgtggtgggcggcttgcaagcgacgccgtcgtcagtcctcgccggactcaaccaccagatgcttcctcctcagctattctgaatatattcttaactagcttaattaatggccatggaaatcgatcaaacgcagtcgatcgaatttacggatgctacgtactggcatgaacaatcttgccgacgatattaagatcggatggaagcatggacgacgatgatgattggggtacggtatagaattattgtagtattgaacaattaggcatttgtatgcgattttttctcctacgtattcatttcaggcacagtgcaaaagcaagctggagccttgatagtactttacaccgtagagagggaatgttgtacaattaaagattactagatatacagaacaataatactttactgtagccaattgatatactactagtatacaggattgtagaagatatcaaatgcaatagattctggctctgatctgggaaatggaaattgcatggatgtgtt

SEQ ID NO: 5565 - DNA, 1817 bp, Oryza sativa
  Predicted polypeptide sequence is orthologous to G504, G1425
aactagcttagctagacagcgtgtgttggtggtggtggtggtgtgtgtgtgtgtgaggagggtgatcgatcgatcgagcgatggagagcccggactcgtcgtccggctcggcgccaccgcgagtactacggcggcaacagcagcagccgggctcggcgccggagctgccgccggggttccggttccacccgacggacgaggagctggtggtgcactacctcaagaagaaggccgcctccgttccgctccccgtcaccatcatcgccgaggtcgatctctacaagttcgatccctgggatctccccgagaaggcgaacttcggggagcaggagtggtatttcttcagcccgagggaccacaagtacccgaacggggcgcggccgaaccgggcggcgacgtcggggtactggaaggccaccggcaccgacaagcccatcatgtcgtcggggagcacccgcgagaaggtcggcgtgaagaaggcgctcgtgttctaccggggcaagccacccaagggcgtcaagactaactggatcatgcacgagtaccgtctcacggacacgtctagctccgccgccgccgtcgctacgaccaggcggccgccgccgcccatcaccggcggtagcaagggcgccgtctctctcaggctggatgactgggtgctgtgccgcatatacaagaagacgaacaaggccggtgcggggcagaggagcatggagtgcgaggactccgtggaggacgcggtggccgcgtacgcgccgtcgtcgcagcagcatgccacggctgctgctggcatggccggttcggacggcgccggaggagttgctgcagcgcacggcggcgactacagttcactgctccatcacgacagccacgaggacaccttcctcgtaaacggcctgctcaccgcggaggacgccgccggcctctcgaccggcgccagctctctcagccagctcgccgcggcggcgagggcggcggcgacaccgtgcgacgccaccaagcagcttcttgctccgtctccaaccccattcaactggttcgaggcattccttccacgggccaaggagtttcctagtgggctaagcaggagtagcagagacatcggcgacatgtcgctgtcatcgacggtggacaggagcctgtctgaggctggcgccgtggccattgacaccggcgacgccgccaatggcgcaaacactatgcctgcatttatcaatcctctcggcgtgcagggtgcaacctaccaacaacaccaagccatcatgggtgcctcgttgccatcggagtcagcagcagcagcagccgcctgcaatttccagcatccgttccaactctccagggtgaattgggattcctgaataaaaggtgccggcattatgcatacacatatatgcacatgcatacatgcatggcttttcaagtagtagcacaacattactagtaattaatcacactaatgtgtgtggcagtcgcattcagtgagcactgatcgagtagttgcatgaacacaacactaatgcatgcactacatatatatggccgcattgctcctagggcacgtacctgtacgaactaggtaagtgacctaaccagctagatcatgttcagaataaggagaagaagccgcatgcaaacacgtagatcatatggctttgccttcacatgcgtttgcatcatatatatcgcattcagaaagtagtgctgcagctaacacatagatatggtgttagcttcatgcgtttgtaccatatatagcggatgcagaaagtagctagttgcactgttcatcattatcccatgagatatgaactttatat

SEQ ID NO: 5566 - DNA, 1206 bp, Oryza sativa
  Predicted polypeptide sequence is orthologous to G504, G1425
atggctgaatcctccgaatctgcgtggccgcagcagagtcagcagctgcagattagcagcacaatgccggccggttctgcatggccggaggaggagaatctcgagaatctcgagcagccgcttcccctgctgatgccatcgtcggaggatcatcgcgagcagcagcttgttcccgttccatggctgcagcaggatcaggatcaggagtggcatgagcaggagcagtttcttcccctcaaaaatcagaatcaggagcagcttcaggatcagcaacctctgcaggatcaggaggagacgcgtagatatttgggcgtgcccggaatccggttcgtgccgtcggatatagaacttatccttgacttcctccggccgaaactacgcggcgagcagctgcccagctacagctacatgcatgtctgcgacgtctactccgaccatcctaaagaacttacgagtaagctgggtcccagccgcgaaggaaactggtacatgttttcacctagaaaccggaaatacaacaaaggcaaaaggcctagccgaagcaccggtcaattgggtttttggaagtcgactaccaagaacgaggccgtccttgacgccctcagcgataacatgttgattggatacaaggcatgcctcacctatcacgaatacgatgagagcatgccgacgccaaagttgaagaaagagaacgcgatcaagacgccgtggaagatgtgggagttcgtgtgttccaactccaaccggccgttcgacgcggaggaggagcccatgcggctcaacgactgggtgttgtgcaaagttaccaacaaggacaacaaagttaccaccaagaagttcaaaccacaacgcagcaagaagccgaagaagccgaagaagctacagcaggaggaacagccacaaaaccaaggcattgtgatcaggcagccgtcagaatccggctcggcctcctcgtcgcaccaagaaatccctggctcttctcttcccggagccggaggagacgccgcggccgcggcggcgacggcggcggcggtggtggatcctatgccattgcatatgattcctccttcttcatggaattatttcagcacgggagttactgcagatggtattgttatggatgacagtacgggagtcgattcatatggttgtgtagatggtgctggtgctcttaatttccagaggaacatcttctaccaccgttaa

SEQ ID NO: 5567 - DNA, 1125 bp, Oryza sativa
  Predicted polypeptide sequence is orthologous to G504, G1425
atggcggcggctggcgcggatgggctccctccggggctcagattcgaccccagcgacgacgagctcgtcggccggtacctgctccggcgcctccagggccagcccctcccgctcgacggcgtcgtcctcgatgccgatcccctgagcgcgcagccatggaggcttctcgcggatcacggccggggcggcgacgaagccttcttcctcgcggaggcgcacgccaagaacgccaagggcaagcgccagaagcgcaccgtcgagggtggagggttctggcaggggcagaggatgtgcgtcgacggcaagaagctgctcgtccccggcggcgacgacggcggcggcggcggcgaagtactggagatcgcgtggcgcaagtatgtcctgagcttctttgccgagggggagagggggagctcggggtgggtgatgcacgagtactccgtgacggcgccggctgacctcgcctcgtcgccgctccggctctaccgcatccgattcagcggctacggcaagaagcggaagagagagccggaagacgacggtcgagcacatggcgcgccccggcgggctgaggcggagactgctctgttcgatctggaggtcgggccaccgccaccgccactgctcgttcctcctcccgcggcggcggcggcggatcatggcaccgatcagagctcctccggtgtgaccgacatggtgttccgtgatcttcccgacctgatcgctgatgctggagctgctctgcccgatcagaaccaacaggattggtctgaagtcgccgatcagagctccttctgtgtgatgggcgatgactcttctctgctgctccctgatcttcctgggatgattgatgacaatgagcaccagcagtttgtgcgcgagtgcgacatgccacacctgttcgtcccgcaagcagaggaagccattgctggtggtggtgcagcatcggcgccatcggcggacaaccagaactgcgagttcaatgacggcgaggacatggcattgtcagattttgagtttccggagagtattgatgaggtgcttagctacatcgacttcagcacgagcgacacgagctgccgcgacttcaccatggacgagctgttcgatctgccggtggactag

SEQ ID NO: 5568 - DNA, 1818 bp, Oryza sativa
  Predicted polypeptide sequence is orthologous to G504, G1425
atggcggcgggtggtggtggcgctgatgggctccctccgggcctcaggttcgatccgaccgacggcgagctcgtctcccgattcctgctccggcgcctccagggtaagcccctcccgctcaatggcgtcatcctcgaggccgaccccctcagcgtgccgccatggaagctgctggcggagcacggccggggcgacgagggcttcttcttcgccgaggctcgggccaagaacggcaaggggagccgccagaagcgcaccgtcgagggtagtgggctctggcaggggcaaagggtctgcgccgacggcgagaagctgctcgtccccgatggcggcggcgtggaggtggagatcgtgtggcgcaagtacttgctgagcttcttcgccgagggcgagagggggagctccggctgggtgatgcatgagtacgccgtcacgtcccccgccgagctcgccgcgtcgccgatccggctctaccgcgtccggttcagcggccacggcaagaagcgcaagagagagccacaatccggcgaggacggtgtcggtcgagcacgcgcggcgccacagagcgctggaacagagactgctctgctcgaggagcgcgtcatgccgccacagccggcgccccagagcgtcggaacagaggatgccctggtcgaggagcgcatcccgccgccacagcccgttcccatccctcctatcgccggaacagaggatgccctggacgtcggcactgaggacgttcgaggacgagccgcgccacagagcgctggaacagagtctgctctactcgaggagtgcgtcctgccgccacagaccgcgccccagatcaccggaacaggggttgctctgctcgacgaggtcgttccaccgccacagaccgtgtcgatttcccctcccgcagcgctggtggacgctgtcgatgatgctgactgtgccaatcagggatgctccggcgtgatggacgattccacaatggtgttcagtcatcttccggacatgatcaccctgcccgcagaagaaggtgatgccgccggtggtgcagcgctggcgtcgatggactactcctgggctgattttgagttcccagagatcaacatggatgagttgcctaactgcatcgacttcaccacaactgaccccagctgcttggacattgagctctccatgggcgacctccatgagccccagagcactggaatagagtctgatctgctcgaggagttcgttccgcagccacagccagtgcttgttcctcctctggctgctctggttgaagttgccgatagctctgaaggccctgatcagggatgctccgttgtgatgcatgattcttctgcggtgtttactcatctgtcagacccgatcgtcctgccagaagaagaagaagctgatcgtcctgatgcgccggctgggactatgtcactagactatcagaactactccttgtctgatttcgagttcccagagtaccctctgctcgatgttgccggtgatgctgacggcgcagatcagtgctcttccaacgtgatggatgattcttccatggtgtttagtcaccttgaagacctgattaccctaccagcagaggaagcagaagccgatgcttgtagtgcagcgcctgcgccgtcgctggacaaccaaaaatactcctcacagggcatcatcgacagtgaggcgccggcattgtctgatttcgagttcccagagaccattgatgaggttctaaacagcatcaacttcacaatggccgacccgagctgcttggatatggagttctccatggacgacctcttagactttgatccgccggctgattag

SEQ ID NO: 5569 - DNA, 1524 bp, Oryza sativa
  Predicted polypeptide sequence is orthologous to G504, G1425
caacacccaaccccctctctctctctatctctctcctctctctctctctagctctagctctagctcgtcgccgccatgaacgttccaagcaaatgcatggctcctgcaaagtaaaaaaagaagaagaagcagcagctgcagcttctcttcagtatcgatctttaactgtatcgagctagcttagcttagcttagctctctgccattaacttgtgcttcactgagcttgagctagctagcttcttggctgtgtgactgagtagctctagctcctcgtcgtcgtcgtcgtcgtcgtcgtcgtcggcgtcggtggtggtgtgaattgatagaattgatacgatggagagggcggctgcggcggcgccggtggtggtgaggcatggaggagtggtgttgccgccggggttcaggttccacccgacggacgaggagctcgtggtgcagtacctccgccgcaaggcgttcggcctgccgctccccgccgccgtcatccccgacctccacaacctcttcaagctcgatccctgggacattcctggtgcgagcagcgacggggacaagtacttcttcgccgtgcggccacctgcggcgagggggaggaggcagcatgtgacggcgagcggtgggtgctggaagccggcgggcgggcgggacaagccggtggtggtggcccggtgcggcgggagccacctcgtcggcgtcaagaagggcatggtgttcgtcccacggcaagggaggaaggcaccggcggcggcggcggcggccgccggcggtggctgctgggtcatgcacgagtacagcctcgccctgccgatgcacaagaagggttgcttggctgaggctgaagaatgggtagtgtgccggatatttcagaggagcagcagcggcagccggtcgccgaggaggcctgacaacgacgtgaggcgaacgatgccggccgtcgccgagctcggccggtcgccgtcgccatcgtcgtcgtcgtcgcaatccagctgcgtcacaagcagctccgaccaggaagaggtcagcagcggctagctagctgaagaagaatgcaggcagcagcagcaagcagctaagctgcctctcaaagagaggcttgagtgttagcctagctaagcatatatatttatagccggccaaaccctctgaaagtgatctgcatcaatgcatgcccccctttaatttcttcttcctccttaattattttttcccaaccatgtaatgtaatgtaatttaatgtaatgcagtgtaatgtaacgggaaggaagcactgaattaatcaaattaaattaacaaatgaagagtgctcaaaagtccaaggaagcttctaaggttcaggagccagatattatctacttaattaattaattatgggcacatatctgtagttgctagctagctgcatatgcatctcgtcgttgtcgatccatttgtaacttgcaagttgtgttggtgtaatattgtaatatttttctccgatggttgagaaattaatctgaaatccattatagcaattaattgc

SEQ ID NO: 5570 - DNA, 407 bp, Oryza sativa
  Predicted polypeptide sequence is orthologous to G505
atactcgtatagcctataccgacgatacacacactttaaactacaacactggcaccatacccaatcccactcctttccactagacatccacacatgcagaaaacctcatcgtcgtccggcagcggcagcaacaggcgccttcgtccacgtcccagcctgcccagctcgatcctactcctcagcctcctgtccgcagcagcgactgtcggagtgactgcaagcgatgcaccactacagcaaggacaagggtaccactccttccagatagcaaagcgagggaggtcgtttgcagacgccaacggaatctttgaccccgagctctttgcacaggacagggagctcgtcgcggaaaagtacagacacagcaacgcacggtaccgccgtaatcttgaacgatcagcggcagc

SEQ ID NO: 5571 - DNA, 1531 bp, Oryza sativa
  Predicted polypeptide sequence is orthologous to G509
gacacaatcgccaacctatacagatatatgtgctagctacttccaagttcctacctatcaatttctctcctcctcttcttcttctctgcatcaatctgcagcttaattcttagctatgtacatatagctagctaccacttccaaaatactccacagagatcaatcacatatagatatagctagattgctatagacagagagatcatcaaagaaatttagcaggtgatagccacatggggttgagggacatcgagctgacgctgcctccggggttccggttctacccgagcgacgaggagcttgtctgccactaccttcataacaaggtggtgaaccagcatcgcttcgccggagttggaggagccgccgccgccggcggcggcaccatggtcgaggtggacctccacacccacgagccgtgggagctaccagatgtggcgaagctgagcacgaacgagtggtacttcttcagcttccgcgaccgcaagtacgcgacggggctccgcacgaaccgcgccaccaagtccggctactggaaggccaccggcaaggaccgcgtcatccacaaccccaagctgcacgccgccgcccaccgccgcgcctccatcgtcggcatgcgcaagacccttgtcttctaccgcggccgcgcccccaacggcgtcaaaaccaactgggtcatgcacgaatttcgcatggaaaaccctcacacccctcccaaggaggattgggtgttgtgcagagtgttctacaagaagaaggcggagacggagacggagtcgtcgtacagcatggagaacgagcaggaggcggtgatcgccatggcacggagcgccgcggccatcaaggcgggtggatgctactccaactcctcctcgtctcacgacccagccgccgccggccatcactcgcccccgccattcccggcgtcgctcgccgcctgcagcagcagccaccactacagcagccacccaccgccgcctcccgatcaccaccaccaccaccacatgcccgtcaccggcggcggcggcggctccctcaacgagttcatccccaccaccagcatggcgctgtacagcagcatcttcgacttcagccagcatctcgacggcggcgccgtggcggcgtcggcgtcggcggcgggatcgagggtcgacggcggcgagcagtgcggtctgatggagctagggctcgaggagcactacaactacaacggcctgatgccgatgtgacgatccaccataggtgtcggtgctgctagtgctagcttagctagcttacacacacccccagctgctagctagctgcagttctgcagcgcagctagctagcgtttattattaataacctcttttcacctcgattgtttgatctgatttgtttcgtggtgatcgattccatcgatcagcttgtgcagatttcgttgattgtgcatgcaaacatgcgcacctgtgtatagggtatagtggtacgtcgtatagcgctgttgcattgtttggaggtaaattatatatcttagcctttaatttgattg

SEQ ID NO: 5572 - DNA, 1077 bp, Oryza sativa
  Predicted polypeptide sequence is orthologous to G509
tgcacgtagtgttcgattaattcttgagctcatatattacttattcatccaaatagtattggtagcttgttgatcgaagaattaatccatggatggattgatcagtgatgatagtatgatgatgggtggtgaggtgagggcgatcgagtcgaggctgcctccgggtttcaggttccatcccagcgacgaggagctagtcggctactaccttcggaacaagcagcagcagcagcagcagcagacggcggccacctccatgctcgtcgaggttgacctccatgcctgcgagccatgggacctaccagaggtggcgaaggttggttcggatgagtggtatttcttcagctggagggagaggaagtacgcgacggggtggcgcaggaacagagcgagcaagcaagggtactggaaggccaccgggaaagacaagcccatccttcatccgacggtggccggcgccaggaagacgttggttttctactccggtcgcgcccccaacggccgcaagaccgcctgggtcatgcacgagttccgcctcctccatcatcatcatcatccaaacccaaatattcagaatatgcagcagcaggagggggatgactgggtgctgtgcagggtgttccgtaaggggaacaacagcaatggacaacctctagccacttcttcgccacctgctcatcacctggtggagtcactcatcagctcacctgcaccaactatcatgagcgatcacgatcggctcttcaccatccagctgccgcatcaccaacattgtgatgagcagtactttttcttagatgacgatgaacagcaccagcagcagctgctagatctttcagtgctccaagctccaacctcgttcgagtctgagcaagctccaggccacggtggcatggagattaatatcgcagagatggagagcttcgacacgacctgtgctgcgctgcaagacgcgagcgattactgcatgcagctctattaattaattcaatggatggatgaatcacacgtatatatacgcatagccttaaattaattaatgtgtatcatcagcttaattaattgcgcacttggctt

SEQ ID NO: 5573 - DNA, 1288 bp, Oryza sativa
  Predicted polypeptide sequence is orthologous to G509
aaaaatttacacctatatctatctatatttctcgtttgtgctcgggctagctcaccatatgcgtaaaattctgtagccaaaaggagcaagcaaactaggaggaggattagttcttgcgcatcgcttctgagctcgatctacgtcgtccggccggccgggagggatcgatcgatgggtctgagggagatcgagtcgacattgccgccggggttcaggttctacccgagcgacgaggagctggtctgccactacctctacaagaaggtgtccaacgagcgcgcctcgcaggggacgctggtggaagtcgacctccatgcgcgcgagccatgggagcttcccgacgtggcgaagctgacggcgagcgagtggtacttcttcagcttcagggaccgaaagtacgcgacggggtcgcgcacgaaccgcgccaccaagacaggctactggaaggccaccggcaaggaccgcgaggtgcgcagcccggccacgcgcgccgtcgtcggcatgcggaagacgctcgtcttctaccagggccgcgcccccaacggcgtcaagtccggctgggtcatgcacgagttccgcctcgactcgccgcattctccaccaaaggaggattgggtgctttgcagggtgtttcagaagagcaagggagacggcgagcaagacaaccccaccagcgcagcctccccggcggcgaccttcgccggctcgtcgcaggcggcggtgcctggccaagccgcgtacagcagcgacgaccatacgggctcgtcgatgggattcgcgccgaggcagaacgagatactcgacagctcgagccatcagttgctgaacttggcgatgctgcagtgcaactcggttctcgatcatttcccgcaggaggtgaacagctcgccgatgatggggttggcagggtccatcggaattggggatgaatacggcttcttctacgataccggcttcgaggagacggcgagcctcgggggcatgaggttcccacaagggtggagttgatgccaattgatcgtgcatgcagtgagatcatcgtgcctgcgcgcatttgcgaaggaaaatgattgaattaattccattgatacagttatttcgtcctaaaaaaataaactattgctactgtaggtagtgtttggtttagcatagaacctgcatgagatggttcggtcacttgaactgtatatatattgtgtgagtcaaaatgtatcgctctactcgtatgcaagttgatacaatccatcccaaagttccagttcatagatcaaacgatctatgagctatc

SEQ ID NO: 5574 - DNA, 1456 bp, Oryza sativa
  Predicted polypeptide sequence is orthologous to G509
aagaagagatcatatttagctatatctctagctagctgcgtctcgtcttctccaagctattgttacttagctagctttagctaggagagtaaaagatcgagtgatcattagtgagtttgattagttgattttgttggggttgagatcgaagagatcgatggccgggctgagggagatggagtcgacgctgccgccggggttcagattctgccccagcgacgaggagctcatctgcttctacctccgcaacaaggtcgccaaccaccgcgtcgcctccggcaccctcgtcgacgtcgaccttcacgcccgcgagccatgggagcttcccgaggtggctaagctcaccgcagaggagtggtacttcttcagcttcagagaccggaaatatgcgacagggtcacggacgaaccgtgcgaccaagacaggttactggaaggccacggggaaggaccggattgtccatgagggtacaacacgagcggtggtcgggatgaggaagacgctggttttttacctcggccgtgcccctaatgggcaaaagacgacatgggtcatgcatgagttccgccttgaaacacctaactcccaacctaaggaggattgggtgctatgtagggtgtttgacaagaagaagccatcgacaatagaagccgagggtggcggaagcagtggcagcgaccttttcattcccggtgccaccgatggctctactgacccctcctcgccgacgacgatggcacctctccttggctcatcgcccgatccgacagtggtggacaggttcgaccaccggtcagcggcggtgccaccattaatggtactcatgcaaggtggtggggaccaaatgatcagtggtagcggtgtccactgcagcaacaacgacaactccggtagtagcagcgcactgcttaacctgacgatgctgcaatacagcttcctagaacatcggccaactggtgacgacatggcggtgggggcccactttggaacatgccagggtggcaacaacgatgccacgatggcacttgggatggggtttgaggagcatggcatgggagagatcatagagatggaaccagcatggcgccaaggtggtagcaactgcgtgtacagggacgagctctacttctagcagaagtagtacaatggattaatattaatgatttgcatgtgttagagttcagttaaattcagaaaatatgtagagcttagaagaggtttgctagtttgtgattagagtgtgattattaattaaggtggagttaattaaggggtcgattagttcgagtggtcgtgatatgaaaatatttgtgtaattactcagtttgtaggtgagccatatatcaaacaactttagggaaaggggatgatcaagaattcagaaccaggatgaatttgatattcttgtactttaaaaaatgtaatgatgggaataatatttaaatctgattgagcc

SEQ ID NO: 5575 - DNA, 2565 bp, Oryza sativa
  Predicted polypeptide sequence is orthologous to G521, G2887
gggttgcttcctccgaaaatcctcatcctctccattgaccagacggcggcgcaggcgcaggcgctcacctccctcctcctccgcggcatccccaatcgaccagctggctcccctgcctcctccgcgattttgatcctaatcacccatgtctgctgaagtcagcgaggaatatccttatttcctctcctgctacttctggttcatatattgcataaaattccgagatttcacttgatacaagtggatcacctggagttttgtgctaatacttcctatcatgtgaatcagttgtagttagcataattggcaagactcaagttttctctcatctgggttcagaaacatttgtcggttgagtgctcgatctaaactctgcttgagtcttgccgaagattgtttctcaacaatcacgtcttctgttctctctgaggttggaccaatctcccttttggtctgatcaacctcctgatctcccttaagtgaaccgtcctgctgtgttcacgcaatacaatcttctgaagtcctctcttgttccttctgtgctcaaacatcaaaagcagctctctcctaagttctcttgattgtttgtgctcctaaattctgttgtttgagcactcaaacatttcccttactggtcaatcttagatcacttgttgattattggtattggcattatttggtgaagcatttctgcttgtaccttaaacaaaggtctctgttgtcttattggtgctgaaggcaagatatacactgcagtgatggctcaaacttgcttgccacctggctttcgttttcatccaacagatgttgaacttgtttcatactatttgaaaaggaagattatgggaaagaagcctcttattcaagctatatcagatgttgaactgtataaatttgctccctgggatcttcctgctcaatcctgtctccagagcagagatcttgaatggttcttcttttgcccacgagacaagaaatatcctaatgggtctaggacaaatcgttccacaccaaatggttactggaaaacaagtgggaaagatagaacgattgagcttaactctcgcattgttgggtcaaagaaaacactgatttttcatgaaggcaaagcacctaaaggcaacaggactgattgggtgatgtacgaatacaaaatggaagacaatcaattggtctctgctggtttctcaaaggatgattttgtcctctgcaaaattttcaagaaaagtggccttggtccaaggattggggagcaatatggggctccatttaatgaagaagaatgggagcatgcagatgctgaaatgtttcccttgctgccaaatgttgaaacttctgtgtttccattgctgccctcttcagaggtagtaaattctactgatgatacacgtgttcagccttctgttgctgccagagctattgaggaactacctgtgcagcatttacctcatgtatgtgctgggaatggatcaacatatcaaaatattactgttactggtgaaagtgctctcatggaactgccttcccagcactctgttgaatctattggtgatgaggtagtttctgtggacaactgttctaatgtggtcaataatgcagacagtcctgtaattgaggggcttgtattggaggaactttctaggtttttaactgattctcctcatcatggcaaccctgttggggagcactctggtctcccaccaatgtctgaggctgaagctcatgcttttgaggttagcacaaatgatctgtacaatgaaattgcagggcttgctgaattgggtgtgccaaatggtgatggattttctccgtccaatgctggtgttactgaacaacagcccacatactttggagttcctaacagtgaaaattatgtaaatatggatgatatctttgctccagacacaagattatcctatgcatatcctttgccaaacaaccaattttggcattatcccatggatcagttcacatacagtactactctatctgctgcctttccatctggtgactcgcgtccaactatgcgcattgttgatgatttacctgctgctgctaataacggtggctttgcttcaaaacccagcatgcagttcccactgtcataactaagtccagaaccgttctagaggactctgatactgatgacctagtgggattccatatgctggcagtactgcgcaacagatgtgtcttcatggccacctgctgccgctccgagctaagccaaacctcgctgaatctttctcgtggactgttgctggatttaccagtgctcgaactggtggtcactgcaagcattgtgaggccaacaatgtacattgttttgaaggtttggcctagttctcgatggcgatgctctatgatccgaacttgtctagcctggcgcgctactgaggatcagatattcgctttgtgttaccttatttacttgctgctgaataaagtttgtttatcaaactagtgtatattgtgttatgactgcacttaaaccttatgtaagtttgcatggtttggcctactatttacttgctattaatcttctcctaagttcgttgttttggc

SEQ ID NO: 5576 - DNA, 2255 bp, Oryza sativa
  Predicted polypeptide sequence is orthologous to G521, G2887
ggacgggagccgcctgcctctctccgctgcgcgccgcctctttccaattccacctcgccgcttctcctctcctctcaatctctcatccctcccttgtcgtaccgcatccgcatcagcaccaccatctcctctccgcggcggcgccgcatttccttccctcgccgaccgccaccaccagcggctccgcttgctcttcaaatgactcttgacatcaggaaggattatctctgttttccttgctgtggatgctcaataatatgccaaattcttaggccaaggtctatttggatctcgttatgctagtatagacaacgttccattctccttagtatggccaagacatctcttcctcctggattccggtttcatccaacagatgttgagttgactgtctattacctgaagagaaaattattgggcaaacacttacggtgcaatgctgtttcagagcttgatctatacaaatttgccccttgggatcttccagagaaatcttcgttgcagagtaaggatcgagaatggtatttcttttgcccacgtgataggaaatattctagtgggtcaagaacgaaccgatcaactgaagctgggtattggaaagctactggaaaagacagaccagtaatatataattctcagactgttgggatgaagcgaactttggtgtttcatcttggcaagccacctcggggtgatagaactgattgggtaatgtatgaatacaggctggaggacaaggaactgtctgcttctggtgttaaactggatgcttgtgttctctgcaaaatctttcaaaaaagtggtccaggtcccaagattggggaacagtatggtgctccattcaatgaagatgattggaatgaagcgaacggggagctatcctcttttgccttttctgtgcccccttgtgcgctggaatcaagtaatggcaggttaaacacagctggtcagcagctggctgttagtgataatattggatcttctttggaccattgttcagaaactaatgacaagatcgctgttggtggctgtgggacgactagtcctagcgttccttttgataccatacatacccagcagctagatgagattatcagttgtttctcgacagatcttttgaactccgttagtcgagatggttcattgcctgactcaactgctgactatgataatgacaatgaagtatcgtccgatgatggtgaagcaatatttaatgaacttgatgaacttgattcccaatcagatgagagcatttccaaccattgtaactcatgtggtgaagacttgattcctcctacgctggaagtacttaaaactgaacagtacttggagctgaatgacttgtccttttctcttgccgatgatcctgatccatgtaacctgctgctgacaactaatctatctgatcagaaccatccagaattagagaccaggtttgagcaggggtctcttgttgacatctgcaataccactaatgctaccatatccaatgctgcctgttcagcgtcaacagttggtgatcatgtgacctgaatcacaggtatggctcctatacctatagcctgaaccagacgggggttcgttcgctcgctgttacttgaggcatgtcatggttcttctgtttcctgtttattgaagtgcattttacagctcaaacaggaaggcgctcagattatgagattgggagttgcagctagtttgcgaagattcagtttgggccaattcaggagaattcgtggttcatggacatttcgcttaccctagtttgcgaagaagattttgtcaccaataagggatcggtacgaataactcgttggcgacgttggatcacttgtccttaaaaagatgttggaagcctgattctggagcggacagccttacattcctggtgatcccctgagcttgtgtggtgcttactgccgtccaaattagtactcctaggcagctagtaggaatttcctctttttttttcctgttttacctgtacgagcggtctgtctgatcatctgatgtatgctaacgtcaatagcgagttacgcagcagcgtagtacaaagctcaactattaggctagattagagagagacggcgatggtgacttttcgcaacgaacctagattgaacatgttgcaaactaaatgttggcacagctaaatattcttaaaaccaacgactaaatgtaatatgcgcaaatctttgaccatacccatacgttgcagatgcaattaattaatgaaaccttacatctgatttttc

SEQ ID NO: 5577 - DNA, 1753 bp, Oryza sativa
  Predicted polypeptide sequence is orthologous to G522, G1453
atccagatgcgcttgcacttgcacttgcatgcagttcattgctctagctataggctatagctactatacactcatgagaatctgagattgggctgaaaattgatgagcatcgatctgaagaagacatatatatagctgatgatgatatagctttttctgcatatgcttgttttgatctgcagccaatcgatcgaggcatagagagtcaccaggcaatcaaattccaaccatccatcagctagatatatatacagcaaagatcacgatactcctagctagctagctagaagaattgatcggtcgatcggaggaaatagcaatggatcggcatgaggaggaggcaggagagtctccatgtgtgccgccggggttcaggtttcacccgacggaggaggagctggtgggctactacctcgccaggaaggtggcctcccagaagatcgatctcgacatcatccaggagctcgatctctacaggatcgagccatgggatctgcaagagcgttgcaagtacggtgggcatggcggcgatgagcagacggagtggtacttcttcagctacaaggaccgcaagtaccccagcgggacgaggaccaaccgcgccacggcggcgggcttctggaaggccaccggccgcgacaagccggtgctctcgtcgccgtcgacgagggtgatcgggatgaggaagacgctggtgttctacaagggtcgcgcccccaacggccggaagaccgactggatcatccacgagtaccgcctccaatcaaacgaacacgcccctactcaggaggaaggttgggtggtttgccgcgcgtttcagaagccgatgcccaaccagcagcagcacaggctgtcctacggctgcatccccggcagctacggcgccggagcctacgccgccgtccccgacaactacagcttgctgctgcaccacgacaaccctagcttcgccgggcggccattgatgagcgccgctgcctcagctctcttcgccaacaacaacaataacagcgtcgtcgaccacagcaacattctgagttcagagtccaagcttcacttctccgacatgatgccgcctctggagagccccaccatcgtcgacggcgagggctacgtctcgcaggctagcagctgcgtcgacgtcgatcagcaagccggcatcgtcgactggaacctgctcaccagcttgctgccgccgccggcgcatcagctcttccaccacctgccttccgcttctagctccaagaacagcaacaacatttcttcgtcaggcttcatcgatgaccgagactgatcgatcgatccagatcgattattatcaattgacaattcattcatcatatatatgcatgaattcttacaaatacgcacaattaaacgatcgagtgtactattaattagttgattactccgtctccatgatgtatacattaatttgaccactggccatcatcaggccatctgcatgcttactatctagcttatgtcagtacacggttgttagttcattcttaattaattagctactagtgtcagtgtgtgtatctatcggttgttcgtcttttgacctcattgctgagagaggtttgtaactgatgatgattaagttagctagcatttaattaggtgctatatatacacatatatatgcactatcactatatacatcatatatatgtatacatatatcgttgtctgcttaatgtgtacaccacctctctgcagtatatatagtattgatcaattaatttgt

SEQ ID NO: 5578 - DNA, 1418 bp, Oryza sativa
  Predicted polypeptide sequence is orthologous to G522, G1453
ctcatgcgatcgatatagctgctccatccgtttgaaggctggctgctgctggccgagggaggcgctgcatgctgctgcaagctacgaagcagtagcaattgcaggcgcgcgcgcacaagttcatattaacttgctaccagttcgggagctatactttgatccgcggaagaagatggacgcattctcccatgtcccgccaggttttcgtttccaccctactgacgaggaactcgtggattactaccttaggaagaaggtagcactgaagaagatagacttggacgtcataaaagatattgatctgtacaaaattgagccttgggacctacaagaacaatgcaagattggaaacgaggagcagaacgagtggtacttcttcagccacaaggacaagaagtacccgacgggcacacgcaccaacagggcgaccactgccggcttttggaaggccaccgggagggacaagccgatctatgtcaagaactgccttgttgggatgaggaagacgttggttttctacaggggccgggctcccaacggacagaagtcggactggatcatgcacgagtatcgcttggagaccaacgaatacggagctccccaagtaagtttgtgtactagtgcatgcatgctaccgaggattcagacttcagacacctaacatgctccatgttcaggaggaaggatgggtggtctgcagggtgttcaagaagcgagtcgcggcggtgcaaagggcggccggcgacggcggcgactcacctttctggttcaacgagcacgtcgcgttcatggcgccggcgccaggcctcgactcgccgtaccatggccaccgccagagccacccttgcaagctggaggtagagtatcaccaccacctccttcctcaggaggcggcgccgttcatgcacctcccaaggctggagagccccaagctaccggccgccgacatcattgtcgccaccgcagcgtcgtccgctctccagccgtgcggccacacgacggcgcagcagctgcagctgcagatcgagccggtctacgtgacggccgatgcgtcggcagcagattggagggatcttgacaagctggtggcgtctcagttcggccacggcgactcgactgcgaaggagcccagttactgcaatccggtgcaggtgtttcaggtcgaggggaagcaggaggatagcttggattacgtgtccacgtctgcctcctgcggaggggaggaggatttgtggaaatagccgcgtgaatgatgcaaaacacatactaacatatacgccattgtatacagcctaataacattgcggtgtgatttgatacagtgtataaatagctagcattgtcatggtaattaccaactgcccatctatatatactaataaagtataaccgaagtggttatacatgcatgcatgatt

SEQ ID NO: 5579 - DNA, 1346 bp, Oryza sativa
  Predicted polypeptide sequence is orthologous to G522, G1453
aatttgcttctcatctttcttctctactcctctcaaatacaagagctcacactgctccctagcttccttcttcatcccttgaactagttgtcagctactgaccagcctgaagatagatgctagtttgtgtagagaattcgatcttctgaggcgtatggtgatcatggagtcatgtgtgcctcctgggtttaggttccaccccaccgacgaggagctcgtcggctactacctccggaagaaggtggcctcgcagaagatcgacctcgacgtcatccgcgacgtcgacctctaccgcatcgagccatgggatctccaagagcattgcaggatagggtacgaggagcagagcgagtggtacttcttcagctacaaggacaggaagtacccgacggggacgaggacgaacagggcgacgatgacggggttctggaaggcgacggggagggacaaggcggtgcgtgagaggagcaggctcatcgggatgaggaagacgctcgtcttctacaagggcagggcacccaacggccacaagaccgactggattgtccacgagtaccgcctcgagtccgacgagaacgccccgcctcaggaagaaggctgggtggtgtgccgcgcgttcaagaagcgaaccatgcagccgccgcggagctccatcggagcatgggaggcgagctactcctaccacgaccccgccgtcttcgtcggcggcggggaacacttcaagcaagaggccgcggccgagctggacggcgtcgccgccgccgccggagctaacgccttcctgcggtactccacccgcctggccgagctcccgcagctggagagcccgccgctgccaagccaggggagccaggcggcctcggccgtcgtcgacggcgaggaagataacgccgattctagcaggcgccctggcggcggcggcggcgccgccgccgcggtgaccacggactggagggcgttcgacaagttcgtcgcgtcccagctcagccccgaggagcagcacacctgccgggccaccgacgacgacgacatggcagcgctgctgctcctcgacggcggcgggcaggaggacgacgccgggaggtggctgggctccgccgggttgctgagcgccgtggcggccgacgcgacgacggactgcggcctcggcaccagctgcgtgcctggcgacatcaactgattcagggccaagccgatcgagctctcacttctccttagcataaagtgtgagatatctacgaattgtatggatggctatatatacgtacgcctatacatatgtagctggtcaaagcatcgtttcagtttcagtttcagttcttggaagtcaatggatgttgaccatt

SEQ ID NO: 5580 - DNA, 2350 bp, Oryza sativa
  Predicted polypeptide sequence is orthologous to G522, G1453
gctagcttcgccatccacattcttcttgcttcttgctcctctctctctctctctctctctctctctctctagcttcctgctgcatcttcctcagccatctctttcatcctcccagtcgtcccaggctgcttaattacatatatctagatatatatattattcttgttaatttcgatccatcagtgtgcaatatatatatatagttttacctctaatatttagcttcttaatttctcctcatttttctgcctgtgctactgcatacatgcgttaattcatggtcgccatggatcgcatggagatccgtttctttactactccacttgttttctctagctactagttttctcttcttcttttcatcaaacaatcaatcaatcatatcccgttctatcttcacacatcaaccccgttccctgttctccgttctctctcagctgcagctagctacctctcctcctctcttccgatctctcatcaggatcggatcgaggagggaggagggagaccaacgatcgatcgagccatccaggatttactagtcaatcaacaactttatatatcatgcagctgatgcatccacacatctagataacgagctagatagctagctagggatcgagaaggagagagaatatatacatactgcatatatatatgcacattgatcgagcaactaatccagacagggatcgacaagagaacaaaagttcattcatgtctcctagctagctactcttatctgctacctatcgagattcatctttggatttctacaaggattttgatcacatcatacactgattttaacccaaccaaccacgactgatcaaaccaaggcaagcagaggcaggctctcaaatatatagatagatagcgatcgatcgatcgaaatggatggatctagtatgagcagcagcagcacgcagcagcaggcgcaggttcctcctggatttcgtttccacccgacggacgaagagctggtggattactacttcggaagaaggtggccgcaagaaggattgatctcaatgtcatcaaggacgtcgatctctacaagattgagccatgggatctgcaagagcgttgccggatcaatggcgggtcggcggcggaggagcagaacgaatggtacttcttcagccacaaggacaagaagtacccgacggggacgaggaccaaccgtgcgacggcggccgggttctggaaggcgacggggcgagacaagcccatctacgccaccaagcagcacagcctcctcgtgggcatgaggaagacgctcgtctactaccgcggccgcgcccccaacggccacaagtccgactggatcatgcacgagtaccgcctcgagaccaccgagacggccccgccgcaggaagaagggtgggtggtatgccgggtgttcaagaagagattacccacaacaagaagagattcagaccatgacgcaccttgcggcagctggtacgttgatgaagatgcaccgggcgccttcatgtctccgatgatgatcaccagatcatcaatattgcgcccacaccaacaccacgccggcatcacgctgcaagagcaacacctccacaccacttacaagcacagagacctcactactaagattcagcagctccaagtccctgcggcaggccatcatctcctcaacaccatgccccatgacctggagagttctacttcctccttccattctcttttggtctcacctgatcaccaccaaatcaacatgcaccatgctcaggctgatcccttctttgacgacatgcatgcagtcgatcaagccactaccactgactggagagttcttgacaagtttgttgcctctcagcttagcaatgatgctacaaacaagcctgcggatcattatactgatgaaggagacattcttcaggtcagtgacaagcagtaagaggtggcagccgccgattatgcgtccacatcaacgtcaagcagccaaattgatccatggaagtgatcgatccatgcatgatcgatgccctgcacgcatttaatcaagatatattatatcttatagataaaattatctcaataatgattatgatcgtatcgtatcaattggacagatcgatacaagtggtttgagctacatattaatgccgtgtaaataagactactctagctagtacaacgtgtggtgtttgtgtgctgcttatatatatattgaccttcgtacgtgtgtttctatatgaaataaggtcatggaggacaaattaaaagcttcatgaatataatcgtggtttgtaatagataaacctcttctgctatgtgattgtaaacttctggtgtttcaacatatgtaacaagtacgccaatatgc

SEQ ID NO: 5581 - DNA, 1101 bp, Oryza sativa
  Predicted polypeptide sequence is orthologous to G522, G1453
atggaatcatgcgtccctcctgggttcaggttccaccccaccgacgaggagctcgtcggctactacctccgcaagaaggtcgcctcccagaagatcgacctcgacgtcatccgcgacatcgatctctaccgcatcgaaccctgggatctccaagaacattgtgggatcgggtacgatgagcaaagcgagtggtacttcttcagctacaaggacaggaagtacccgacggggacgaggacgaacagggcgacaatggcggggttctggaaggcgacggggagggacaaggcggtgcacgacaagagcaggctcatcggcatgaggaagacactcgtcttctataagggcagggcgcctaatggccagaagaccgactggatcatgcacgagtaccgcctcgagaccgacgagaacgcgccgccacaggaagaaggatgggtggtgtgccgagcattcaagaagaggacggcgtatccggcgaggagcatggtggagacgtgggactactccttgcacgagcgcaacatcatgagcgccgcggcggcggcggcgttcgccgatccgagcgcggcgtacgcgcagatgaggcggcagcacaggagcgggcggttcaagcaggaggcggagctggacggcgccgccacagccctcctccactactccagccacctcgccgagctgccgcagctcgagagcccctccgcggctgcggcgccgctccagcccaacccgagccagctggccaccgccggcgaggacgacgactgcaagggcgataatggcggtaggagggccaagaaagcccgcgccgccggcgacaaggtggcgacgaccacggactggagagcgctcgacaagttcgtcgcgtcgcagcttagccccggggagtgtggcagcatggaggcaacggcggaagccgcggcggcggcagtcgccggtgtgagctcgccgctggaccacggcgatgacgacatggcagcattgctgtttctcaacagcgacgagagagacgaggtcgacaggtggacggggttgctcggctccggcgccggcgcgagcggcgtcgacggcgacctcggaatctgtgtgtttgacaaatga

SEQ ID NO: 5582 - DNA, 495 bp, Oryza sativa
  Predicted polypeptide sequence is orthologous to G522, G1453
atggagtcatgtgtgcctcctgggtttaggttccaccccaccgacgaggagctcgtcggctactacctccggaagaaggtggcctcgcagaagatcgacctcgacgtcatccgcgacgtcgacctctaccgcatcgagccatgggatctccaagagcattgcaggatagggtacgaggagcagagcgagtggtacttcttcagctacaaggacaggaagtacccgacggggacgaggacgaacagggcgacgatgacggggttctggaaggcgacggggagggacaaggcggtgcgtgagaggagcaggctcatcgggatgaggaagacgctcgtcttctacaagggcagggcacccaacggccacaagaccgactggatcgtccacgagtaccgcctcgagtccgacgagaacgccccgcctcaggcaagatctccatttatctctctctcaatcaacaagatcgatctacagtttctagaaaagattaattag

SEQ ID NO: 5583 - DNA, 1308 bp, Oryza sativa
  Predicted polypeptide sequence is orthologous to G525
ccttaaccacttcatcacttctctcgtcgatctagtctaaaaggtttagtagatgcgattagccaggcagcagcagcaggtggtggtggctgcgacgatggagcatgacgtgcaccaccaccggcagatgatgcagcagcagcagcagcaggagatggacctgccgccgggcttccggttccaccccaccgacgaggagctcatcacgcactacctcctccgcaaggccgccgaccccgccgggttcgccgcgcgcgccgtcggagaggccgacctcaacaagtgcgagccatgggacctgccatcgagggcgacgatgggggagaaggagtggtacttcttctgcgtgaaggaccggaagtacccgacggggctgaggacgaacagggcgacggagtccgggtactggaaggcgacggggaaggaccgggagatcttcagggggaaggccctcgtcggcatgaagaagacgctcgtcttctacaccgggagggccccccgcggcggcaagaccggatgggtcatgcacgggtaccgcatccacggcaagcacgccgccgccaattccaaggatcaggagtgggtgctgtgcagggtgttcaagaagagcctcgagctggcgccggcggcggcggcggcggtcggcaggagaggcgcgggcgcggggacggacgttgggccgtcgtcgatgcccatggcggacgacgtcgtcggcctcgccccgtgcgcgctcccgccagcgcacgtgacctgcttctccaacgcgctggagggccagttcctggacacaccgtacctcctccccgccgccgatcccgcggatcacctcgccatgtcctccgcctcgccgttcttggaggccctgcagatgcagtacgtccaggacgccgccgccgccggaggagcgggcatggtgcacgagctgctcatgggcggcggctggtattgcaacaagggcgagagggagaggctgagcggcgcctcgcaggacaccggcctcacgtcgtcggaggtgaaccccggcgagatctcgtcgtcgtcgcggcagcaacgcatggatcatcacgacgcgtccctctgggcctattgaaatattcattcatcatcattgaaaattgcattagccattattattagtactgttggccaccgattattgattgtgttgtaatattggtattgttgattataattaattagtacgccaaagagacaaatcacaagagaacgaagtgtgtatgctgtagattaattccgtatgtttgtgaaaatattcttgaacccaagtgaatgttactagtgcttttc

SEQ ID NO: 5584 - DNA, 1548 bp, Oryza sativa
  Predicted polypeptide sequence is orthologous to G525
gatatacaacgatttcctcttgtcaccctgaatctacttctgctgcaaaagcaataagcaaggagcagttagccaggtaaagctctagctagctagcttaggcagcaatggagcagcatcagggccaggcaggcatggacttgccccctggcttccgcttccacccgaccgacgaggagctgatcacgcactacctcgccaagaaggtcgccgacgcccgcttcgccgccctcgccgtcgccgaggccgacctcaacaagtgcgagccctgggacctgccatctctggcgaagatgggggagaaggagtggtacttcttctgcctcaaggacaggaagtacccgacggggctgaggacgaacagggcgacggagtccgggtactggaaggccacggggaaggacaaggacatcttcagacggaaggccctcgtcggcatgaagaagacgctcgttttctacacggggcgcgctcccaagggggagaagtctggctgggtcatgcacgagtaccgcctccacggcaagctccacgccgccgccctcggcttcctccacggcaagcccgcgtcgtccaaggtacacgaacgcacgtacgccgcgtgcgtgtgtttggttgtgaccagtttgatcgatcgatcgatcgatcgattgagcaggccggactgacacgccgtgggtttttcttgttggtgcgtagaacgagtgggtgttgtgcagggtgttcaagaagagcctcgtggaggtgggcgcggcgggagggaagaaggcggccgtggtgacgatggagatggcgaggggagggtcgacgtcgtcgtccgtggcggacgagatcgccatgtcgtccgtcgtcctccctccgctgatggacatgtccggagccggcgccggcgccgtcgacccggcgacgacggcgcacgtgacctgcttctccaacgcgctggagggccagttctttaacccgacggcagtacacgggcacggcggcggcgactcctcgccgttcatggcgagcttcacgcagtacgggcagctgcaccacggcgtgagcctggtgcaactcctggagagctgcaacggctacggcggcctcgtcgacatggcagcgtccggcagccagctgcagccggcggcgtgcggcggcgagcgggagaggcttagcgcgtcgcaggacaccggcctcacctccgacgtgaacccggagatctcgtcatcctccggccaaaaattcgaccacgaggccgcgctatggggctactaaggtttgatatgatcagcgccgtgtacgttaatcgcgggcgattagcgaagtagcgattactgtaaataaaaccatgagatcgcgatcgaggcatctaccaaggttcgcttaatttgcttgtacctataggtgtagattatttggtgatttgggagatgtaattagcattgtttgtttgtaattcgtatcagaatgatcgatgcagtattgtttggagggttagttaagcaattggccactcctcagttgccagttaattagttagagttgcttaatttagctctttct

SEQ ID NO: 5585 - DNA, 1229 bp, Oryza sativa
  Predicted polypeptide sequence is orthologous to G525
ctggtagagtggtaattgctcgcgcgcattctgcatgcatgagcgcgcgcggcggtgtcacgatggcaggaggcggaggcggcgaccgcgcgccgtcgtcgtcgtcgacggcgatgatctcgcgactcctgccgccgggcttccggttccggccgaccgacggggagctcgtcgcccactacctcgcccggaaggcggccgacgccggcttcacctccgccgccatccgcgacgccgacctgtaccgcgccgagccctgggacctcctgccgccgccgcgttgtgatgcggcggaggaggaggaggaggaggaggaggagcggtgcggctacttcttctgcacggcggcggcggcggcggcggccgccccgtgggggtgaagaagacgctcgtgttctacagggggagggcgccgaggggcgagaagacgacagttgtcgcccgcagtgagtgggtgatttgcagggtgttcgtcaggaagacaccagatggtaacaacgataggggaactacagaacatcatcttccctcctacgacgctcatctccgttcgtcgccggcgccggcgaactctgtggacggcgcaggccatgcgagctgcagcttcttctccggtgctaatgagtccatggcgccaagcgaccatttcaacataggagacgacatgatcctccatggccacgacgaggaggagttgctgatgatgaactgttcttcggcttttgatctgccagagcttctcgactacgagagcttctcgctggacctttgatccaacgagcaatggcatgttctaaaatctaaagtatgatctggttacttctcttaatacaaaagatacataagtcttttgcgtattctccaaaaaaatctgaaggatgatgcagctagctagctagctagctagatcgatcaatcgagatatatatgaaggccataatttgatcattagatgcatatgcatcatccatgtctacttcttcagatcactagctacttaatatgtcccctctctgtaattaaacttgcacgtatctgtatatatatttgtactgtagtcattcatgtaatatacgttttgtgtttgcgtattttatacacgcctctatttcaggcgctcttagcatttcttttactttcttagattataaaaactagtgtgtggttgtgtgtttttgctgtgtacatcttacttatatagagagttaaataaaaactctactatcttt

SEQ ID NO: 5586 - DNA, 1587 bp, Oryza sativa
  Predicted polypeptide sequence is orthologous to G526
ttttattcatcacaacaccatccatccatcttaattcgcttctacattggggcgcttgttaatttacatgcgagcttgttgaggttgaagcgatcgggatcatcgttgagagctgtagtacgtggtgagcatgggagagcagcagcagcaggtggagcggcagcctgacctgcctccgggctttaggtttcacccaacggacgaggagatcatcaccttttaccttgcacccaaggttgtggacagcaggggcttttgcgtggctgccattggagaggtggatctcaacaagtgcgagccatgggacttgccagggaaggcgaagatgaacggggagaaggagtggtatttctactgccagaaggatcggaagtatccgacggggatgaggacgaacagggcgacggaggcgggatactggaaggcgacggggaaggacaaggagatcttccgcaaccaccacatgctcatcggcatgaagaagacgctcgtcttctacaagggcagggctcccaagggcgacaagaccaactgggtcatgcacgagtacaggctcgccgacgcctctccgccacagccgccgccgccgccatcctccgcagagcccccgaggcaggacgactgggccgtgtgcaggatcttccacaagagctccggcatcaagaagccggtgcaggtgcccatgcagatgccgatgcagatgcagatgccggttgctcatcaggtgcccgccgccaactaccagcagcagatggccatggcctccgccagcatcatccaagtccccatgcagatgcagatgccctccatgtctgaccagctgcagatgttggacgacttctccaccggttcactcatggcgccgcctccgcctccgccttcctactccactctacctggcttcccgcttcagatcaacggcggcgcccagcagtttgttgggaacccgtcgatgtactaccagcagcagcagcagcagcagcagcagcagatggacatggccgccggaggcttcgtggtgagcgagccgtcgtcgctggtggtgtcgccgccgccaacatggacgctaccatctggaagtactgatacatacatacatacatacatacatacatagatacatacatgcatgcgccgatgcgcgagtgtgatgacagagggtggtgggttaattagctatactccatttttatgcatatgcatcatggcttttgcattgcctttggcttcttgtgtgatcgatgtgagtgagatttgctgagagattattagttattatagattggctagctatattatcatatactgtatgtactaataatatgtgtgtaccagcaatatgtatgtgtgtgagcgtgcagccgtgcaccgtatagcaaggtatagttacaggtatatacatacaagatatatataggtatacatgcatgcgtgatagataaatgtgtgtactgcatgtatttgtgcgtgagcccagcttgattgtgttgtacatagctagcagtgcatgccttctatccctccgtacggattgaattatgtgaattaattattttgtttaattataacatgcatggtgtatggtgt

SEQ ID NO: 5587 - DNA, 1644 bp, Oryza sativa
  Predicted polypeptide sequence is orthologous to G526
gcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcggagtcggaggtgtcggtgatcaaccagctggaggaggaggagactcggctggagctgccgccggggttccggttccaccccaccgacgaggaggtggtgacccactacctcacccgcaaggcccaggaccggagcttctcctgcgtcgtcatcgccgacgtgaacctcaacaactgcgagccatgggacctcccaagcaaggcgaagatgggggagaaggagtggttcttcttctgccacaaggaccgcaagtacccgacggggatgaggacgaaccgggcgacggccagcgggtactggaaggccaccgggaaggacaaggagatcttccgcggccgcggcctcctcgtcggcatgaagaagacgctcgtcttctacatgggccgcgccccccgcggcgagaagaccccctgggtcatgcacgaataccgcctcgacggcaagcttccccccaacctcccccgctccgcaaaggaggaatgggcggtttgccgggtgttcaacaaagacttggcggcaaagattgcccaaatgccgccgcctcccttcccgcgcaacgactccttcgacctcgacctcgacgacttcctccacctcgacgccgacctgccgccgctcatcgacgaccccttcgcctccacctccacgctcaagacggagccacctccgccggccaacctgatgcacaaccactacggctacttctccctcccggcgtcagcgaccaattataaccacagctccggcgccatggcggaccaggcgattcggaggttctgcaaggcggaggcgtcgacggcgtgcttctccggcgccgacgctgacgtggatccggtggtggacgagctgctctccttcccggactccatcacggactactcctacatatggaaggcctgaccagattaatttcgtggttaatttgccatatgatcgatcagattaatcctgtttaattagttggtttattaacttgattactgtcaaaggtttgggttaactaggagatgatgatgatggagtttgtggtgatgcgagagagagagagattaggtcgcgctgatctggtctgatcaaggtgtgcagagcagatggagcggactaattcattaattagcttaatcaaattagttatataggtttgtttgtcttaattctgtatgtatatagttatctgattggggataatacatagagattactagctagctagctagtttggtgattaggggggtgatgagctagctagagagagatatctcatcaaaattaaggtctcggttggttgattaatctgcagattatatattgccttgtgtgtgataggccatgtggcctctttctgtgtatgtgtgtgtgtggatggaaggagtaaattaactaaaccccttgtacatgtaccatcagttgtgctttacttacatgatcaattcaaccattgatcgatt

SEQ ID NO: 5588 - DNA, 1570 bp, Oryza sativa
  Predicted polypeptide sequence is orthologous to G526
gcattatacctttatccccttcatttctgttccatttctcatccatcgcgcgtcgtctccacctttgttgcttgtgccaccaagctatctcctcctctcctctctactagtgcttctgcttgctcgatcagcagtgagcttcaagctagctagcaagcatggtggagactagtacatcccttgtgaaattagagcaagatggcagcttgttcttgcctccaggcttcagattccatcccacagatgcggaggtaatcttgagctacctcctgcagaaattcctcaaccctagcttcacctccttgccaatcggcgaggtcgacctcaacaagtgcgagccatgggatctcccaagcaaggcgaagatgggggagaaagaatggtacttcttcagccacaaggacatgaaatacccgacggggatgcgaaccaaccgagccaccaaggagggatactggaaggccaccggcaaggacagggagatcttcaacctgcagcctaccagctatggaggcagcagcaacaacaagaataataagcagctggttgggatgaagaagacgcttgtgttctacatggggagagctcccaagggcaccaagaccaactgggtgatgcacgagttccgtctccacgccaacctccacaacgacaacccgaaccttcgtctcaacctcaaggatgagtgggttgtgtgcaaggtattccacaagaagggagacgatcgcgaagccatcaacaagcagcaggcacaggctgcagctgttgatcagtactctgccggaacacccaacaacggcagctccgtcgaagccggcgacgacgacgacgacttgttccagctcgactccatcatcgaccccagcatctacttcagcaactcatcagctgccaacatcttgtcggcgccgcccaacatgtccaattccgtcgtcgctgccaactacggtgcaagtacgacgacgactggtactgctagtgctggtagcttccagcagcagccaaactactgcagcttgatcaacaaaagcatcagcagcagcaatgtctcctcttggaataatatgcctccacctcctcctgtagctgaaggaggagtccatggaattggaagcagctacagcttgcagcaccaggcagcaatggtgaaagccctacgagatgtcattcgtctcccaaatcctcttggcatgccgcagtacaagttagatgatgcttatctatgggactcatcgtaatagctagtgctgctgctgctgctgcttaattacgtgctgagaatttttggtgctcgatcggctagctacggcactactgaattgagcatgtgcctggatactttgcatggtcgtttggtcatcgaattattaggaatatactatatagctatacattcgtgcaattttgttgattgctttgttgtttagttttggtcttctgtacaaagatcatgacattttgcttcgtgagtttcttgctggtaatgctgattgatagatgttctcttgcggcacatatttttggaacttgctatataatactctagcctttaatttggtggcatttgtgg

SEQ ID NO: 5589 - DNA, 1796 bp, Oryza sativa
  Predicted polypeptide sequence is orthologous to G526
gaaccccaagtccattctctcgttcccaaaccctgcatccttctctttcacacaagcctctctctcgccggcttcggcgtccgtctcctcctcctcctcttcgtctagccttgtggcggcgtgcggtgcggtgcggtgaggaaaggagggagctttgaaggtcgggggagggcggaggagatgtctgaggtgtccgttatggccgaggtggaggagacggcggcggcggcgccgctggacctgccgccggggttcaggttccaccccaccgacgaggagatcgtctcgcactacctcacccccaaggccctcaaccaccgcttctcctccggcgtcatcggcgacgtcgacctcaacaagtgcgagccatggcacctcccagccatggcgaagatgggggagaaggagtggtacttcttctgccacaaggaccgcaagtacccgaccgggacgaggacgaaccgggcgacggagagcggctactggaaggccaccggcaaggacaaggagatcttccgcgggaggggcatcctcgtcggcatgaagaagacgctcgtcttctacctcggccgcgcgccccgtggcgagaagaccggctgggtgatgcacgagttccgcctcgagggcaagctccccagccagctcccgcgctccgccaaggaccagtgggcggtgtgcaaggtgttcaacaaggagttggcgctggcggcgaagaacgggccaatggcggtgaccgaagcgaccgccgacgacgcggggatcgagcgggtcggctcgttcagcttcctcagcgacttcatcgaccccgccgagctgccgccgctgatggacccttccttcgtcgccgacatcgacggggtggacgacgccaaggtgtccgcgtcgacctccgggcaggccgcgatcgccgccggcttccatgtcgcgtcgcaggtcatgagctaccagcaggtcaagatggaagagccgttgccgctgccgtacctgcaccagcagccgccgcggatgctgcactcgggtcagtacttctcgctcccggcggtgcaccccggcgacctgacgccgtcggcgatccggaggtactgcaaggcggagcaggtctcggggcagacgtcggcgctcagcgcctcgcgcgacaccgggctcagcaccgaccccaacgccgccggctgcgcggagatctcgtcggcgccgacgtcccagccgttcccggagttcgacgacgggattctgggcctcgacgacttctggaactaatccactcctgaatgatccggagctagctccctaccgaccttgcgctacaggattttgcttcaggctggttgattaattacttgatttgattaattaacttggtgtttcatgcttgggttaattagtggcagtttgttgatgcatccttctcttcctccttccgatcgaaggcttcttctcgggatgggttcggatgatcagattatttatcatccatccagacctccagggattagctaggactccttgttaattaatcctagctagctaggtttcttcatgtcttgatctgatgtaaatacaattactactactaagtacggggtatcctgattgtgtctagtagcatgatgattgattatactacaatcaatggggtgtagattaggggtggattgatcatttacgaattgattaatttggcatttgatgagccagctagctgctagctttataaagctttatactatgtacatgtaccattaattgcttgagctagacatctcatcatatgtgaattgatgcttcggtttagcctt

SEQ ID NO: 5590 - DNA, 963 bp, Oryza sativa
  Predicted polypeptide sequence is orthologous to G526
atgggagagcagcaacagcaggtggagcggcagccggacctgcctccgggctttaggtttcacccaacggacgaggagattatcaccttttaccttgcacccaaggttgtggacagcaggggcttttgcgttgctgccattggagaggtggatctcaacaagtgcgagccatgggatttgccagggaaggcgaagatgaatggggagaaggagtggtatttctactgccagaaggatcggaagtacccgacggggatgaggacgaacagggcgacggaggctggatactggaaggcgacggggaaggacaaggagatcttccgcgaccaccacatgctcatcggcatgaagaagacgctcgtcttctacaagggcagggctcccaagggcgacaagaccaactgggtcatgcacgagtacaggctcgccgacgcctctccgccgccgccgccatcctccgcagagcccccgaggcaggacgactgggccgtctgcaggatcttccacaagagctccggcatcaagaagccggtgccggttgctcctcatcaggtgcccgccgccgccaactaccagcagcagcagcagatggccatggcctccgccggcatcatccaagtccccatgcagatgcagatgccatccatgtctgaccagctgcagatgttggacgacttctccaccaccgcttcactctcactcatggcgccgccttcctactccactctgcctgcaggcttcccgcttcagatcaacagcggcgcccatccccagcagtttgttgggaacccgtccatgtactaccaccagcagcagcagatggacatggccggcggagggttcgtggtgagcgagccgtcgtcgctggtggtgtcgccgcaggatgctgccgaccagaacaacaacgccgccgacatctcgtcgatggcatgcaacatggacgctgccatctggaagtactga

SEQ ID NO: 5591 - DNA, 1644 bp, Oryza sativa
  Predicted polypeptide sequence is orthologous to G526
tcttcctaaacccatctcgatccctacctagctaagctatttcattcacacctcgatcaatctcgatcgtctctctcgtctactactagtactagcttcttctcctccatttctgacctgagctagctcagaacagagagctgagaatcatcagctagctagctaggcgtctggggagagagcaggagccatgtcggagtcggaggtgtcggtgatcaaccagctggaggaggaggagactcggctggagctgccgccggggttccggttccaccccaccgacgaggaggtggtgacccactacctcacccgcaaggcccaggaccggagcttctcctgcgtcgtcatcgccgacgtgaacctcaacaactgcgagccatgggacctcccaagcaaggcgaagatgggggagaaggagtggttcttcttctgccacaaggaccgcaagtacccgacggggatgaggacgaaccgggcgacggccagcgggtactggaaggccaccgggaaggacaaggagatcttccgcggccgcggcctcctcgtcggcatgaagaagacgctcgtcttctacatgggccgcgccccccgcggcgagaagaccccctgggtcatgcacgaataccgcctcgacggcaagcttccccccaacctcccccgctccgcaaaggaggaatgggcggtttgccgggtgttcaacaaagacttggcggcaaagattgcccaaatgccgccgcctcccttcccgcgcaacgactccttcgacctcgacctcgacgacttcctccacctcgacgccgacctgccgccgctcatcgacgaccccttcgcctccacctccacgctcaagacggagccacctccgccggccaacctgatgcacaaccactacggctacttctccctcccggcgtcagcgaccaattataaccacagctccggcgccatggcggaccaggcgattcggaggttctgcaaggcggaggcgtcgacggcgtgcttctccggcgccgacgctgacgtggatccggtggtggacgagctgctctccttcccggactccatcacggactactcctacatatggaaggcctgaccagattaatttcgtggttaatttgccatatgatcgatcagattaatcctgtttaattagttggtttattaacttgattactgtcaaaggtttgggttaactaggagatgatgatgatggagtttgtggtgatgcgagagagagagagattaggtcgcgctgatctggtctgatcaaggtgtgcagagcagatggagcggactaattcattaattagcttaatcaaattagttatataggtttgtttgtcttaattctgtatgtatatagttatctgattggggataatacatagagattactagctagctagctagtttggtgattaggggggtgatgagctagctagagagagatatctcatcaaaattaaggtctcggttggttgattaatctgcagattatatattgccttgtgtgtgataggccatgtggcctctttctgtgtatgtgtgtgtgtggatggaaggagtaaattaactaaaccccttgtacatgtaccatcagttgtgctttacttacatgatcaattcaaccattgatcgatt

SEQ ID NO: 5592 - DNA, 1435 bp, Oryza sativa
  Predicted polypeptide sequence is orthologous to G526
ggcacgagccttctcctctagctagagctagtgcttcctccatcttcagtctagcttcaattcaagctagggagcaagctagctagctagcatggtggagtctactacatcccttgtgaaattagagcaagatggaggcttgttcttgcctccaggcttcaggtttcacccgacggacgctgaggtaatcttaagctacctcctgcagaagttgctcaaccctagcttcacctccttgcccatcggcgaggtcgacctcaacaagtgcgagccatgggatcttccaagcaaggcgaagatgggggaaaaagaatggtacttcttcagccacaaggacattaaatacccaactggcatgcgaaccaaccgggccaccaaggagggctactggaaggccaccggcaaggacagggagatcttcaggcagcctgcagctgttaatacaagcagctatggaggcagcagcaacaagaagaagcagctggttgggatgaagaagacgctggtgttctacatggggagggctcccaagggcaccaagaccaactgggtgatgcacgagttccgtctccacgccaacctccacaaccaccacccaaaccttcgtctgaatcccaaggacgaatgggttgtgtgcaaggtcttccacaagaagcagggagacgaagccatcaacaaccagcagcagcaaccacagtatgcagccgtggatcagtactctgccgaaacccccaacagcggcagctccgtcgttcaagccggcgacatcgacggcggcgatgacttctttcagctagacgacatcattgaccccagcatctacttcgtcagcaactcttccaacatcttgtcggcgccgcccaacaacaacaacgcggtttattccgtttctgcaagtacgacgacgactaatactactgccgttagcttccagcagcagccaaactactacagcttgatcaacaaaagcagcagcagcagcagcagcaactatagtgctcctctgcagcagcacgtctcttcttggaatattacgcctggagctggaggagcccatggaattggaagcagctactacaacttgcagcagcagcaggcagcaatggtgaaagccctagaaaatgtcattgctgtcccgaattttggtactctactgccgagcagcaacaagctgaagggtttatcgaagtcggcgatggctgggcttacgcagcagaatccccttggcgtgccgcagtacaagatagagaattatggggatcattacatatcacgacagtaatgatcacatatacatatatattgcatgctgctgcgttctgagaatttttgtgctcggctactgcattactgaattacgtactgaacatggacatcatcgagatttaggaatatatgtgtgtgcaatttattttaaaaaaaaaaaaaaaaaaaa

SEQ ID NO: 5593 - DNA, 699 bp, Oryza sativa
  misc_feature (661)..(661): n is a, c, g, or t
  misc_feature (699)..(699): n is a, c, g, or t
  Predicted polypeptide sequence is orthologous to G536
tttttttttttttttttttttttttgaatagcaataattgataatacttcattgcaaactgcccttagttcatcctctactttctttttgtagccatttattgttacacctggttgctcaccagctgtcaccttctgctcaagtgattcaaggattctccatgatgctctcctggcaccaatagttttcttaaaaccaactgaaaataaaattttttttgaatagcaataattgataatacttcattgcaaactgcccttagttcatcctctactttctttttgtagccatttattgttacacctggttgctcaccagctgtcaccttctgctcaagtgattcaaggattctccatgatgctctcctggaaccaatagttttcttaaaaccaactgaaaataaaattttttttgaatagcaataattgataatacttcattgcaaactgcccttagttcatcccctactttctttttgtagccctttattgttacacctggttgctcaccacctgtcaccttctgctcaagggattcaaggattctccatgatgctctcctggcaccaatagttttcttaaaaccaacctgaaataacaatttttttgaatagcaataattaaaaaacctcattggaactggccttagttcacccccaaanttttttgtggacccctttattgttacaccgggtggctn

SEQ ID NO: 5594 - DNA, 702 bp, Oryza sativa
  Predicted polypeptide sequence is orthologous to G536
ttttttttttttttttttttttttttcgaaccattggaagggctgtcataacttcaaataatccgccaagaggactttgatcaaccctatctgtttccatacggggatgttcatgtgctaccaaaacgaaaacaggggggggaattgtgagcgctggaaaagccatacaccggtccaccatcttcgccaaaagcagggtgaagtatctcataaaaaagactttcaagttcgtgcggagtcgcgtgaacacaccctgcgtgctttgatgaggctagtatacaatcagggataggcaagggaaaaacatcattcatgggaatccgaccgtccgacccgtttgctgccaaagccaaattttagaaacatacatgacacatacaactcctgaagatgctccctgccagctttcttcgtctgtctggggacagataatattggctggagatgaacaatgtcaatcgaggaggatggtgcttaagcagcggcaggaggggtggtagccggtggctgctcctcagccttgggctcaaaagcagcgggtgcctcctcagtagcagcagccttgggggcttcctccttgggcgcatcggcagcggggagcctcggcgtcattaccatccgacgatgtccagagagtgaggttgtcacggaggagctgcatgattagggtgctgccgcgataggactcttcaaacagagagg

SEQ ID NO: 5595 - DNA, 634 bp, Oryza sativa
  Predicted polypeptide sequence is orthologous to G536
gattttgtttattgtattcaatcatgttcgaagattgaaatattatatacatccttttttaggggttacaggttaaattaggtttagattcgaatttcgcaagaccaagaatttactcgtccttgtcgtccttgtcgtcaccaccgtccttgtcgttgtcaccttgtaccgtcgctggtccacaaagtcaagttgtctcggagcaattgcataatgactgtggagtccttggtagagtcttcggtgaggttgtcgagctcagcaatggcgtcgtcaaaagcttgtttagcaagttggcaagccttgtccgggctgttcataatttcgtagtagaaaacagagaagttaagagcaagggccaatcggatggggtgagtagaggccaactccttggtggcgatatcagaagcagataggtaagcacccaaagacttgtcagcggcgtccttgcggaggtctccagccttgaactcagccaatatctgtagtagtcacccttcattttgtagtagaaaaccttagcctcgttggattgagcggcggggatgaggtgcttgtcgaggacgttcaaaacgtcttggctaatgccggaaaggtcggcttcaaccttggttctgtatgagcgaattcttgg

SEQ ID NO: 5596 - DNA, 1152 bp, Oryza sativa
  Predicted polypeptide sequence is orthologous to G536
gtcctcggttcctcccctcttctggtcgcccccacccactcacaggctcaactcaactccacccgaatccgcaagagagagagagagagacgatggcggcggcggcgggaggagggacgagggaggagatggtgtacatggcgaagctggcggagcaggcggagaggtacgaggagatggtggagttcatggagaaggtggtgacggcggcggcggcgggcgggggtggggagctcacggtggaggagaggaacctgctgtccgtggcgtacaagaacgtcatcggcgcgcgcagggcgtcgtggcgcatcgtgtcctccatcgagcagaaggaggaaggccgcggcgccgcgggccacgccgccgccgcgcgctcctaccgcgcccgcgtcgaggccgagctctccaacatctgcgcggggatactccgcctcctcgacgagcgcctcgtccccgccgccgccgccgtcgacgccaaggtcttctacctcaagatggagggcgactaccaccgctacctcgccgagttcaagaccggagccgagcgcaaggacgccgccgacgccaccctcgccgcctaccaggccgcgcaggacatagccatgaaggagctgtcgccgacgcaccccatcagactgggccttgcgctcaacttctccgtgttctactacgagatcctcaactcgcccgaccgcgcgtgcacgctcgccaagcaggccttcgatgaagctatttcggaactggatacccttggggaagaatcctacaaggacagcaccctgatcatgcagcttcttcgcgacaatctcactttgtggacttctgatatgcaggacgatggaggtgatgaaatgagggatgcaaccaagcctgaggatgagcactagctaaagatcctagtgacagtcgtctgtctcttaaccgctgggggtagttatgatgcttgtacaaggaccattttcttgtgtcctttcgtcgggtctttgcttaccctttgtttacttatattgctatcgccatcctcatgtattatttgttactttcctgctggaatcctgctcgtgtgtgggagagtgcctcaagcctttaactaggacaaggattgtcaactcttgtttactatgattgaatggctatgcttgttcgatattt

SEQ ID NO: 5597 - DNA, 2438 bp, Oryza sativa
  Predicted polypeptide sequence is orthologous to G536
gagacaaatccattgctgggaagtgaagaagatgaaggagagggagaaggtggtgcgactggccaagctcgccgagcaggcggagagatacgacgatatggtggaatttatgaagacacttgctaggatggatgtggatatgagtgctgaagagaggcttttattttcagttggttttaagaaaactattggtgccaggagagcatcatggagaatccttgaatcacttgagcagaaggtgacagctggtgaccaaccaggtgtaacaataaatggctacaaaaagaaagtagaggatgaactaagggcagtttgcaatgaagtattatcaattattgctattcattgccttccattggccaattcgggtgaaaatgtcgtgttcttttataagatgtatgtgcaggttcatcaagtcaattatttgcttctcaattgtgttttacttcatatcggtctatttcctaatggttacattcagaatttattcccaaacaaacatcttattattatccaggcatattttgatgatgcaatctttttctttgtagaagaatacacaactttgagctcatgtagtgttttgaatagcattgacataacacatccatatgagtttctgactttctgctaaattctcttcctaagaaatgcttgactgaacaccttggtccaaagaattgcagaaggtgacaaacatgttgactttgctctgctttaaactttgacatcaaccaggttttaccaaatgatgctaaggtttcatagaatcaaagatttaaacataccagccatgactcatgtgtcattcctccagggactaactatgctgaccttttttgctcacagtatccaaaaacttataggtaacctcatgacatatagttttgctcacatggtcctaaagtttcagaataaagactaaattatcataatttaaagggcagtatgatacatatatatactgataaataaagggaaggcttctaaataagcaaggagttgaagagctgatctgtgccagcacattagcttaacttgtttatttatctaattctgcacagaaatgcaagtactttttttttctttagtgcacgaccatttgtagtgttggggtattcttcagaaaaggaaagggaaacaagacctaaagatgagatgaacctcttgattccccaactgttttcttagtcttggtctttaattaaatcatgttacacctggattgttctacattttagcctatacctgagcatagtttcttatgaagctttgctaagttgtttttccataataataccttctggtgaaagtttccataataattaaagtttcaataattatttactaagcttttggattactcaattatcttttccatcattgtttttcaagtattaacaatgaaaaaaaaaactgaatagtgcctcactagttctgaagtttcccctcagtacctcttgtttcagatattttgagattttctgagatgagatgttataagattatactaggatcttatgtgttgccctggtaatctatttaacaatgggcaggttggttttctatcaattaaccgaggatcttccctctatagtatgtgcatgttcgcacgatactcatgtgtatatcttttttctttaatctgctttatacatcactcttaaaaaaattacaggaagggtgactactaccgttacttggctgaatttagcactggaactgaaaagaaggctgctactgatcagtcccttatggcctatcagcacgccatggttgttgcctccagtgagctttctcctgcccatcaattcaggcttggccttgcgctcaacttttcagtcttcttgagataatgaactctcctgagagagctagccaagtggcaaaacaagcacttgatgaggctactgctgagattaactctgctggtgtggagggttacaaggacagcatgcttatgatgcagctcctgaaggagaacctggcattgtggacatcagaactaactggaggtgaaacatctaaggacgatgatgttgttatggagggctaactgtctgaaatgttctaaaggccccagcatgtgagcaaaacaatcagtaacattgtaacaatactgctactgaacttgcgacatttatcatgggagccgtggaaatcacctttatttttccctttcttctgtagtttcttttttttggccctcgcttgggtcttggtgtgactcccaaagtattttcagagtttggatttgataaccatgcaccagctttggttatattttgagatcttggagtggtcaccaacccagctttaatattagtttgagagtactttttttttccaatgcttgttaagcatctttgtataccaacgggatgatgaactatatatctcttaatgatgacgaaataaacgtctcttttgttaagatg

SEQ ID NO: 5598 - DNA, 1876 bp, Oryza sativa
  Predicted polypeptide sequence is orthologous to G536
gtctccccccaaaatttccgacgccagagcgcgaggagacgcacacagaggtattccttcgctcgcgatctctctcctccccctctcgaattttgatctcttcccgtagaattttcgcttcgtgtgtgtgtgtttccgttcgattggatcggtgctggtagtacttgctagcatgatcccccgcgtgatctgtggccgtttggtgggatcgttttccatctgaattctcagctaaaccctgctgttttcgtagcgatttttttttgctaggcgtgctttagtggtaggtttgtctgcacgaatcgggtgggtctctggtggttttgaagtgatctgtgtgcggttgatgtgattttacggagtatggttggatccgtcaaaaacctgagttctgtaggggttctgtggttctggtccatgtttgcttctcagaattttgcttataattttgatttttctcgtcttgatctattgttagattgactctgatgtacagttagctcgggaatactgaagctacgattgcggggcagtaattcaaaattgctctttgaaatgtgctacggtaccaaattcaaaaatcaaacttgagatcattggcttgcccacttgaaacaggaattggatggatttcccaacaatgcatcattttctgttttttgcttctgaatttatgcctttattctgcatcgtggattactctttaaattgtttgtatggatcctccaaagaacggttagttcatcaccgtttttgttctttgatcttgcagacttggcatttgtagagtttttagatttatagatagcaaagatgtcggcacaggcggagctttcccgtgaggagaatgtgtacatggccaagctcgctgagcaagccgagaggtacgaggagatggtcgaattcatggagaaggtggccaagacggttgactctgaggagctcaccgtggaggagcgcaacctcctgtctgttgcatacaagaatgtgattggagcccgccgtgcgtcatggcgcattatctcctccattgagcagaaggaggaaagccgtggtaacgaggaccgtgtcacactcatcaaggactaccgtggcaagatcgagactgagctcaccaagatttgcgacggcattctcaagctgcttgaatcccaccttgtcccctcttccactgcccctgagtccaaggtcttctacctcaaaatgaagggtgactactacaggtaccttgccgaatttaagaccggggctgagaggaaggatgctgctgagaataccatggtggcatacaaggctgctcaggacattgctttggctgagctgcctcctactcatccaattaggcttgggctagctcttaacttctcagtgttctactatgagatcctcaactcgcctgatcgtgcttgcaacctcgcaaagcaggcttttgatgaggccatctcggagctggacaccctgagcgaggagtcctacaaggacagcactttgatcatgcaactcctccgtgataacctgaccctgtggacttcagacatctcggaggacaccgcggaagagatcagggaagctccgaagcgcgactccagcgaggggcagtaaagccggctttatgtgccctagaagcttgtagctagtgctttgctactgtgtaatgacacctatgtggctgtgattgttgtcgggaaatctggggctcccccgtatgtgaggttgctagcgatggttttgcagtctcgcctttaagctactcgtagcagagcaggtgggggtctgtggagccaggcctggttgggggtgggggagcctcttgaactgcttggtggcacttcctgtttttctgtttgcctttttattggtgtttattgttatggtc

SEQ ID NO: 5599 - DNA, 1345 bp, Oryza sativa
  Predicted polypeptide sequence is orthologous to G536
ggcgttcgcatccgccgccgcagccgcagccgccgccgccgacgccgacgaggagaggaggagagggaaggcgagagggaggtaggtaggtaggcagttagccatgtcgccggcggagccgacgagggaggagagcgtgtacaaggcgaagctggcggagcaggcggagcggtacgaggagatggtggagtacatggagcgcgtggcgcgcgcggcggggggcgcctccggcggggaggagctcacggtggaggagcggaacctgctgtccgtggcgtacaagaacgtcatcggcgcccgccgcgcgtcgtggcggatcatctcgtcgatcgagcagaaggaggagggccgcgggaacgacgcccacgccgccaccatccgctcctacaggggcaagatcgaggccgagctcgcccgcatctgcgacggcatcctggccctgctcgactcccacctcgtcccctccgccggcgccgccgagtccaaggtcttctacctcaagatgaagggcgactaccacaggtaccttgcggagtttaagtctggcgacgagaggaagcaggctgcggagagcaccatgaatgcatacaaggctgctcaggacattgctctcgcagatttggctccgacccaccccataaggcttgggcttgcactcaacttttcagtgttctactatgagatcttgaactcccctgaccgtgcctgcaacctcgcgaagcaggcgtttgatgaggccatatcagaactggacagccttggtgaagaatcctacaaggacagcactttgatcatgcagctcctgcgtgacaacttgactctgtggacttcagatgccaatgatgatggtggtgacgaaatcaaggaagccgcagctccaaaagagcctggggatcagtgagatgaattcggacgccagtctgatgcaccatctgttgttgttggggcaatggacattgatgtcttcggctttcagtagctatcttctagtacacgaactgtcgtcgcaccatcgcggaggagacgatgatgttcttaaattacttaagtagttctgggtcacgcttttgttcagttgataaatgatggctggatcctggttttcttgttccacgatgccagccacaggaaaaaccctactattctgcactgttagaatgctgttatattaaccatgtttgacaagacattttcagtatgtttgtatgaccgtcttggaagtgtttggttgaacctgtctcagggtctttggtccaagacattattcacctggcttgcttaactcgttttagagaacaaaaaaatattgtctgtatggtgacatgcttgagttcaccgtaatctc

SEQ ID NO: 5600 - DNA, 2091 bp, Oryza sativa
  Predicted polypeptide sequence is orthologous to G536
ggcatttctaggcgtgctcgatctcacgggaaggcgtgcggcgatgtttttttttttttggcgatttttttggggtggtgggttctggactgtgggatgtggttttgggctagatctggtgtgctcggtggtgatgggtgatttggatgggattggattcgtgagatctgcgatcccgtgcacgcgaggggagtagatccgctcggtttggcgagcttcgtctcgtttagaagtggggatttttgttttttgctttttttggattatcatctctgagttgagcaaacgtctgttggggatttggaaaagttagacagatttatttatttatttatttatttatttatttatttatttatttattgtggaagtatgttgatggtatcggttattagctgcgtttgatccacggattagatctaggtttaatctgttaatagtgtggggatctatatatatgtagcggtgaaaggtgcacgcctgctcggtattggggtgataatttttttatctggattgggaggtaggtggtcttggtttgtggaaaatcagtgtttgtctcgtgggtggattgatgcgacgtttagatctagcctagccatgtttatgatttattgatctgcaatgtttagatatatccctcattataaggctgtaattgagtttctgttagttctttctgtattgaacaatttttagtgattacaaatacaacttagttgagattatgaaatattttgaatttggacatgatattggcttattcatttgttacagcctttaaaaagagttagtattaaatatttgatggaatttgtaggattcagtagtattattcacaattgtttaattattcatttctcaacaaatgaacatccttgatatgaatgggaacatgatctgttttgtacaattataccttctggagagaccccatggctttcagattattaatgttggtgaatgcttatcagtacctttttatctggctacagtaatcccttaattggtcaaaatgtctcgggaggagaatgtctacatggccaagctggccgagcaggctgaaaggtatgaggagatggttgagtacatggagaaggttgcaaagactgtagatgtggaagagctcactgttgaggagcgcaacctcttgtctgttgcttacaagaatgtgattggtgcccgccgtgcctcctggcgtattgtctcatccattgaacagaaggaggagggtcgtggcaatgaggaacatgttactctgatcaaggagtaccgtggcaagattgaagctgagctgagcaagatttgcgatggtatcctgaagttgcttgactcacaccttgtgccctcatctactgctgcagaatctaaggtgttttacctcaagatgaagggtgattaccacaggtaccttgcggaatttaagactggtgccgagagaaaggaagctgctgagagcacaatggtggcttacaaggctgctcaggatattgctctggcggatcttgctcccacccatcccataaggcttggactggcacttaacttctctgtgttctactacgagattctaaactctccagacaaggcttgcaaccttgctaagcaggcgtttgacgaagccatctccgagttggataccctcggggaggagtcttacaaggacagcactttgatcatgcagctcctgagggacaacttgaccctctggacctctgacctcacggaggacggtggtgatgaggtgaaagaagcctccaagggcgacgcctgcgagggcagtaaaatgggaagatcgatcgatcgatggctccgcatgttattggagaccatcgatttagatgcctcatgctgctgtcaccatgatggatggattcttctcctgttctactagaatgtttttcttcctgtccccccttcctctctcttctctggtttttactagggtggtagcggtcgaattagttcttcccattgctttgcatttggtgctagtggtccgtctgggctgattgttttcctctggatatgactctcgtgtgtgttgtctccagatagtgttttattgagcaatatttaaagttgtcgtcc

SEQ ID NO: 5601 - DNA, 2361 bp, Oryza sativa
  Predicted polypeptide sequence is orthologous to G536
gacaggagaagccgcagccactgaggtcctagttctgatccagaagtggcggctacgcctttgctgtagcctcaccgatccgccgccgccgccgccatgaagttccgctctgattcgtcaggcggcgacgagccccgcgctccggctgccggcgacggcggcggcggcggcgacgagccggccaagaggcagcggaccgatccgtcctccagttcgagccagggcgaggcctcctcttcctcgcagccgccaccgcagcagcagcaggaggagcagcctccggaggatgcgggagagggcgagcagccgagggttccggatctcggggaggacctggtgttcgaggtgctgcggcgagcggaggcgcggacgctggcggccgcggcgtgcgtgagcagggggtggcggcagctcgcggaggacgagcggctctgggaggccgcgtgcgtgcgggagtgggcgaacctcggcttctccgagcggcagctccgggccgtggtgctctccctcggtggattccgccggctccacgctgtctacatccgccccctgcagtggcgtggcgccggcgtgcccaggcaacaggggaggcggcagccgccggtgaggttgggccgggaccaggttcagctctcgctgtcactgttctccattgggttctttcagaatatgccttgtcctaagaaagacaagggaaatgacagtgataagaatggagggggccaatgcgggtagtcgaatttgtggaataagcttcactccaacaagcatcatcctaagctaccatggcagttgccctattgttcacactggtgatgctagagagtgttggagagacgaacaggaaaatcggcatgcttgatttgggacatgagagaaattaagtggaattgcaagatctgaattggttcggttgtgttccgcacttgtaagatttatgtgatagtgtcacatggattgatggacgttgagtgctatgaggacagttgcgtgaatgctgatgacaagtgatttacttcaagagaagggagaaatggtttgcaattcgttctgctgttgctgatattctagttatcagctattgtgtcaacttgatatatctggcccaagagcagtatggactgtgtgccttcttgcgccggtaccaagctttagagggaaagctgatgcaaatagcttttgtttgcataacctttttcaattagggaaacataatttcccatattaggcatatggagaattatgtgagatttgaccttctgtttctaccagaaaaacacaacagtgaagatgtcgcagcctgctgagctttcccgtgaggagaatgtgtacatggctaagcttgcagagcaggccgagaggtatgaggagatggttgagttcatggagaaggttgctaagacagttgactctgaggagctcactgttgaggagcgcaaccttctatcagttgcttacaagaatgttattggtgctcgccgtgcgtcatggcgcatcatatcatccattgaacagaaggaagagagccgtggtaatgaggatcgttgcacgctcatcaaggaatacaggggaaagattgaaactgagctctccaagatctgtgatggcatcctcaagcttcttgactcccaccttgtgccttcatccactgctccagagtccaaggtcttctacctcaagatgaaaggcgactactacaggtacctcgcagagtttaagactggagctgagaggaaggatgctgctgagaacaccatggtggcatacaaagccgctcaggatattgccctggcagagttgcccccaactcatcctatcagacttgggctggccctcaacttctcggtgttttattacgagatcctcaactctcctgaccgtgcttgcaatcttgcaaagcaggctttcgatgaggctatctcagagctggacactctgagtgaggaatcctacaaggacagcactttgatcatgcagcttctgcgtgataacctgacgctgtggacttccgatatctcggaggatgctgctgaggaaatcaaggaggcccccaagggcgaatcaggagatggacagtgaacatgatcgaatgcgtgcgcccacaaactagaatagtgacgctgcaaatgtgctgtgggttatcgtttcattttatagattgtaatgtctcgtgatttgtcggaaacaggaggcgctccccatttatgttgtgctaggaaaccttgcagctgactcgctgcttggctggtggattctcgagctgcactttctttggggggagcctcagggtggaaccttcatgtcacttattggatcgattgttttcggtatgtcagttgtgagccttatctccagagtcct

SEQ ID NO: 5602 - DNA, 1508 bp, Oryza sativa
  misc_feature (1471)..(1475): n is a, c, g, or t
  Predicted polypeptide sequence is orthologous to G536
gtcggaatccgggtcgaccacgcgtcgtttcttttctcccaccctctctctctctccggtctccactccctccgctcctccgctcctcgcctcttttacccgctcttccccccgatctccccggactcccacagccgcagcgaacaaatcccgcgcgggttgggaagagcgagctcgtgaggagagcagagggaaagcgcgagggggaaggaggaggaaaggtgcacaaggtcagactaagtttgcgttgaagaacaaaggagaggaaaaatgtcgcctgctgaggcatcgcgtgaggagaatgtgtacatggcaaagcttgccgagcaggctgagcgttacgaggaaatggtcgaattcatggagaaggtggcaaagaccactgatgttggtgagctcaccgttgaggagcggaacctgctttctgtggcttacaagaacgtgattggtgctcggagggcatcgtggaggatcatctcttctattgagcagaaggaggagagccgtgggaatgaggcatatgttgcatcaattaaggagtaccgtagcaggattgaaactgagtttaagtcaggagctgagaggaaggaagcagctgagaacactcttgtggcatacaagtctgcccaggatattgcactcgctgacctgcctacaactcacccgataaggcttggacttgcactgaacttctcagtgttctactatgagatactgaactcaccagaacgtgcttgcaaccttgcaaagcaggcgttcgacgatgctattgctgaactggacactcttggcgaggagtcttacaaggacagcaccttgatcatgcaacttcttcgtgacaatctgactctctggacctctgacaatgcggaggatggtggtgacgagatcaaggaagcagcgaagcctgaaggagagggccactaatctgtcctgaagtctatttctgagtccatttactcagctacctgctgtattactggatcataagatgtactaggatcaattgctatgtggaatcataagattagggctgcgtatgtcaaaatgtgtcgagctgaagtacccagtggacacagtttatgtgcactacattgcttccgtgacttatttactagttaattagcaactttcaaccacttcctgtatttgcagcacattattagtatcgctgtattagcgttttccatgggctggttatgattgagaatacaggccaggcattgcatgtctttatttggaagtcgatggggcacgttgggatttaaaaacaaaaacaaagggggcggccaaggatcagctacgagcggctgcaggatagctcaagtgactaatcatatggcgcgttaacgcgagggaccgcggcccactaacggggcgcaacccccgggggagaaacgcgcgaccacaggcgggaggcgacgccagggggggtgacccacacccctcccccgaccggcagacgcacaannnnncgcacaagcacgcacaagacacacaacacaaag

SEQ ID NO: 5603 - DNA, 409 bp, Oryza sativa
  misc_feature (380)..(380): n is a, c, g, or t
  Predicted polypeptide sequence is orthologous to G536
gagttcggtggccatctttgttcagattcgtctcatagggctgtagtgtttcaaagtgtaattagttgaaaattaatctgaattcatccgaaatgtccgaaagagaagacaatgtttataaagctaaactagctgaacaagctgaacgttacgatgaaatggtggaggccatgaagaaggtagcctcacttgacctggagttgacggtcgaggagaggaacctgcttcttcgcctacaagaatgtgatcggtgccagacgtgctacctggaggataatcagcagcatagagcagaaggaggagaacaaaggcgccgaagaaaaactagaaatgattcgcacctacaggactcaggtcgagaaggagttgcgagatatctngtccgacattcttggagttcttgacaagc

SEQ ID NO: 5604 - DNA, 433 bp, Oryza sativa
  Predicted polypeptide sequence is orthologous to G536
ccctgagcgaggagagctacaaggactctacactgattatgcaactgctccgtgacaatcttactctctggacctcctctgaggccgagacctccgctgctggtcaggccgaggctcccaaggaggacgcacctgcggccgctaccgaggagccagctgccccggccgaggagcctaaggccgagtaaggagtcgactagtgatttgtctatgcaggtgtcaggtggactggtgtctacggagtgtggacggaagacctcgtttttgatcaagagcttcggcatcgtttcagtacagacaatggccatggaaaggactgggtttttcaccaacgggctggctaggcgagtctataacagaacacttttacgttctgctcttagactgttaatgcgttggccgtctggacaataaaaatactaaaattactttc

SEQ ID NO: 5605 - DNA, 428 bp, Oryza sativa
  misc_feature (191)..(191): n is a, c, g, or t
  Predicted polypeptide sequence is orthologous to G536
gaaaaccaaaccacttctttttttccatctctcttggccccattcgccatctgccaactccttcaactgaagctcctctcagccgaattttgtttattcgctttcccttaaacaatccctcaagctactataaatttccacgactcaagtcgccaaacatcaacaaaatgggccacgaagacgccgtctancttgccaagctcgccgagcaggctgagcgatatgaggagatggttgagaacatgaagattgtcgctggtgaggatcgagatctcactgtcgaggagcgaaaccttctctccgttgcctacaagaacgtcattggcgcccgccgtgcctcctggcgcatagtcacctctatcgagcagaaggaagagtcaaagggcaactcttctcaggttacccttatcaaggagtaccgacagaag

SEQ ID NO: 5606 - DNA, 317 bp, Oryza sativa
  misc_feature (29)..(29): n is a, c, g, or t
  misc_feature (42)..(42): n is a, c, g, or t
  misc_feature (48)..(48): n is a, c, g, or t
  Predicted polypeptide sequence is orthologous to G545
ccttaaccaaggtgccaaccaagccaagncattaaggggttncaccancagggaggcccagggagggcttatcccacccctggaggtcttcattaaataaaatggatattcatgataatccaaatcccagtggtggccatcggatctctcttgatttctgtcacggtggtatttccaataagctatgataatcacgatctgcccatcatatattatcttttcttgaggatgtgagcatatgtagagtgatgatatcattgcctaagaaataaatcttgtcatcgggatggatcccttttgtaaaaaaaaaaaaaaaa

SEQ ID NO: 5607 - DNA, 394 bp, Oryza sativa
  Predicted polypeptide sequence is orthologous to G545
ggcgaggaaacagctccgagtgcaagagcatatggaaccatcaggattcattctctaggtcggccgccgcaacttctcaagtcattctctaggtcggccgccacaacttcaagagcacatggaactatcaggattcactctctaggtcggccaccacaacttctcaattcattctctaggtcggccaccacaacttctcaattcgcatgctcaaagtacgattgtaagtaatgcatttctgggatggattaggggggggggggggttgttagattcagacataaatttgaggcattagatgatgtaagtataactggtgagattttttttgtgtttcgtctaagaaaggccactgaatcaaagttttgcaagtttactccctaaaaaaaaaaaa

SEQ ID NO: 5608 - DNA, 892 bp, Oryza sativa
  Predicted polypeptide sequence is orthologous to G546
gtgcaccaccacgagagcggtggctatgcagccatgcgggcgccgtctcctcggcgccggcaccgcctcgccgccgccgctgccgggcttgggttcggcttcggcccactcgatggaccgcgcgcagcgggcgcacatggtgcgggcgctgggggtgaccaccacggtgctcttcgtcgccagcgtctcctacatcgcgctcaccgcgctctacgcctgcttctgcgacggcggcgggcggcgacggcgagaagacggcgggtcgtcgtcggtgcgccccgagccgtccgaggagaccaagcgcgcgctcgacgggatcccggtgcacgtggtccagatgccgccccgcgacggcggcggcggcggcgccgacgaggagggcggcagcggcgactgcgcggtgtgcctggcggagtacgccgccggggacgaggtgcgcgtgctgccggcgtgcgggcatgggttccacagggagtgcgtcgaccggtggctgctcacgcgcgcgcccacctgccccgtctgccgcgcacccgtcgtcgcgcgcgtcgagggcccggacgacgacgccaaggaggattactgcggcgacggcgagagcgtcgagaggcacggcggcggcggcggcgacattggcttcctgtccgtcgccggcgagtcccgcgtgcttcctgcgatttgattttgctacgagtactcatcagctgtaatagggtacttagtaggtgtttagctcaattttgctagctgtggacaaacgtagcttagtaggatgattcgagtttgtttattggcgagagcaataacgatcatacgagtagtttcactttcagggttacaagttcatgtgcgatcaatctggttatttagttattataccttcttaaaatttctg

SEQ ID NO: 5609 - DNA, 722 bp, Oryza sativa
  Predicted polypeptide sequence is orthologous to G546
cacggggaggtagtgacaataaataacaactcaaacacacttgtcaccttctctccccgcatcgcaacgataagcccgtgaacccgaccccgcgcgccacccgtccttcccacccccgagcgagctagagaggaagacgatgcagctcatggcggccaggaagcttctagagcagccgggcaccgccgcgccgccggtgctgggcggctccatcgccgacgacagggacatcgtcatcatcctcgcgtcgctcctctgcgcgctcatctgcgtgctcggcatcggcctcgtcgcgcgctgcgcgtgctcccgccgcggcggcggcggccccgacgcggccgccgccaacaagggcgtcaagaagtccgtgctccgcgcgatccccaccgtcgagtacgcctccgcggtctggaagccgacacactacagcgaggtcccgcccttcttgccgtagaaggcgcagccgcatcgcgcgctccggagattccggggggctagagctagaagaggaacagagaaaccgaccaaaccataagcctgagatggttaaatttctcgtttgcttgctagattttagtgccctagctagctggaaatggatagcatttgggaaaaaattccgagtcagagatcctggtttgcaacttgcaagtggatggctgcagctttttcgctttgtacattttgtaaagtgatgagaataagatctgcaatttagctcc

SEQ ID NO: 5610 - DNA, 1495 bp, Oryza sativa
  Predicted polypeptide sequence is orthologous to G549
ctcgaaacacaagaaacaaccggagaaactgagcccggccgaccgcaaggacagcaagctattagccatcctcgcatggatcccaacgatgccttctcggccgcgcacccgttccggtgggacctcggcccgccggcgccggcgcccgtgccaccaccgccgccaccaccgccgccgccgccgccggctaacgtgcccagggagctggaggagctggtggcagggtacggcgtgcggatgtcgacggtggcgcggatctcggagctcgggttcacggcgagcacgctcctggccatgacggagcgcgagctcgacgacatgatggccgcgctcgccgggctgttccgctgggacctgctcctcggcgagcggttcggcctccgcgccgcgctgcgagccgagcgcggccgcctgatgtcgctcggcggccgccaccatgggcaccagtccgggagcaccgtggacggcgcctcccaggaagtgttgtccgacgagcatgacatggcggggagcggcggcatgggcgacgacgacaacggcaggaggatggtgaccggcaagaagcaggcgaagaagggatccgcggcgaggaagggcaagaaggcgaggaggaagaaggtggacgacctaaggctggacatgcaggaggacgagatggactgctgcgacgaggacggcggcggcgggtcggagtcgacggagtcgtcggccggcggcggcggcggggagcggcagagggagcatcctttcgtggtgacggagcccggcgaggtggcgagggccaagaagaacgggctggactacctgttccatctgtacgagcagtgccgcctcttcctgctgcaggtgcaatccatggctaagctgcatggacacaagtccccaaccaaggtgacgaaccaggtgttccggtacgcgaagaaggtcggggcgagctacatcaacaagcccaagatgcggcactacgtgcactgctacgcgctgcactgcctggacgaggaggcgtcggacgcgctgcggcgcgcctacaaggcccgcggcgagaacgtgggggcgtggaggcaggcctgctacgcgccgctcgtcgacatctccgcgcgccacggattcgacatcgacgccgtcttcgccgcgcacccgcgcctcgccatctggtacgtgcccaccagactccgccagctctgccaccaggcgcggagcagccacgccgccgccgccgccgcgctcccgccgcccttgttctaagctcgccggagactctgctgctgttcccgcgccgccacggcgcgtgggagtttcctgtggtgttgggccgtgttttcgttgtaaggcagttaggtcgttctaagctattcgatgggccgatcgaggatgcgtcgtcgtgtaggaactcgtcgtgtacccatgtttgcgatctggatggcccatttgtttagctgttaccatgttaaattcgtttcctttatttatgaaatggtaaatcctaaatgtcgtg

SEQ ID NO: 5611 - DNA, 2257 bp, Oryza sativa
  Predicted polypeptide sequence is orthologous to G550
gactactatagtgtcattactccgaacacaacgcgagcggccgcctcctcctccgcccagtgacatgccacccgccgccgccgccgccgctggcatcatccccgctcgtcgccgtcgtcgtgctgcgcccgaggaggaggaggaggagccggtgccggtgccggtgccggtggtggcagcgcggacgagatcggggcgccgctatggccgcgcttaggcagggcgacgaccccgccatcaagctcttcggccgcaccatccccctcctcctcgacccccccgccgccgccgccgccgccgccgacgaggtcatgcctaatttaggaaatggtgtaaaaaccaataatgacttacctttagtctcagacaagcttttgattgtcaaaggtattcctttttgtcccaacaatagtaagaaaaatgatttacaaggcatcagcagaccggatggaagaatagaaatcgattccatgactgaggatgttaagactgagcctgatggatctgtccctgagaagatactcaagaagccagataagattctgccatgtccacgctgcaatagcatggaaacaaagttctgctacttcaacaactacaatgttcaccagcccaggcacttctgcaggaactgccaaagatattggaccgctggtggagctatgaggaatgtcccagttggtgctggaagacgcagaaataagcatgtgtcaaaatactgtcaggcgatgatgacgtgcaataatactgtagctcctggagatgtttctgatgtggttcaccatcaggttattacacatggatcttctctccttccggcaacactgaaggaaaatgaaacacctacagaattcatatcagaagtaccaccatgtaagtcttcagcttcaatccttgatattggagagccgaatgatactgaccttgttcccttggcctctggtgataacaaggaagaaaaatcatgtgcatcttctgtggtagtatccagctgttcagagaatctgatgccagataatgcaattatgaaagagccaaacaacaggtcaggatgttgtaatggtgtggcattgcctttccctactggacctgctttggtgctcccctggagtcttggatggaacagtgttgctctcatgccagctacccagtgctcgatgcagcccgttcttgggttaaaaggtgggataccctgcccgccttcatggccaccgcaactgatggtgccggccccaggaatctgtactcctgttgttccaatccctcttgtgccacctctgtggcgctgcttccctggctggcctaatggaatgtggaatgcacaatgccctggaggtaatactactgtgctgccgtcaaccgctccaaacaaaatttcttgttcaggaagcagttctctggtgttgggaaagcattcaagagaagaaagcttgcaggaagaagagaagacgagaaattacttatgggtacctaaaactcttaggattgatgatccagctgaggctgcaaagagttcaatctgggcgacccttggcatcaagcctgacgataaaggcatattcaagtctttccagccaaatgttgcgaaaaatggcacggcaccagaatcgcctcaggctctgcaggccaatccagcagcattttcgcgttctcaatcgtttcaagagacgacttgaggagcttttctgtttgttttctgacataaggatcatactgctacctccacaggaatggtcacaatgtttctatccagtgtgatcttgagctcatatgttgctagagccagatcaaatctagcaactcaaatctggcagagttgccagtgatgaacttggttctgtggtaatgtttatgttgatcaaaaatctctgcttctccccaaggagagaattgtgagcttgtgatccggagctcaaaacatgctccatctgaaatcattagtcaatagctgtcgctgtgatggaggtgaaaaggataactgtgaagtctcttttttcttactttctttgaatttttagactggcattctgacgtttgtatatagcttctcaaaattcatgtaatggcttctatgttaacctgcagaaaatgcataattttgtaactggatggggatcaactccgtttggacataagcaaatcagcctagttatctcatttgcagcattgaaatttaccccaaactaacaccatatctgtcaataccattgggtcaaaatgaacacccatttctaaattatcaaaattcatttacccc

SEQ ID NO: 5612 - DNA, 1720 bp, Oryza sativa
  Predicted polypeptide sequence is orthologous to G550
atatgatgaaatgaaggttgatgtgccacaagaggaggaagataacgaaatgaaggtcgatgcaccacaagagaaaaaggataatgaagtgacggctgatgtgccagaagagaagggaaatgatgaaatgagggttgatgcatcagagtcaatagaaagcatagagccagtcagcagatctaccttggacaataaaaaagaagatcagggtcagatgaacaacgttgaagagaaagcagcatcagactcaaaagatgaaaatgaaaagacagcaaatgatgaatcaggccaggacaaagtacttaagaagccagataagattctcccttgccctcggtgcaacagtatggacacaaagttttgttattacaacaactacaatgttaatcaacccaggcacttctgtaagaactgccaaaggtattggactgccgggggaaccatgagaaatgtacctgttggtgctgggaggcgcaaaagcaagagctcatcgttgcactaccgtcacttactgatggcccctgattgcatgatggggtctagagtgaaaatatccaagtcaatgaaccctgaagctttcgcatctgcgcattcgacccctatacaaccaattggcagaaacgaaacagttctcaaatttgggcctgaggtgccactctgtgaatcgatggcatcagtgctgaacattcaggagcagaatggaaccaatgctgcagcagtaccaacgggtgaaaatcaggaagataactcttgcatctcttcaatcacatcacacaacgtgttacctgaaaatgcagcccaagttgacaagaacagcacgccggtgtattgcaacggagtcggcccagtgccgcagtactaccttggagctccttacatgtacccatggaacataggatggaacaacgttcctatgatggtgccaggtacaagcatgccagagtctgcttcccaatctgagagctgcagcaccagttcagctccatggatgaacatgaactcccccatgatgccggttgcctcgaggctttctgcaccaccatttccataccctctagtgccacctgcactatggggttgcttatccagctggccggccacggcatggaacataccgtggatcagaacgaatggcggctgcatgtctccatcgtcgtcgagcaacagcagctgttcaggcaatggctcccctctggggaagcattccagggactcctctctcccactgaaggaggacaaggaggagaaatcactgtgggttcccaagacgctccgcatcgacgatcccgacgaggcggcgaagagctccatctggcatcttcaagccgttccagtccaaaggtgagagcaaaggccaagcagcatcagagactcgtcctgctcgtgctcttaaggcaaacccagctgcattgtcgcggtcgcagtcgttccaggagacttcttgactctttacctgttgaatttcctatagtttttgtcagcacagtgtgtgtactgtaaaatgtgtatagcagtagaggttttgcggtattcagaaggatcaggagagagctttttgtgcagccactaacttgaggtggataggagttgcaaagggctttcatgagaaactacatcgagatgtatatgtattgtaaatacttgacaaactggttgtgtacatctaggttaagtcaggaaaatacactcacctggtttagctctcctagtatattatact

SEQ ID NO: 5613 - DNA, 1461 bp, Oryza sativa
  Predicted polypeptide sequence is orthologous to G550
atgggagggggtggtaagtgcaaaagagggaaaagaggaaagattgcagccaagcgaagaaggggccagtgttgcagcagcagcagcagcagcggaggcgcaagaagacgagctagagagagagaatcagaggagagcttgggtgagatgggtgagtgcagaggaggaggaggaggaggagatgggctgatcaagctgttcgggaagacgatcccggtgcagccggatgccaaggatgttcagcagcatagtggcagtagcagcagctcaaccgaatccgacgtccaagaaaccgccgctgtcgccgtcgccgacccctccccgcggtcggaggtcgtcgacggcgagagcccgccgcagccgggcggcgaggcggcgagccatcagcagcagcagaaggagatgaagctgaagaagccggacaagatcctgccatgcccgcggtgcagcagcatggacaccaagttctgctacttcaacaactacaacgtcaaccagcctcgccacttctgcaagcactgccagcgctactggaccgccggcggcgccatgcgcaacgtccccgtcggcgccggccgccgcaagaacaagaacgccaccgccgccgcccacttcctccaccgcgtccgcgcctgcgccgccgccgccgccatgcccgcggcgccccacgacgccaccaacgccaccgtgctcagcttcggcggcggcggaggcggacacgacgcgccgccggtcaccctggacctcgccgacaagatgacgcgcctcggcaaggaggggctcgtcgcccatgcccggaacgccgacgccgccgccgcgtgcagcgaggtgtcgagcaacagggacgacgagcagatcggcaacactgtagcaaaacctgcaaacgggttgcagcagcatcctcctcctcctcatcatcatcatcattcagccatgaacggtggcggcatctggccctactacacctcggggatcgcgatcccgatatacccggcggcgccggcgtactggggctgcatgattccacctcctggagcttggagcctcccatggccggccacagtccagtctcaggccatctcatcatcatcaccacctacaagtgctacaccttcagtctcctccttcacactaggcaagcatcccagagagggtggtgatcatgaggcaagagatcaccatggcaatggtaaagtgtgggtgccgaagacgatccggatcgacaacgccgacgaggttgcccggagctcaatccggtcactcttcgccttcagaggcggcgacaaggcggatgataacaacgacgacgatggcaccggcgtgcacaagctcgccaccacggtgttcgagccaaagagggacagcaagacggcgaaacatccggcgatcacgagcttgccgctcttgcacaccaaccccgtcgcgcttacccgatccgcgaccttccaggagggatcttga

SEQ ID NO: 5614 - DNA, 1809 bp, Oryza sativa
  Predicted polypeptide sequence is orthologous to G550
gcctcgcttgtgcgaatgaaaagatttcaagaaatccaaccaaaaatctcgcgctctcctctcctcctcctccgcatgagctcatcggcgttggcgttggcctgtcgtctccgggaggagtagtgcaggcggcggcggggaattccgaaacggagtttgttcgttttggagcggagtggtgaggtgagtcgtcgagatgggggagtgcaaggtgggaggaggaggcggaggcggagactgcttgatcaagctgttcgggaagaccatccccgtgccagagcccggcgcctgcgccgccggcgatgttgataaggaccttcaacacagtggcagcagcacgactgaaccgaaaactcaagagaacaccgttcaagactccacaagtccacctccgcagccagaggtcgtcgacaccgaggactcttcagctgataagaactcatcagagaatcagcagcagcagggcgatacggccaaccagaaggagaagctgaagaagcctgacaagatcctgccgtgcccccggtgtagcagcatggacaccaagttctgctactacaacaactacaacatcaaccagccgcgccacttctgcaagaactgccagaggtactggacagcgggtggtgccatgcgcaacgtgcctgtgggtgcaggccgacgcaagagcaagagcgtatcggccgcttcccatttcctccagagggtcagggctgctctgcccggtgatcctcctctctatgccccagtgaagactaatggcaccgttctcagcttcggctccgacctgtccaccttagacctcacagaacaaatgaagcatctaaaagataagtttatcccaacaaccggtatcaagaacaccgacgagatgccagtcggtttgtgtgctgaaggattgtcgaaaacagaagaatcgaaccaaacgaacctaaaggagaaagtttcagcagatagatctccaaatgttgcacaacacccatgcatgaacggaggagccatgtggccatttggcgtggcaccaccacctgcttattacacttcaagcattgcaattccattctatccagctgcagcagctgctgttgctgcatactggggctgcatggttccaggagcttggaacgctccatggccaccgcagtcccaatcccaatcggtttcatcatcaagtgctgcttctccagtatccacaatgaccaactgcttcagattaggaaagcaccctagagatggtgatgaggaactggatagcaagggtaatggcaaggtgtgggtgccgaagacggttcggatcgacgatgtcgacgaggtggccaggagctctatctggtcgcttattgggatcaagggtgacaaggtgggagcagatcatggcagaggatgcaagcttgcaaaggtttttgagtcaaaggatgaggcaaaggcatcaactcacacagcgatcagcagcttgccattcatgcaggggaacccggctgccctaacacgctcggtgaccttccaagagggatcttgacttgaacaacgccttggaaatttttatgctgccttctgctgctataaagacatagcgtgatacagctgaaattttgtacattagaggattgtaaagtaggtatgggagatggagtgtcagggtgtataacttaacatagctacaagcaagcccagtagctgtattagataacttgtacatagctatgtgggtttgagaaagatagggagagcaagttccccttataatatgtagataaataatataatgatttgaatatttagatcaaaaggatttccttttgcagtagt

SEQ ID NO: 5615 - DNA, 1849 bp, Oryza sativa
  Predicted polypeptide sequence is orthologous to G550
gcaaactccacttgtcggatctctctctctctctctctctccctctctctctcgcccatgtaccatctccatggacgacctcgccgccgcctcccctcctcacccgccgccgccgccgccggaatcccacgtgcctccgcccccgcagacgccggagaaggattcatgtgaggatacaggagacatgaggatcagtgaagaaaagccatgcacagatcaggagttagatgctgatcagatgaatagttctagctttaatagttccagcgagtgtgagaatcaaacacctagcaatgatgaaatgactggatcagagtccaaatctgaggcagctcaaacagagggtggtggatcgagtgaagagaaggtcctgaagaagccagacaagatcctgccttgtcctcgttgcaacagcatggatacaaagttctgctactacaacaactacaacattaaccagccaagacatttttgcaagagttgtcagagatattggacggcaggtggaagcatgaggaacctccctgttggtgctggtaggcgcaagagtaagagctccactgcaaattaccgcagtatattaatcacgggcagcaatctagctgctcctgctggagatgctcccctctatcaactctctataaaaggagatcaaacagcaacggcagttaaatttgcacctgattccccactctgtaattccatggcctctgtgctgaaaattggagagcagagtaagaatgccaagcctacctcaacagcacaacccagaaatggagaaacccagacctgcccggcttcaggaacaacttcagatagtccccggaatgaaccagttaatggagcagttagtgggcatcaaaatggaattgttgggcatagtggagtccctcccatgcatcccataccatgcttccctggtcctccttttgtgtacccatggagtccagcatggaatggcattcctgccatggcaccaccggtatgcacagcaccagctgaaccagcaaattcttcagacaatggaagcacagctagtgttcagtggagcatgccaccagtgatgccggtaccaggatactttccggtaattccatcttcagtttggcccttcatttctccctggccaaatggtgcatggagctcgccatggattcaacctaattgcagcgtgtcagcttcatctcctacaagcactagtacatgttcagacaacggctctcctgtcctaggaaagcactccagggactccaaaccgcaaggagatgacaaggcagagaaaaacttgtggattccgaaaacgcttcggatcgatgatcctgacgaagctgcaaagagctcaatctggacaacccttggcattgaacctggtgaccgtagcatgttcagatcattccagtcgaaacctgaaagcagggagcagatatccggtgctgcacgagtcctgcaggcgaatccagcagctctatctcgatctcaatctttccaggagacaacgtgatgtatattgaagaaatcgtgtgacaattgtagaacatgttactactataatttaagcaagtgctacagcctgaaggatgattggcgatgtaggcgctgctgcaaacatggaggcagcgtgatctgtactattgaaacctgaagagtactattcttgacatttttctataatttgcctgtggagcatgcaccagtctactgggttcatgatcaggctgtcagcatatgttttgttgtacaataataataattgttaatagctttgcctaaaggatactgatagtattctgctgatccttcagctctgtgatcaatggcccatatatttacctgacaagtttcagaaagg

SEQ ID NO: 5616 - DNA, 567 bp, Oryza sativa
  Predicted polypeptide sequence is orthologous to G557
atgcaggagcaggcgacgagctcgcggccgtccagctccgagaggtcgtccagctccggcggccaccacatggagatcaaggaaggcaaggaagcgccacttcgatcccttctccttccctttcttgatttccattttactgttcctctttcgggaatggagagcgacgaggagatagggagagtgccggagctggggctggagccgggcggcgcttcgacgtcggggagggcggccggcggcggcggcggcggggcggagcgcgcgcagtcgtcgacggcgcaggccagcgcgcgccgccgcgggcgcagccccgcggataaggagcacaagcgcctcaaaaggttgctgaggaaccgggtatcagcgcagcaggcaagggagagaaagaaggcatacttgaatgatcttgaggtgaaggtgaaggacttggagaagaagaactcagagttggaagaaagattctccaccctacagaatgagaaccagatgctcagacagatactgaagaatacaactgtgagcagaagagggccaggtagcactgctagtggagagggtcaatag

SEQ ID NO: 5617 - DNA, 1011 bp, Oryza sativa
  Predicted polypeptide sequence is orthologous to G557
atggctcacagcttccgttccgtccgagaaaggcaagtggttttacgcttttacgaaatcggatggatggggatgccgctacgcttccggggaggtcaccgtcagatgcggtggatgcgtgtatggtgccttcgcacgccacgctccccgaacccccaccgtcggatggctccggagtggacggcccggatgacggccaccagagcacacagactcgttttctctctcctccgctctctcgatttctctctctctcctctcatccgatctgcatctgcttctcctttccacacttgtgcttcgtgttcgtcgtggtctcttgtttcttcttcttcttctagatttgattttctttttttttcttccctttttcgcggcggcgaggggcgaggggggaggatggcggcgcaggagcaggagcaggagaagcagcaggtgaagacgagcacgacgagctcgctgccgtcgagcagcgagcgctcctccagctcagcccccaacaacctcaaggaaggaggaggggtggagagcgacgaggagatacggcgggtgccggagatgggagggggcggcgggtcggcgtcgtcgggggcgggggcggacgagcggcaggggaaggaggacgggaagcagcagggtggtggcggcggcggggcggcggcggcggggggcgggcaggagcaggcgccgccggcgaggaagcgagggcggagcgccggcgacaaggagcagaaccggctgaagcggctgctgcggaaccgcgtgtcggcgcagcaggcgcgggagcggaagaaggcgtacatgacggagctcgaggccaaggccaaggacctcgagctccgcaatgccgagctcgagcagcgcgtctccaccctccagaacgagaacaacacgctccgccagatactcaagaacacgacggcgcacgccggcaagaggggcggcggcggcggaggcaagggcggcgatggcggcggcggcgggaagaagcaccatttcaccaagagctag

SEQ ID NO: 5618 - DNA, 872 bp, Oryza sativa
  Predicted polypeptide sequence is orthologous to G557
aagtacggtcggaatcccgggtcgaccacgcgtccgcggacgcgtgggttttttttttggcggaattacatacatttattacacttttgcagggctcggccaatccgccaataggaggtagacatggaaacaattatatgccttccagagttgattcgagaaggcataaataggtaagttcatttgtctcgatctggctagcactaacgagtacttattcaggtgcatagccaagaatggttgtatttaatgtagtaattaattttatctaagaaactacaaatcaatcaaaagggagcagcttccctttgagtcttagttgtgactctgccaaatggagctagccaagctaacaaaattaatcgaactccagattccagactacagattgcggttactagctgtctccgccggcactgctgtctggccctcttctgtttgctgttgtgttcttcagcacctgcctaagcatctggttctcgttttgcagggtagagagcctctcctccagctctgagttgctcctctccaggtccttcaccctcgcctccagctcactcatgtacgccttcttcctctcccgagcctgctgcgctgacacccggttcctcagcaatcttttgaggcgccggtgctccttgtcggcggggctgcgttcgcggcggcgcccggtgctgctggtgcgggcgacgccggcctggccgggggcgaaaacacgaagtccggccgcggcccgccgggcacgtgaacccgaaatactcttccgagtcaagtcccgggaagcagccaatcggacccccatatctgtggggaaacctctggggtgggggggggggcgcaaccccagaggggacaaaaagatcaagggaaat

SEQ ID NO: 5619 - DNA, 1548 bp, Oryza sativa
  Predicted polypeptide sequence is orthologous to G558, G578, G629, G1198, G1806
actcactatagggctcgagcggccgcccgggcaggtgtcgctcgtcgacccctctccgccgccgaggctcgctgtcccaagctaatccgtccgcttcgttgaggattccattgaatgcttggctgtggtggagtgctacactgctagtagcagcttgcatctcagcaatttgggtgaaccccccacattcttgaggcagtaacaattggatctacatcttgccactacaaaaggatcaacgatctgtactagccttcatttgtgggttcctcattgggaattgggattctttacaatggcagatatgagccctaggacagatacatcaacagatgataccgatgataaccacatgcttgaaccaggtcagcttgctcttgctgctgcttctgactctgacagatccaaggacaaacatgaagatcaaaagacattgcgtcggctcgcccaaaatcgcgaggctgcaaggaagagtcgtttgaggaaaaaggcatatgttcaacaattggagaatagcaggctaaagcttacacaactagaacaagaattgcaacgagctcgtcagcagggcatttttatatccagctcagtggaccagactcattccatgagtggaaatggggcattggcttttgatatggagtatgcacgttggttggaagaacacaataggcaaattaatgagctaaggtctgcagtcaatgctcatgcaggtgataatgagctccgtggtgttgttgacaagatcatgtcacactatgaggagattttcaagcagaaaggaaatgcggccaaagcagatgtctttcatgtgttatcaggcatgtggaagacaccagctgagaggtgtttcttgtggctaggaggattccgaccatccgagcttttaaagcttctttcgacacagcttgaacctctcactgagcagcagctgtcagggatagccaaccttcagcagtcttcacaacaagctgaagatgctctttcacaaggaatggaggcccttcagcagtccttggcagaaacattggctgggtctcttggttcttctggatcaacgggaaacgtggcaaactacatgggccaaatggcaatggccatggggaagcttgggacccttgagaatttccttcgccaggctgacaacctgcggcagcagactcttcaacagatgcaaaggatactgaccactaggcagtctgcccgtgcgcttcttgtgataagcgattactcttcgcggcttcgtgcccttagttccctctggcttgctcggccgaaagaatagcaagcgcaagtaacttgactgcaaccacatttttcgggtttgggaggtgatggtgatcttacctggaagagttgacaatcctgcaaaggacttgattcggagatatttgcacatactataatccaaaagagatccttgtgttcaggtagcttagtcttatggttaagtgcattaggccctggcccatgttgtactgttagccgctgtaaaatactgttccattattacttatgtatctgtaatatcctaattttcagagaatg

SEQ ID NO: 5620 - DNA, 2155 bp, Oryza sativa
  Predicted polypeptide sequence is orthologous to G558, G578, G629, G1198, G1806
tcgagcggccgcccgggcaggaaaccgctcctcctcctcctcccaaatccaccacggcgacgccgccgccgcagagcccctagctcccggaggtccctcgcccccgccagctccgacggcctcacggaaggaggagtaacgtgggcgttgattggatttttttgttttccccccaccttgagtgagtctgtgccgtttccccggcggcgagggagggcagagggctgatcatggtcgtgcgccgccggtgccttgccgagatttcccccaaccgccaccgacgatcgttcacttggcacaaaggggagtagcactgtccaagctgttgtggtccgtcagggagattggccaacctgtggggtttcagatcgacataagtacgtcagtatttcagccatcgatcaatctggcggttatagggctgtgcttgcaacctttctggcagaaaggagagagcaaagtgatttgctgtctcctgttgattgtggcctgttgaggcccagtaatggcagatgctagttcaaggactgacacatcgattgttgtagacaacgacgacaaaaaccaccagttagaaaacggacatagtggtgcagtcatggcttctaactcttcagatagatctgacagatctgacaaacttatggaccaaaagacaattcggcggcttgctcaaaatcgtgaggcagcaagaaaaagtcggctgaggaaaaaggcatatgtgcaacaactagagagcagtaagctgaagcttgcacagctagagcaggaacttcagaaagctcgtcagcagggaatcttcatctctagctctggagaccagacccatgccatgagtggaaatggggcattgacttttgacttagaatacactagatggctcgaggagcaaaataagcagataaatgagttgaggacagcagtgaatgctcatgcaagtgacagtgaccttcgtcttattgttgatggcataatggcgcattatgacgaggtattcaaggttaagggtgtagctgcaaaggccgatgtgtttcatatactttcaggcatgtggaagacacccgcagaaagatgcttcctgtggcttggtggtttccgtccatctgagcttctaaagctcctagcaaatcacctcgaacctttaaccgagcagcagttgctgggattaaacaacctccaggaatcttctcagcaggcggaggatgcactttcacaaggtatggaagcactgcagcaatctctggcagatactttggctggatctctcggttcatcagggtcttctgggaatgtggcgaactacatgggtcagatggcaatggccatgggtaaactaggaacgctcgagaatttcctttgccaggcggacaacctgcgacagcagacattgcatcaaatgcaacgaattctgacgatccggcaagcctcgcgtgctcttcttgccatacacgattacttttcacgcttgcgtgctttgagttcgctgtggcttgctaggccacgggagtaacaaaatggtcatgtgtgcctgtgacgaggttagacgctcattttgatggactgcagataattgggtttttccctgtacaattgtgtttggcagctgtggactaaagttaaaaactgtacctaaagtggtgtatgcaaataggtgaagcctctaagtaattataacgattgcattattgtgttagcaataaaagttgggtaattcaggatgtgtcctgagttgttttgttgtagtagaagaactgcatgtagtggctggaaatgcagtgttgaatgtaactaaagctctgctgctcacgttgcataatgttgtgtagtaatagttagctagtgatgcccattttacctgcactcctctgggaagctgaaactgcaacctgaagcaaccacggtgcagaagaccgcatgcatggtaaatgattaaaaggatatatatgggctcaacatcgctgccaaatcctgagataatgaacaggcatgctaaactgctacttccacatgaaacctcccagttgacatgaagaatgagctgttcagttttatggtttctgtgttgcactgtacataattcctgtacgggtctgaatttatcctgaaatcatgctaaactgcagaagcatatgaaatctccagaccggttgacatg

SEQ ID NO: 5621 - DNA, 1654 bp, Oryza sativa
  Predicted polypeptide sequence is orthologous to G558, G578, G629, G1198, G1806
tcgagcggccgcccgggcaggtcgcctcgcctctctctcttccttctgaccaacccgacctcggcgcctccccccatttctctctctctctcttcgcgttgccgtctcgaccccgcctccaccgccgaagccgcccgaggcggcggccgccggcagctgggctcctccgaatccgaacacggcggggtctctcccctcgctccccacggcggttggcacctgctggctctcgatccaacgtgtacagctaatttgatctgttggcgccttagctagaaaggtggcgactctggcatctcagtgatcatagggcatttgaaggtggcctgcatccctgttacaagtaagggacaacaaagcaatttgttgtctctttatttggagctgggaagaacccggcatggcagatgctagttcgaggactgacacatcaacagtcctggataccgacgataagaatcagatggtagacgggcaaagtggagctattgtgccttctaattcatctgatcggtctgacagatctgacaagcccatggaccaaaaggtgttacgccggcttgctcaaaatcgtgaggctgcaagaaaaagtcggctgagaaaaaaggcatatgtacaacaattagagagcagtaagctgaaacttgcaagcttggagcaagagatcaataaagctcgccaacaaggaatttacatttcgagctcaggagaccaaactcatgctatgagtggaaatggagctatgacttttgatttagaatatgcccgttggttggaggaacaaaacaagcagataaatgagctgaggactgcagtaaatgctcatgcaagtgacagcgacctccgtctcattgtagatgggataatggcgcattacgatgagatattcaggctgaagggtgttgccgcaaaggctgatgtgtttcatatactttcaggcatgtggaaaacacctgctgaaaggtgcttcttgtggcttgggggttttcgttcctctgagcttctaaagcttcttgtgaatcagctcgagccattaactgagcagcagttgttgggactatcgaacctccaacagtcctctcagcaggctgaagatgctctatcacagggaatggaagcgttgcaacaatccttggcaggtacgttggccgggtcccttggtccatcaggatcttcagggaacgtggcaaactacatgggtcaaatggctatggccatgggcaaacttgggacccttgagaatttcctccgtcaggctgacagtttgcggcagcagactttacatcaaatgcagcgaattctgacaatccgacaagctgcccgtgctctacttgcaatacatgattacttctcacgtttgcgtgccctgagttctctctggcttgctaggccacgggagtaacaacacatagggtgcatcaccgttaatgcttcatgaactgatctgggaggaacggcggagcgggactgattgcggatgcatttgcagaagattggtggctcagttccctcggcacaagttgtattgacaccttttggtttcatgttgtacctgatgttgtacaagtagggtaaagcttgtaacttgtaagttatggtgaatttatgattggcagattgtacaattgtattagcaataaaataaaaggtaggt

SEQ ID NO: 5622 - DNA, 1565 bp, Oryza sativa
  Predicted polypeptide sequence is orthologous to G558, G578, G629, G1198, G1806
atcatcttcttcctcctcccgacctcccgctcctccgcactagtccgaatccgagctccaagtcgtcgagcaacctcaccgccggaggacaccttccgccgctcgccgtcgccgccgccgccgccgccgcgcagcatggcgtagcggtggtgggcatggcggcgcaccaggggatggcggcggcgacggcggcggaccggttctgcctgccgaggatggcggcggcggcggcggccgcctcgcaggtggagaactggggcgactccggcgtcatcgtcagcagcccgttcaccgacgacacctccaccgacctcgacgacagcgccgacaagcaccacctccacgctctagtgggcggcggcgatggcggcgacgacgccggcgagcagcgaggcgcggattcctccgccgtgtccaaggaaagaagaggggatcagaagatgcagcggaggcttgcgcagaatcgcgaggcggcgcggaagagccggatgaggaagaaggcatacattcagcagttggagagcagcaggtccaagctgatgcaccttgagcaggagctccaaagggcaagacagcagggaatcttcattgcaactggaggctccggcgatcacgggcactcgatcggaggaaatggtacgttggcgttcgaccttgagtacgcgcggtggctggacgagcaccagcggcacatcaacgacctgcgggtggcgctgaacgcgcagatgagcgacgacgagctgtgcgagctcgtcgacgccgtgatgatgcactacgaccaggtgttccgcctcaagagcttcgccaccaagtccgacgtgttccacgtcctctccggcatgtggatgagccccgccgagcgcttcttcatgtggctcggcggcttccgctcgtcggagctcctcaaggttcttgccagccatcttgagccgctgacggatcagcagctgatgggcatctgcaacctgcagcagtcgtcgcagcaggccgaggacgcgctgtcgcaggggatggaggcgctgcagcagacgctgggggacacgttggtgtcggcggccgccaccgtggtcagcggcggcggcggcgccgacaacgtcaccaactacatgggacagatggccatcgccatggccaagctcaccacgctggagaacttcctccgtcaggctgatctgctgaggcatcagacgctgcagcagatgcaccggatcctgaccacgaggcaagcggcgcgggcgctgctcgtcatcagcgactacttctcgcggctccgggcgctgagctcgctgtggctggcgcggccgagggactagactgactaaagaggatcaatatcatttgcctgagttctgagttctgacgatggatggaggtgaacctgttttttgattgctgaatcctgagagagcgttaactgcgatcggcattgtaaaatcagttgctttggtgatgaagcagtagtagtaggagaatattttagattgggctcttgggcctgtaacgtgttgtagtgttagcgtagtaagaactaatccgcgtacaatgtcaaaaggagaagttttatt

SEQ ID NO: 5623 - DNA, 1831 bp, Oryza sativa
  Predicted polypeptide sequence is orthologous to G558, G578, G629, G1198, G1806
tattatgctcaggttattcatcattatccacagatatgttttttcttctttgcaaatattctccttttcccagagccgcattggactccaatacaagagtcagagggtggaagcaaagaaatcgtagtaaatgatctctactggcctctgtagccaaaggattcagcaaatctgcgaagacctcacgagtcaggagctttccaggagttgcaacctgcagctgctgcttactttggtgagttggagaaggcccttatccatggcaccagtgctggtgctggtgtcgatcatggcatgatccaaagtgacgcgtacacagagtcagcaggatatcttgcagctaggccccccacactggaaatcttcccttcatggccaatgagtcatctacaggagccatacagtaactcgcagtcagtagggagcaccactgactctagctcagctcagaacacaatgtcacaggccgagttggtgtccccagcgagcatgaggtccgactctgggcaggaacagcaacaacaggaggtattgatggtgaccattgatgattacaactacaaacaaggacttggagcagcaatagctactgcaccaagctttcagcaacatgcaggaggcctagacatgaggaagcatggatccactagaaaagacggaaaactgttagatgccaagactgaaaggcgattggctcagaacagagaagctgcaagaaagagcaggctgaggaaaaaggcttatgtgcagcaacttgagactagccgcataaggcttcagcaaatcgagcaagagcttcagagagcacgctcacagggcttgtttcctggaggatgcagtgcacctggagatatgagctcgggtgctgtaatgtttgacatggattacacccgatggatagacgacgacagcaaatgcatggcagagctccagggcgcgctacaggcccagctccccgacggaaaccttggtgccattgtggaagaatgcatgcgccactacgacgagctcttccaccttagggccgtgctcgccagctccgacgtgttccacctgatgactggcatgtgggcggcgccggccgagcggtgcttcctctggatggccggtttccggccatcagaaattctcaaaatgctgatacctcagctcgatccactgacggagcagcagctgatggggatgtgcagcctgcagcagtcgtcggagcagaccgaggaggcgctcgcgcaggggcttcaccagctgcaccagtcactggccgacgcggtgggcggcggtcctctcaacgacggcgcagatgttgccaactacaccggcctcatggccctagcacttggcaggcttgagaacctcgagagcttttatcgtcaggctgataatctgaggcaggaaacgttgcaccacatgcggcgaattctcacaaccagacagacagctcggtgttttctttccattggagagtataatcgccgtctccgtgctctcagctccctctgggcttcacgtcctcgcgaaaacttcattgcgacagagaatgtcagccctacaggaactgaatttcaggttattcagcaatctcagcaaaatcaattctccggtttctgagacctcttctccaggagggtacaaattctgcatttctgccagtagcaaggtggagagagagagagagagagagagagagcgaatgtaatgttctatcattatgatattgagaaaggaacatcactaggaaaaaaaaagatggcagaaagttggaaactggggcggctcgatcacttgctatgttccaatggctcttgaattgaatgaagggttagctctaagc

SEQ ID NO: 5624 - DNA, 1974 bp, Oryza sativa
  Predicted polypeptide sequence is orthologous to G558, G578, G629, G1198, G1806
ggatgcgtcgtcgccattagcggggagaggagcgggagagagctcgtcgggattattccgagctccatatccattgaaccgaaccagctctgagtgagagagagagagagagatcggagctgttgtttcttctcgtttctttgattggtggcggtgttgaattgaattgaattgatcgatcgattgtttcttggtgtggtggtggcggcgacggcgagcagcgcgccaaggtacatgacctcggcggcgccggcggccgcgcagttcgctgcgccggcgccggcggcgatggggatctacgaccgccggcaccatcccctcgccgccggcgtctggggagaccaccccttcatccgcccggacaccaccgccagcaccagcaacgccgccgccgccgccatggtcgtcgcgccgccgccgctaacagagcccaagttcgagagccagctagctctgcctctgcagcatggagacgatcaagacaacgctgcagctctgcaagaatcgccgaggcatgcgtcggacagcttcgagcaggaggcgtccaagcctcgagacaagatccagaggcggctcgcgcagaacagagaagcagctcgcaagagccggctacggaaaaaggcttacatccagaacctggagacgagccggatgaagctggcgcatctggagcaggagatcacccgagcaaggcaacagagcgcgtacatcaaccgcagcagcaacccagccaccctaccagcgcccatcgattcaggtgtggtgacgttcgaggtggagtacgcgcagtgggtggaggagcaggggaggcagacggcggagctgagggcgtcgctgcaggcggcggcggaggggccggagctccgggcggtggtggaggcggcgctggcgcactacgacaggctgttcgcggcgaagcgtgaggcggcgaggcgcgacgtgttcttcgtgatgtccggcgtgtggcgcaccggcgccgagcggttcttcctctggatcgccgggttccgcccctccgaggtgatcagggtgctcgcgccgcagctggagccgatgacggagcggcaggccgccgacgtgcaggggctccagcagaaggcgcgccacctcgaggacgcgctgtcgcagggcatggacaagctgaagcagacgctcgccgactcgctgctcgccgaggccgtcgtcgtctccacctcctgcgacgcctcgccgccgccgccgccgccggaggaggaggagccgtcgtcctccgccgccggtgacggcggatgctacatggcgcagatggggagcgccatgggcaggctcagcaacctcgtcgcgttcgtcgaccatgtacgccatcgccgatcaccaccacctacctcccatctccatgtccgacgacgagcagagctcggctgacatcttgctgatgacgtgcaggccgaccatctccggcaggagacgctgcagaacatgtacaagatcctgacgctgccgcaggcggcgcgcgggctcctcgcgctcggcgactactgccagcgcctccgcgcgctcagctcgctctgggcggcgcgcccgcgcgagccggcgtaaagcgagctgagctcgccgccggcaacggccagcctgatcgatcaccggaggaggagcaagatgtcgtcgctgagctcgccggggaagacgacatggagctcaagtggctcagtttgagttctctgcattttcatttgcaaggacaggaaagaaattaaacggacgtgttcacttcatcataggatagcagcagcagcagtagctaggaggaggaggaggaggaggagaatttgaatttgaatttaaaagacgtgtaaatatttactacagtaattaacttgcttgggtagttatttgcgtcgctcaacttgtaattgctgccatttccatggataaaaaaaatgtcagggatggtcatatgaaaaattgggagtgattccaggcgcctgaagtttg

SEQ ID NO: 5625 - DNA, 4510 bp, Oryza sativa
  Predicted polypeptide sequence is orthologous to G558, G578, G629, G1198, G1806
gtccttgcgccatctcgcggctgaaccggggaggggcgccgatctctatccgacgagcagaccaagggaggggaggggatcctgggttcacccaaatatttgaagacccaagcgtttggtgattggcaaagatgggttgggggatatcccggttgattggactgaaagcagctgtgttcctctctgtggcttatttcttccatagattggacatgacactgctttcttttcccctcatatatgcctctgtgattgcgatgcttgtttctattgcttcacatccatcaattgaccttcctttgctccttggcaaggggtcgaatggaagctttcctgtgtggtcatggatcatgttctcaccatttcttcttttcatccatctgtttgttctgttacgaagatttgtgaaaaatgagcccttgtacactgagattgctgatggagtgtatgttggagggtggccctcttcagttgagcgcctgccccctggtgaacctgcagtcatagactgtacgtgcgagctcccaagaagctctactatatccgagaattcatatttgtgtgttgccacctgggatacaagggctcctcaaccatcgcagattgagtctgccgtgagatgggcactgagaaagcgttcgcagaacaaagctgtatatgtccactgtgcctatggccatggaagaagcgtctgcgtgatgtgtgcacttcttgttgcattgggattagctgaggattggaaagctgctgagcaaatgattcgtgagaagcgaccttctattagcatgaattctcttcatcgtaaaagtttagaggaatgggcaaaacacttgctcactccctcaaaaagaagtggggaatcagatgtgagttatgcgattctttcggatcatacccgaaaaaggcattgatctcgcaagaaaactaacttgctcagtggctgtgataattgagatgaagtttaaatgctctggcattatctactgttatcctagtcatgtccaaggcatttcattctctaagttaattgtttgggagtatgttgtaaaacttctactactgtggcttacaacgccagctcttttaggcgctctgttggctgcgtttgttgccctgacttgggattagggttcacagatggaatttcgcgaaaaccaatcggatttcttgaaactgctaggtctcggtttatgaaaaccggaccagttttgtaccgcattgaccgaaagtcatcggtttttaccggtttttggtcggatttcggtaaaccggtgaggagcggtttttacttcgaaattgaaaagtaaaacccttgttgggaacctttccttccccttcggcacaaaaaatagagcaactcattagcgcttgagcaattaagttagctcaaactaacttaaaaaatggatttaatatgatttttaaaacaactttgctatagaagagttttgcaaacaccatttagcattttgaaaaacgtgtgtgtggaaaattgagaggtataagttgggaaagctcgttgccgaacgcagcctaagaacaagttttataatagagccaactttaagtttatagcttatattagaattaacatgtatagtgatgagctataaggttatctctctatttttctcctctctctatctctctcatgcatatgcatttaatgtatttatcttgaagtatgtgaatagctatctcttgcataataagagccaatctttttcattttctaaattctctttcctccacataagtttatttgccttatagtgtactattaaacttgctctaatgatcttccctgtcattgaatgcttgccagagacgtggtattgtcggatctctctttctgaaaaagaggggcctctgctagcctgctagattctcatttatagcgaaatgtggtatgtttttcatttttggtagtttgcatctatctctctgttaggttcttttcatctggcctgaaataaatgctcaactattcaccactttgctgtacccctgtattctgtggacatttcatacttgactcatgaaaattttcatgtttgtatctcatgttttgtgtgtaatgatcgtggctaagctgtagtgtactcatcccatcatgctatcttgtgtggagtatgctcttctggccttttcataatttttgccatttttctgcccttgtctcaagcaccagtttgccagttgatggatcaaaatcaagagctgcactattggaacaatctacatcctacggaaagtcgcatgcctggcaagaaatatctcaaatggtcttggtagatgtcacatgacaaaagggttgcttttcacctttctagttctttgatcttcttatcagttgaattcactgatctgccctttcttccatttatttggtctttgaaaaaagggacttccatctatttgtttcttgttttactaataagcattgtgacattccttgtgacttgcgttgtttttctgtgtcctgttttttacatgtatttcagatgtacctcttagtgacaactattttgtctgtcaattgatggtattagatttgtcctccgtgatttcagagttcagacagttatcatctctcttccatcagtgccattagtgccaggttgggaaagccttatttgctggcacgttttcttttttcttttttttttttggtagtgttgatctgcgtcatgttctgttgttatctgtagatgtctattttcaaagtaagcttgggaacatcctacctttaaaaaaaatggcttgttcagcagaaatattagaggttgttttatgcatcgtcttttgggaggattttgtctgctcaagtcatgagcagccacgcatctcctgcctttgcattgctctggtctgcaacaattatttctgtgctaactcttcagcctgttcaagagccattggaagtttggaacaagtgagccagtgaccagcattgcattgcacctcaacaaatttttgcctcttccttttcctagtgatgttgctttctcaatactttaataatagaacattacaacccctctccctctcccaccctctctttctaacatcacttttggccggagtttacatcctccaggagaagctctcaaaatcctgagtactgattctgctgaggctgattatgcatcggttgcagctcggttcctgtgggactgacgctctcggtgccaatgaagttcctgttgcaagagaaaaaagagtcaatgccagccatgttcatctgtttctccgactagaagagatattgcacgaatatctgtcctcgatataacacatcaaatgatcaaatcaaccatccaccctatgaacactagtataattcatcgcttatctaatgactcgctggagataagcagttctgagtcttactcgcgaggacgtgaagaccagaggttgctgagagcacggaggcggcggtaatactccccaatggagaggaaacaccgagccgcctgccgggttgttagaatccgccgcagctgatgcaacgtttgttgcctcagattgtcagcctgcacatttgccaggaatgaagaagaaaaaaaaagtaagttctgcatgaatgatcaacggaacgggatgacaatgctaagctgttgacgtacctgctggtagaagctttcgaggctggcgagcttgtccagggcgatggccatgaggctcatgtagttgggcacgccggggccgtcgttgagcgtgccggcggcgacggtgtcggcgagcgactggtgcagctgctgcagcccctgcgcgagcgcctcctccgcctgctccgacgactgctgcaggctgtagatccccagcatctgctgctccgtcagcgggtccagctgctgtatcagtatctgcatatatagtcgacgatgagtatatattcgtgacacgcccatgcaggcaacgccggcgatgcaggcggcggcggcggcggaggcgaaccttgagaaggtcggaggggcggaagccgcccatccagaggaagcagcgctcggcgggggtagcccacgtgccggtgaggaggtggaagacgtcggagcgcgcgagcgccgccttgagctggaacagctcgtcgtagtgctgcatgcactcctccacgatgaggccaaggttggtgtccagcaggtgcgcctgcaggccgccacggaggtcggtcagccgcttgctgtcgtcgtccagccagcgcgcgtactccatgtcgaacatggccgcgcctgcaaacgattttactgcgccgtggtgagaactccgaggcacaccctcgtctgcaagctgcaggcttgcaggctgcagctgctgctgctcaacgcatcgaaaaaagaaacggacggctctgattaccagaactcatgtcgcctgctgctctgcaccccccaagaaacaggccctgacgatcaatcaagcaatgcgggtaccatattaaattcctgctaatttatttcatttctggatagtagaaaaaaaatagtactagtactagcatcagaaattc

SEQ ID NO: 5626 - DNA, 2225 bp, Oryza sativa
  Predicted polypeptide sequence is orthologous to G558, G578, G629, G1198, G1806
gtgactccatgacaaaacaccttcaagtagagacaagacctatacctctctctcctttcctctcttcaaagaagaaaaaaaccagcataggagaaaggaaggacaagatctttccatcaactgtgtgattagcatgccccagaccggaaggtgaagctgctacactttcagatactccatatcaagattcaagagagagctaaagctataggagtgagcagcaatagcaagagccaagaacagctagctactccagctgagagccaagaaccggtcaagctttgcttcttgcacttcttgctagctaaagctactccggtcacttttctgctatagtagctcttggctcttgcttatcacaagagaccacaatcttgatcgaagaaatttgagctagcgcttcgttctgattcttggagatactgggagatcgagctgtggttttgtggctcgtaggatgggagaggctaggagagggcagaatcctcatcatgttcttggctatggcttccatggcaccaccttgcccaactccatggcttctgcaaacctcttcgagcaaggaggaggaggaggaggtggcgctgcctattttggagagctagaagaagctcttgttcatcaggttgccacactcaggaggagggctcaacaaactgcaaccaccaccacctctcaccatggacacaccactcccttctccactgctgctgctgcagctacagcaacagcaacagctaggcctcctgctacactggacatcttcccatcctggcctatgaggaggagctctcttccaacaccgaaggatggatgttcaaatgtaacggcagacacaacggactccgagagcagcagcaagaacaacggcgatcagggtgcagcagcagccgacatggcgagccagtttgatcagatcccacagcagcagcagaagcagcacaagaagatggcagcaagttccactcacagtgaccacaggatgacaaagacacttgatccaaagataatgagaaggttagcccagaaccgagaggcagcacgcaagagccggctgcgaaagaaggcttacatccagcagcttgagagcagcaagttgaggctggctcagatggagcaggatctcgagagagctcgttcccagggcctcttgctgggaggatcaccaggtggaaacaccagcgcaggagcggcgatgttcgacgccgagtacgggcggtggctggaggacggcgggcggcggatggcggagctgcacggcgggctacacgcgcacctgccggacggcgacctgagggcgatcgtcgacgacgccctggcccactacgacgagctcttccgcctgagggcagccgccgccaaggccgacgtgttccacctcatcactggcacgtgggccacccccgccgagcgctgcttcctctggatgggcggtttccaaccgtccgatctgctcaagacagtggcaccccagctagaccctctgactgaacagcaagtggttggcatctgcagccttcagcaatcatcgcagcaggcagaggaagctctctcccagggcctggagcagctgcatcagtcactagctgagaccgtcgccaatggcggctccgtggtcaacgaagccagccttgggagcttcatgggttacatggcccttgccctgggcaagctgtccaaccttgaaggctttgtcatacaggctgataacttgaggcaacagactcttcatcagatgcacagaattctgacaattaggcaggcagctcgatgtttcttggcaattggcgagtaccataatcgcctccgtgccctcagctccctctgggcttctcgtccccgagagatattggtggcagatgaaggcaactgtggagagctaagcatagcagcacaaccatctgaaagccaattttcagctttctgatttacaaggactttgaagactaaccttcagataggagcagaagtaagcaaaactgggaacaaattttggaagtaatctgacacgtgtgggaaacactgatatgagctgggaaacaatgcaagctccagaactaggaagatttctcagaacccagattgcatagaactcacatggtaatttgcctgagatgtcaaatgatttaatgtcctgcccagtgacaacaaaaaggggttagctagattttgttgctgaaatactacttatttatgtgatttagtggcaaattatgtttcccgtg

SEQ ID NO: 5627 - DNA, 1899 bp, Oryza sativa
  Predicted polypeptide sequence is orthologous to G558, G578, G629, G1198, G1806
gagtggatgaaactccaaggctgattcaatttgccagtgtgtgagaaacgagaaacaaccaagaggctcatcaggatcaagtggctgatcatcatcatctctctctaggatgtagagctagtggtgatcatggtgcaaggtgaggagagttcttggaggatggcagcaagcacccaccatgagagagcaatacctctcaaccaagcacttgcctatggagtccaagcccatgcttctccttctgttgctgctgcaccacctgccagcttcttggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaagacagaacggagattagcgcaaaacagagaggctgcgaggaagagcaggctgagaaaaaaggcttatgtgcaaaacctagagaccagcagggtcaggcttcagcagatcgagcaagaactccaaagagcacggtcacagggcctgtttcttggggggtgcagagcagcaggcgacatgagttctggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttgagagcttctcctggaggatgtaaactccggccaaaagtgatgttagaaagagagggtgggagagggagaggggttgtaatgttctattattaaagtattgagaaagcaacatcactaggaaaaggaagaggcaaaaatttgttgaggtgct

SEQ ID NO: 5628 - DNA, 2027 bp, Oryza sativa
  Predicted polypeptide sequence is orthologous to G558, G578, G629, G1198, G1806
gtcatgacaaaaaccttcgagtgaagacaagaccctagaccgtctctctctctctctgaccaaggctagctagggaaggaagaacaaaaacagcataggaaggacaacatctttctctgaactgtgggattagtacgcccaagaacgtgaagctattacaccgtcagatatatcaagaagatgcaggcggagcaagagcaactgcgcacagaaacggtcaggcatgcctgctctccctcctgcttgtcataaaagggaagccacaagctgaagccagattgctagaaggtagttcttgaggactgaagcaaggtagaagaacttgagcttctggttcgtgtggagctactgggataagttggctgctgattgctgaagatgggagaagctagcagtagttcaggacatccaaggcagaatcctcatgttcttggctatggcttccatggagctatgcccaactccttgccttctgcaaacttgttcgagcagcaaggaggtgctaactattttggagaactagaagaggctctgatgcaacaggtggccacactcaggaggactcaacaaactgcaaccaccacctccacccttcatcatggagacaccacccccttctccaccactgctactgctgcggctacagctaggcctcctcctacactggacatcttcccatcctggcctatgaggtctctccacacacccaaggagggttcaaatgtgacagcagacacaacagactcggagagcagcagcaagaacaacagcaaccaaaatgcctcatcagaccagcatgtgctagtaggagacatggcaggccagttcgaccaaattccacagcaggaacaacacaagaagatggcaactaacagtcccactcatagcagcaagactggcaaggcgcttgatccaaagacgatgagaaggctcgcccagaaccgagaagcagcacggaaaagccgactgcgaaagaaggcttacatccagcagcttgaaagcagcaagctgaagcttgctcagatggaacaggatatccacagagctcgttcccagggcttactgcttggagctccaggtggaaacaccagctcaggtgccgcaatgttcgacgtcgactacgcccggtggctggaggaagacagccagcgcatggctgaactgcacggagggctgcacgcacatctgccggacagcgacctcagagccatcgtcgacgacacgctaacccactacgaccacctcttcaacctcaagggcatggcggccaaggccgacgtgttccacctcatcaccgggatgtgggcgaccccagctgagcggtgcttcctctggatgggcggattccggccctccgagctgctcaagacattgacaccccagctggatcccctgactgagcagcaagtggttggtatctgcaatcttcaacagtcatcgcaacaggcagaggaagctctctcccagggcttggatcagctgcatcagtcattagcagaaaccgtggctggagggtccccgttggatgaccccaacgtcgggagtttcatgggtcacatggctattgccctcggccagctatcaaatcttgaaggttttgtcatacaggctgataatttgaggcagcagactatccatcagatgcacaggattctgacagtcaggcaggcagctcgatgtttcttggccattggagagtaccataatcgcctccgtgccctgagctcactttgggcttctcgccctcgagagatactggtggcagatgaaggcaattgtggagagctaagcattgcagcacatccatctgagagccaatattcagccttctgaaatcctgtttcaaatgtattttgcaactaaccttcaaagtagggagcaaaagcttgttttttaaatgaaatctagcactctagcagatatgtgagaaactcagaagagagttgggaaacaatggaaggctccagctgcactagcaaaattttcagatggaatgaatgggattgcatgattttcagttactgatc

SEQ ID NO: 5629 - DNA, 3130 bp, Oryza sativa
  Predicted polypeptide sequence is orthologous to G558, G578, G629, G1198, G1806
gacccaacccaacccaacctcaacctcaacctcaagctctcctcctccttcctcctctgctcctgctcctgctcctgctgctgccgtgtgctctgctggctgctcctgctggtgaggtggtggtctctctccccccacttcaccatctcctcctctccttcgccgccggcgcgcttgcttcctcctcagcacgccacctcctcgcccctcctcatagctcaatcagattactcgaccgtgcaaacatcctgaccattttctacagccccgcgctttagcgttcttgtttttttttttttggctgctgctgatttggtggcggcggctatcttggagagagatacagaatccgtgcttcttcttgagcgagctggttggttggtggcatgaggcgtggagagcttcagagtgagtgccatggcgcgtgttgattgctgttggtggtgagatggagggtggtaggctaggaggagcggcggcttcagcatcggcggcggcggcggcggacgcgcgcggcgggatgtcgggcttcgcggctcctcagcacgccatccatacaaatttgaacaacgtgcaacctactcaagttactgattttggggcacttgcgcagtctgctggattccgaatagaagatctcgctaatctcagtacaaatggtttgttcaatctgaagtcaaatgctcataccattatcaatgaccccctccaatttgagaattatgtaaagtctatttctccgtctaatattactacaacagcaacagtaacagtagttgaccctcagacactggtcccacaaaagggagcacaactgaatttggtaactataaggactggtaacgttgagaattggggggagtcgactattgctgatacaagtccaaggactgatacatcaacagatccagacactgatgagaggaatcagatgtttgaacaaggacagttagctgctcccactgcttctgattctagtgacaggtcaaaggacaaactagatcataagacacttcgccgccttgcccaaaatcgtgaagctgctaggaaaagccgtttaagaaagaaggcatatatccaaaaccttgagagtagcagattgaaacttactcagatagagcaagagcttcagcgggctcgtcaacagggcatttttatatcaacatcgagtgatcagtcccactcagcgagtggaaatggagctttggcatttgacatggagtatgcacggtggttggaggagcataacaaacatataaatgagttgagggctgcagttaatgcacacgctggtgataatgatctcaaaagtacagttgatagtattatggcacactacaatgaaattttcaagctcaagggtgtggcagccaaagcagacgtttttcatgtgctgtcgggaatgtggaaaacccctgctgagaggtgcttcatgtggctaggtggcttccgatcatctgagcttcttaaggtaagaatatactattattatattgcgcctacttattttgaagcctcacccggaggcaaaatgctgacctgaatatatattattttaattgatccaatatttttcttaggctctgttttttttgaaaggaatactaccaggcaatggcccagtagtgtattttatagaagccaacaaagtttttacagggaaaaaaagaaaaaatacaaaaggctacaaccccctatagaagctataaagtttgtaaccaattagaaaccaattgtctaagatcatcattcatcctacacatatgtagaagaatttcatgcttaaaagaattccaccagctgtcaaatgaaggatctatattctggaaaatctttccattcctttgcttccaaatgtgccaacacgcaatgaaataaatctccaagaatccttttttctgaaatctcaatcttgctagcaccagcatccttttttctgaaagaattctagagaagtgttccaagatattcccagcttctgccaacattttctactaaaagggcattgaaagaacaggtgagacaaagtttctctgtcatgcaaagggcataagacacaagtaagatcagcatttaggggggcgtattttctcctgtccaacatgtctctcgtgttcagcctatcagagaaaagaagccatatgaaaacttttatcttcatcacacatttgctcttccagatccatcggaaaggtctgggaggttgcgtggatgcaaaattcaacttgtaaaaagcttttgaggtgtaattgttcctgccccatataaaactccaattatccccctgctgacttgctaaggacagagcatccagctctccctttagcagcagaaattctgtgtaagcttcctgggtcagtggcaacttaaaacaatcctcaaaaggtttagcacaggtgacagccaaggaatcatttctggcaatggcatggccacatagatgtggttactggcagggcaattagagcctcttacagagcagcagcttgctggcatagccaacctgcaacaatcctcccaacaggctgaagatgctctttctcaagggatggaagcactacaacagtcgcttgcagagaccctggcatcaggatctctcggccctgcaggatcttctggtaatgttgcaaactacatgggacaaatggcaatggctatggggaaacttggtaccctagaaaacttcctacggcaggctgataatctgcggcttcagactcttcagcaaatgcagcgcatattaaccactcgccagtcagcacgagctctacttgcaataagtgactacttctcccggcttcgtgccctgagttctctttggctcgcccgtccaagggaataaataaattgaattgattcgtaagtaggatattgttaggtaatgtatctctagtgttatatcagataggaattgaggtattccctacttcctagattcttcacaatgttcatgtattggtgacagactcggatcactatctttccatgtatgtcttcaagtgaatgttcaatgcatattgtagtctgtatatgacatcatatgatgagttgttgggcaaatttgtaacatttttgagaaaagtggggatgtaaatacttgcagaataattttagagcttatccagtgatt

SEQ ID NO: 5630 - DNA, 2651 bp, Oryza sativa
  Predicted polypeptide sequence is orthologous to G558, G578, G629, G1198, G1806
gtgcgctgttcctgcctacgagcgagagagagaatctcatctcgatgctgaacaagtaattttcccggttctgaatccgttcaatcatccaggaaaaatgtccggaattccaggtaagtaattttctctaatttcttatcctgatcagatttatagtgagattcaggggaatagagatctgctggctttttcatcggaaaatttcgctgaattgcgttcgcgaaaaaaaaaattcgctgaatttcgtacagcggatgatgaggattgaaaaggttgggtgctgcaaaagcgagagggggtggggaaagaagggcgcaagaccaatcaagccaaaaggaaggcaatgccacgaaggaatcggctagggttagccatccgcagccacagccgaggggttagcgggtttagccctagcccaccatgactgttgcggcgcatttcatctcctcctcgccgaggggaagaaaaaaccgcatcgcgacggcgacatcgggggggcctctttaataatgcttccatcagagagcatggccatggccatggccacgaccttgatcttgaggttagccggggtcgaaaggttcttcttcttttgcgcctttatggcaaaggggaattcttcgtcgtcacgcaccaagcgttacgcaattcgcaaaagaggagggagggcagctgtggctctttatataaccctgcatcacttcttctggctaactggtgtcctttggagctgagctacatagcacatccgtggagtctcttgtgctaagcaatttaccgttccagtgctctactttgtaggccatccatattagacggaagaactttatcagtattattattggaggagaccaattcaagaatgatataatggagctttaccctggctatcttgaagaccattttaacatccacaagcttagtatcagcagcgcctctcctccggagtacatgacctcggcgtcgacgcagttcgcggcaccggtcagaatgggggcgtacgaccggcctccgccagttggcatgtggagtcacgagcagttcaaggttgacaacggccaggccacgagtgcatccacgatcatggaggcagagatgaaatttgagaataggctagaagaaattccccaagtagttctggaggaagggagaaatgttgatcaggaggcaagcaagccgccagacaaggtcctcagaagacttgcacaaaacagagaggctgcacggaaaagccgcctgcggaaaaaggcttatatccaacagctggagacaagccggttgaaactagcgcagttagagcaagagcttcaacgggccaggcagcaggtacacggataacaatttgttgtgcagccacttcagcttacacttgtgtcactgactccattgcaaatttgcaactgctctgatgcaggctgtgtatgcaaatgggagccttcgagaaccaaatcttggatttacaggaccgatcgatccaggtgccttaggttttgagattaagtacagccattgggtggacgagcagaatcgcaacactggtgagctgaggaatgcgctgctgcaggggcagacgacggaccaggacctggagctcaagttgctcgtcgaggctgggctcgacaactacaaccgcctcttcgagatgaaagaggaagccgccaactccgacgtgttctacatcatgtcgggcatgtggaagacccccaccgagcggttcttcctgtggatcggtgggttccggccatcggaggttctcaagaatttgagaccgcagctggagcctctgacggacaagcaggtcgtggaagtgggcggcctgcagcaaacctcgatgcaggtcgaggacgccctctcgcagggcatggacaagctgaagcagacgatcgcggactccctgacggcggccgacccgttcgactcccccgaggcctacatggtgcacatggccaacgccgtggagcagctcagatccctcgtccagttcgttacccaggcagatcatctccggcagcagacgctgcaggagatgctcgatcctgacgacgcggcaggcggcgagggggctcctcgcgctgggggactacttccagcgcttccgagcgctgagctcgctatgggcagctcgcccgcgcgattcagggataagctaaacaccgtaatatggtcacggtagaagctactgatatcagtagcaattcgtcgtgttagttcgctacttcagtgtcaggtcaatggccagtgaaggatgaagagatctttctacctgtgcttcgtcgaagaagaacaactcgtgatcgactttctgcagcgccgctgcaactgcaatccaaggaatggtgtatgttcgcctgctgagatgaagaaataaccaaaattaactttggtctttctgatgtgggcacaagagaagatgtaatataatatgtaaatatatacatgttttgggtatcattgccagaggcctctacagctggttttatagacatgtgatgtaattatctgtaactagtgttgctcggttcctcctccctagtacggcagacataggtgacatactgccattgtattgtatgggagaacaaattagttcacttgagaactagaaaaacatgcagtgatgttttgctgaagttgaagtagtttctgccacc

SEQ ID NO: 5631 - DNA, 1605 bp, Oryza sativa
  Predicted polypeptide sequence is orthologous to G558, G578, G629, G1198, G1806
atgagctctgtgcgctactgcttgggcagggacttccagcctgctgccgcggcagctgcctacttcggcgagctggaggaggccctcatccatggcgccaacgccggcggcgtcgtcgatcccggcatgatcagagccgacgtgcacagcaagtcggcggcagcggcagcgacggcaggatatctcgcggccaggccccccacgctggagatcttcccttcatggccaatgaggcagcaacagcagctacacagtgggaattcgcagtcagtcgggagcaccactgactcgagctcagcccagaacacaatgccgcagatggagttggtgtccccagcgagtatcagggcctcctccgagcaccagcaccagcagcagcagccggggcaggaggtcatgatggtgaccactgatgattacagctacaagccaggcctcgctgctgcctccccaagctttcagcagcagcatcagctccagcaccaccagcagcagcagctgcacggaggaggagaccatgacaagaggaagcatggatccacaagaaaagatggcaagtcagtggatgccaaggcttatgtgcaaaacctagagaccagcagggtcaggcttcagcagatcgagcaagaactccaaagagcacggtcacagcagcagctgcagcctgcaagcctgcagcttgcagacgagggtgtgcctcggagttctcaccacggcgcagtaaaatcgtttgcaggcgcggccatgttcgacatggagtacgcgcgctggctggacgacgacagcaagcggctgaccgacctccgtggcggcctgcaggcgcacctgctggacaccaaccttggcctcatcgtggaggagtgcatgcagcactacgacgagctgttccagctcaaggcggcgctcgcgcgctccgacgtcttccacctcctcaccggcacgtgggctacccccgccgagcgctgcttcctctggatgggcggcttccgcccctccgaccttctcaagatactgatacagcagctggacccgctgacggagcagcagatgctggggatctacagcctgcagcagtcgtcggagcaggcggaggaggcgctcgcgcaggggctgcagcagctgcaccagtcgctcgccgacaccgtcgccgccggcacgctcaacgacggccccggcgtgcccaactacatgagcctcatggccatcgccctggacaagctcgccagcctcgaaagcttctaccagcaggttcaggattgtagtgatcattctgcaaaaacaagtcctctacgatgcatggtgaatagatcaggttgtgttagatatacttgcatgagaaaaaaggtgactaacctggcaaatgtgcaggctgacaatctgaggcaacaaacgttgcatcagctgcggcggattctaacaacccggcaggcggctcggtgtttcctctccattggggagtattaccgccgcctccgtgctctcagcaacctctggtcttcacgtcctcgcgagaacttcattggcaccgagagcgtcagtcccacaggaaccgagctgcaaccgatgcataatcagcctcagcagaatcagtactcaggattttga

SEQ ID NO: 5632 - DNA, 780 bp, Oryza sativa
  Predicted polypeptide sequence is orthologous to G558, G578, G629, G1198, G1806
atgaggtcccgcatcttgtggatgagccacgctgagcgcttcttcatgtggctcggcggcttctgttgctctgagctcctcaaggtacttgagagccatcttgagccgctgacgaatcagcagttgatgggcatctgcaacctgcagcagtcgtcgcagcaggccgaggacgcgctgtcacaggggatggaggctctgcagcagacgctaggagacacactggcatcggcggccgccaccgtggtcgtcggcggtgtaggcgccgacaacgtcaccaactacatgggacagatggccatcgccatggccatgctcaccacgctggagaacttcctcaagcttcggcagcagatgcatcggatcctaaccacgaggcaggcggcgcgggcgctgctcgtcatcaacgactacttctcgtggctccgagcgctaagctcgctgtggctggcgcggccgagggacgcgcgtcacggcatggcagagcgcgcatcgcaccgaccgcgcccccggcggcacggccaggtacgcgccgcagccactgcatcccgctgtcggcgaccacctccccacccaccggccggcctgcccaagaggagaaaagtgagagagagagagaaagagagagaggaggaagggagaggaggggaaagagatagggtgatgacgtggaatcctggcatgtggggcccacatgggttccacgctgattcagccgtcacgtcagacaaaaccgcggtcaaaaccaccgagggacctaaagtgaacggttttgtaagttga

SEQ ID NO: 5633 - DNA, 3528 bp, Oryza sativa
  Predicted polypeptide sequence is orthologous to G559
aagcgaaaaaccgagtttgtatactcgataaattaagaaaaagttgagcgcgccgtaccgcccgccgcagcgccgacgcgcacagactagggccggtgccactggtggtggctgtggggtggtcgtgggcggcggtctgcgcgtcggcactgtccggcacgtcttggccggtgcaggcgcggccgtcgaattggccgcagacaccgcctcagcaactgtcacaaccaacgagtcgaaacgcgccggcgccgctgtcgacgacggcgatggaacgctggagcgggtggtgcgcatcgcatgcgcgtgtctgtccaaattcacgcccgaaaagagccgcactgtggcggtgcagctcgtggagcgtgcgtttgggcacacacgcgcgaccgtgacgcgcgctaaattgcgtgcgattgccgcgctggtgctggacaaagccgtgactgaaccggcgtttgtggtgtgttatgcggactggactcacgcgctgtgtgagcagctgcgggcattgacgcccgccgataccgacgcggccgcagctgcagccgctgcggccggtggtgtgtcggtggctgacggtgacgcggatgcgcacgcgcgcgtgtgtaccacacccgacgccgcgtactgccaggcgctagccgacgccgtgcgtcagcggtttgacgacacgtttggtggcgctgctgtcgtgcagcatcctgctgcacccgcgctggcgtcagcggacggcgctgccgtaccgccacagtggcccgatctggtggtggtgcacgaattggagtcactgctcacccgcgagcgcgacgccgacgacgcgtttgtgcggccgcgcgaacgcgacgacgaacggcggcggtctgtggccgaccgggagtgccgtcgcgccgccgcactgtgtcacttcattgccgcgctcttggacgttcgcggcatcggcagcggcgacggctcctgtggtggtggtgagcagcatgaggctgctgcgggcggcgtcatcgcatggccgtggatgacgcatgtcattggcgtactgtgcggtccgcaggcaccaccgcgggcgcacacgtcagcgtgtggcgcagcgtatggtcggcctgggcggcgaccgaacaacggcgcacgctaccggccgctctggagcgtttgggcgctgccgtcgatgcggcggtcggtcacctgcgcgtgtggtgtggcgaaccatccgccgatgcggttgccaaaggcagtgcgcgacgggccgctatgcgccaacgcctgacaccggacgtttgtgaggctgtcgacgcgctatgcgcgttggctgcacagcgctgggcggtaccatcagctgcctcagcgggcacgggcccgcaccggcaatcggccgcagtgcgcagactcgtcgcggcgcacgcacaggctcgcgcacacgcggtgcgctgtctcgcgtctgcggttgcggctgcggggcacagcgcgccggtacgagcagttgttgcggcggcagcggcagcagccggtccggctgcatgtgctctcagcgcagtggctgctgcggccgcacccgcaaccgacgccgtgatcgctgccacgtcgccggcgtcaccaccgctgcgcccacagcgcgtcatgtcagccgcggcgccgcctgcgcgtcggcagccgcaacacagcgacagcggcggtaacgaaggcgttggtcactttaaggcgacgcgtcggctcaatgcaagcgcccgcgtgtttgtgccgcgcactgccgtcactttaggcgctgcgactgcttcaccgccgccgctcctccctgccggcgccgtggccgcggcaggagccgtggcagccgctgctgtcggcccgccgccgtccgcagtggcgctgcctgcgcgggagcagcggcagcaaccgcaacaccaacacccgcaatatcgcggcgacaccgatgcggacgcggaggagacgaaggaaacggcggcgcgtgcacagtggcgacggcacgtgtccgcacttatcggcaaactcacggcggagacatgcgagcgcttggccctgcggtttgttgcggactcaccgggcagtttcggggcggacgtaccggaacgcgtgcagcgcgtgcgcatggccgatgccgtggcccttatcgtgtactatgcgcagagcgagtacatgtacacgccgatgtacgcagcatttatggcgcacgtgcgcgatgcgtttgcccaagccgatgtagcactggcggcggcggactccgctgctgctactgctgttcccacagcccctcccggtggtgccgctccggacggcaacagacaccacaagcccgcacggctgcccgcagtactgccgtgggatcgtgcacgggcgtggtttgcgaccgtgagcgagtgtgtgacgggcgaagtgaacgacttttttggtgccgacgcctttctgtgcactccaacgctggccgacctgcagccgcacaccaccaacagcagcagcagcagcagcagcagcagcaacaacaacaacaacaacaacaacaacaacaacaacaacaacaacaacaacaacaacaacaacaacaacaacaacaacagcagaagtgcgtatggcattccgctcgacagcgatcacgctgcggcggctgtcgtcgccgacgcagccggtgccagtgccggtgacggtatcggtttgccgatcgcctgcggtcattacgtgataccactcggcgggtggtgtgcagcggcgaacacagcggcgcgcgaacacgcctccggtgacgcctgtggtgcgtgggagctggtgccggagatggaggccgtcaaagtgctcgaagacctgctttcgtccgacggtgagcatcccgcgcctctgcacgctgcgtcgatggtcgctgctgagcgcgaacggcgccaacagctcatgacacgcgtacggcggcgcatacacgggtgtgtggcgttggtgtgcgaactgcacgcacggcacatggcgcggcgccgtgtgctgctgaccgtactgtggggtttgcgtggtgtggcgttggggaccggtaccggcgtagcggcaccgccgttttggtatggccatgcgccggtgctgccgcccacgtgggcgctggagatgctgtgccgtgcgctgagcggccgtctcggagccgcactgatgccgccatcacagccgccaccacagtcgccaccggcatcaccggcatcggcagcgccgtcgccagcactggcaccggcggtcagccgcgccggagagcgcgcgttagcgcttgcgctcagcgaactccacgcactgagcgtgcgcaaggatttgctgccgagtgcgcgcgcacgcttcctggtactcgacacactcgacgatgccgcacatcactgggagccaaattggcgcgcgcgggaacggcgcacgcgctaccaacagcagccgcagcagcacccgcagcagcaggcgtcaggggttggtgccgcagcgccgttgacatcgtagcagttcagtgttgtctgtgttttcagtctcatttgccgtcggcagtctgagatgtgccattggtct

SEQ ID NO: 5634 - DNA, 1805 bp, Oryza sativa
  Predicted polypeptide sequence is orthologous to G559
gactccgattcctcttctttcgcccaaattttggctcaacatttcgcagcgcaatctcgagctgaatcttggggggtaaagctttgcttcttggaatcttggtgcggtttttgggggagatttgcgagcgtttggagccgagaagatgaacagggagaaatccccgatcccgggagacggcggcgacgggttgccgccgcaggccacccgccgggcgggccctccggcggcggcggcggcggcggagtacgacatcagccgcatgccggatttcccgacgaggaaccccggccacaggcgcgcccactccgagatcctgagcctccccgaggacctcgacctgtgcgcggccggcggcggcgacgggccgtcgctgtcggacgagaacgacgaggagctcttctccatgttcctcgacgtggagaagctgaacagcacgtgcggggcgtcgtcggaggcggaggcggagtcgtcgtccgccggcgccgcggcggcggtggcggcggcggccgccgccgccgcccatggagcgaggccgaagcaccagcacagcctgtccatggatgagtcgatgtcgatcaaggctgaggagctcgtcggggcgtcgcccgggacggaggggatgtcgtcggcggaggccaagaaggccgtgtccgcggccaagctcgccgagcttgctctcgtcgatcccaagagggcgaaaaggatttgggctaacagacatctgcggcaagatcaaaggaaaggaaaatgcgatatattgctgaacttgagcgcaaggtgcaaaccctgcaaacagaagcaacaacactgtcagcccagttggcactgctacagagagataccagtgggctaactactgagaatagtgaactgaagctacgtctgcagaccatggagcagcaagtccacttgcaagatgctttgaatgacaccctgaagtctgaggttcagcggcttaaggttgcaaccggtcaaatggcgaatggtggagggatgatgatgaacttcggtggcatgccacaccaattcggaggcaaccagcagatgttccagaacaaccaggccatgcaatctatgctggcagcacaccagctgcaacagctccagcttcatcctcaggctcagcagcagcaggtgctgcaccctcagcatcagcagcagcagccattgcaccctctacaagcgcagcagctccagcaggcggcacgagacctcaagatgaaatcgccgatgggcggccagagccagtggggagatggcaagtcaggaagcagcggcaactgatgcgtcatttacaaatttacaaaaaaattccccaaagtttcggtgtaaggttgtggtttaacaaccatggagatggtctgtttcattgagatgatgatgatgtgcaagagtagttatcatcatcatcatcggtaggttcaggttggcttcagcttcagtcatacagttgggtggatgttcagttgaagagtttatctgtagctggttcagtaaggaaatggtcgaataatcaagaattccaggttaaaatctttcgtttctttggtaaggtagcacatcaccaagatgtactgttgtagtgttgtctacagttccataaattcaagtagccagtatacgctgttgtttagtttttctccggttttttagaggtagaggcgtttctagtgttaatcgagaggtatactgtataccttctgattaacatgtaaatcactcaacacctctacctccataaggaccggagaaaaactcaattgtttaattaagatgccattcatgactagatgttctctgtc

SEQ ID NO: 5635 - DNA, 1879 bp, Oryza sativa
  Predicted polypeptide sequence is orthologous to G559
cagactctccagacagaagcaactacactatcagcacagttgtccatgttacaggtactttattttggctttaccttatctcatactttgtgcatccatgatttagacactctacaccaatgtttagcagttggttctactctactagacaaatgcctcagccccatgaaaatgtttatttaggtacatgcctatgcttttaacttggcattttttacctggcaggcttcctattatctgtgttagtataaggttactaaacttgtaggttattctaaatttcatgctggttgtatatcaagtgaagctatttgacaaagtgctgcactgctgcttgttctggaaattccgacaacccatacctaggggtggtaatgggcccatcattttgacctacaaaatgtgagggttgggtccaaaaaggtttgggctgaaatttagaatttttttgtgctaaaaatatttaagggttgagatgggttgtgaaaggacccacaggccaccccgaccctgtttcctctatctgagcagtaaccatttatggtagttaggatgttaacatctgatttattttttccagctgcaaatacaccttttgtatcctacaggttgatactgttaacatattgcagattatgtagtttttgaaggaacttacttttcagttttccacgagtctatccttgattatctctacctgaataatacagagagataccactggtttaacaagtgaaaatagtgatttgaaaatacgggtgcaaacaatggagcaacaagtcaggctgcaggatggtaaggttttcatatcatcgcagtaattctaatcgaattgccatatattttgagaaaaaaaaatgaagtgtcttcatgacacactaatttatagtatatataactggaaattacttgagcctattaagtattgttttcttttctctttattctcttgcgtcttcgttggaataatatagtgtgatattatcttcaattttctcctgatattttctttttcatcacctagtgatcgaagtgatattattgttttctctaccccttttgctgagttattaaccttttgtctatggtagagacgtaacaaaaaatcatataacaagatataagttgtatgaagaaagtaagcattagttaatgcaaattatgacttaggatatcatctttgataggcttcagatcatttattactattttgtaggtgtcacaaaaactctcctacagtgtttttccaatcatctttaggattgtaactgttccttgtttgcatgtagcactaaatgacaggctaagagatgagattcagcagctaaaggttgcaacaggtcaggttaatgccaactgcggcaaagtgggaaactttggcctctcctcatttggaggcgccaatccacaaggttaccagcgcagtcacatacaatctcttctggcagcccagcagctgcagcagctacagatccactcccagcaccagcagcaacagatgcatctgcagcagcatcatcatcttagcacggtccaacagcagcttctgcaggaggggttgcccttgccaggggatctgaagatgaaaggaattgtggcggcatcccatgcacagaacgccggcgcatctgaaagccacgctctgaggagtgagccgtgagttggcataggctcatggcggttgtcagtaataataacatgttgtatctgagtgactcatgcataggctagcgcagtatctaggtaaaatttcagactatctatgaagcacttagatgcctgcagcctgtagaatgtagatcccattcagttgtaagttgtagaactgatgaggcaaaactgagtaattcaccggtgccatggagtatgttcacgtcat

SEQ ID NO: 5636 - DNA, 516 bp, Oryza sativa
  Predicted polypeptide sequence is orthologous to G559
atgccggactcgccgccgcggcgggcggcgaggcaccgacgtgcgcagtcggagatcgtcctcgggacggacgacattgcctccgacgccgacctcggcgtgttcttatttggatatgaaagtaaaaatgatgagaggtttatatgtatgattttcatgttatcgttatataagtgtgagactaatgtttactcgagtcatatcttatttagtctaatttacattaagaacagggagatcatgaagagccgccagagccacaaccggtcagaccgagcctgtcagggttatggataccacatacctaatagtagttgcctaaatctcggcagaacccactacataccatgtcctatacggaagcaaccttcggacataggaggagttccggataaggaaagacaaccaaagttctacatggaaacgacaagtactactcggattgtatccatattggtttccctagttctacttggacaaggggacacctatgggtataaatacaagctcccctag

SEQ ID NO: 5637 - DNA, 406 bp, Oryza sativa
  Predicted polypeptide sequence is orthologous to G559
cacgcaatttttaataacaattcaacagattatttgtcaccaagtggtgaaactggtgccaatttgaatggaggtaacgtcgaagaatgtccatcattgaacattgatgattctacaggtgcagcatcaccagcaggagaaccagaaccagcagcgttagaatcaacagcagtagaactagcagaaccaggaccaacagcagttcaaacagtactcgataaaaaagatgaaggcggcaatgttcaagctgattcaaagtttgtcaatcgtgcaacgggcacaaatggtcatgaagcaacttctcgtagtgataatcactatgaccaatgaacttcttcgtttttgtttgttttaatttattctcgcataatatccagaataaaaacaaaaaaagcttcgtagtttg

SEQ ID NO: 5638 - DNA, 1548 bp, Oryza sativa
  Predicted polypeptide sequence is orthologous to G561, G562
agcgcgcctcagcctcagtacccaccacctccacgctcgcgccgtcggcttcgtgctcctgcgccgccgcaccgatctgcaccgtacgcgggcgtcgatccatccaaggaactcataaaaagtcatgggaaatgacgaagctgtagttactcagaagatggggaaagcaccatcgccccctaaggatcatccagcccttagtccataccttgattggtcaaatatgcaggcatattacggcccagggatcttgccaccaacattttttagccctggaatagccgctggtcatacccctcctccatttatcttgggtcctcagcctctggtgccatccgcttttgggaagccatatgccgcaatttatcctcctggtggagctttttcacatccgttcatgcccctaatggtgagcccattgagcatggagccagcaaagtctgtcaacagcaaggatagctgttcaaataagaaaatgaaggaaattgatggtgcgactgtgtcaactggcagtggcaacagtgaaaaaacaagtggagattgcagcttagaaggatccagtgatggaaacaaccagaaggcaagtggaactcccaagaaaaggagcatagatgataggcctaaatcaggcgtggaaactggtggagctttaacacctaatgatagacctagcgaacaagcagctttgccaaatctatgcattccggttacagcaatcaaaccagacgtgagcactgctagtgacttcagagttattgccaccccagtaactgaagtgccaactaaggatgataaggaatcgaagcgcgagagaaggaagcaatcaaacagggagtctgctcggaggtcaaggttgaggaagcaggccgagactgaggaactggctagaaaagttgagctattgactgcggagaacacatcccttagacgtgaaataagcaggctaacggaaagctccaagaaacttagattagagaattctgctctaatggagaaactaacggaaaccgggcctgatgaagcacaagaagtgcctccagtcaaaacaaaagcacagcaagctcgaggcgtcgaaaatttcctgtcaatgatagacaagactggcacgccgagaagcagcgggcacatggatcatgccattgccacgcccaagcttcgtcaactcctgggctctggtctggcgactgatgctgtagccgcaaggtaatcttaacgacttgaccctcccgccgttcgtgctcaaacgcagcatgtggcctggtgaattttataagctcaacctgcccgcacgattaacatcgaagtattaggtacgattttgtcactgtattcgcccttgtaaattactagtagctgccttttagacgagcattccaaccgctccaccgggatatgaatgcccccctggccgtcagttcttccctgagtttttactctactctcgtagatctgtaacatcagtgctggctcgcgttgttcatatcaaactgatctctgtaaatactgtaacactgacagaaagccttctaactttgatcttttaccttt

SEQ ID NO: 5639 - DNA, 1853 bp, Oryza sativa
  Predicted polypeptide sequence is orthologous to G561, G562
gggagatcaatctgctttcacgtctcctctctctctccgcgtgcttcctccgagggtctcctcctccaccgccgtctcgcttcccggcacgcgcgcgcgggcggcggcgagctccctctccttcgccactcctccaacccctgtgcggctactccggtgcggagccggcgagcgagcatgttctaagtggctctcttccttaaatctctctacaagaggcaattgaattgaagacagcaggctttcataaaaggcatggctcatgatgaagctgttgctacacaaaagattgggaaaacaacctcccctcctaaggatcaaccaactccatgtccatttcctgattggtccgctgttcaggcatattatggccctggtgtcttaccaccgacatattttgccccagcaatagcttcaggccatgctcctccaccatatatgtggggtcctcagcctataatgccacccccttttgggaccccgtatgctgcaatgtacccacacggtggagcttatccacaccctcttatgcccatgatggcaaatccattgagcatggaaccagccaagtctgcaagcagtaaggaaaaaggctacaacaagaaacttaaggaagttgatggggctgcagtatccactgggagtggtgacagtaaaaaaacaatgacgtctagtggggattacagtgcagaaggctctagtgatgtaaatgatctaaaggtgggcaagactggcaggaaacggagattggatgatggagctggtgctgaaacatcagcagctgcaaagatggaaaatgctttacctcccagccatatattgggaagtactgcgattttgccaaatcacagctttccagctcaagtaattaggcccagtgctactaatgttgctaattcgagggcattgggcacaccaatatctccaccgcctggtgtgattgttccaagtcatacaggagtatcaacagaattactgatcaaggatgaaagggaattaaagcgtgaaaagaggaaacaatcaaatagggaatccgccagacgatcaaggctgagaaagcaggctgaaacggaggatctggctacacaagtagaatcacttacagcagagaacacgtcacttagatctgaaatcagtaggctatcagaaagctccgagaagctcaggctggagaattcggctctaatggggaagcttaaggatcctgcagcatcgacccaggcagaaacatctctgcagaaaaccaccacagcctcctctcctcgcgtcgtggagaactttttgtcaatgatcgacaacacgaacaagacgagtgtcagacacacagagcatgctgaacccaagcttcgacaactcctcggctccggcccggccactgatgttgttgctgcaagctaatctgccattttccctgtcacagaggagagactacgcgcatgcggcctggggattttgcaagctcacgctactactcacataacattcggcagtacagtgttaggtgtcaatttggtcagtatattcaggtgaccatctactactcaaaataccgtttccaattgctgttccctgctcaggcatggaagcttgctaggtgagaccaatgtaccacgttttagcagtgttgtaacataggggtgttgtgctgcatgccaacctcaaaccttgtgagatcgctaaacactttttagaattgaaatttgtggagaccaaactaaatgaaatgtaacctaccctttttacttgggtatatgggcccatattctttacatggcttggaactgtaactttgtaagatgtttttagtcaaacttctttaaaatttatatttataacactaaattagtttcatt

SEQ ID NO: 5640 - DNA, 1950 bp, Oryza sativa
  Predicted polypeptide sequence is orthologous to G561
atgggcgtccatgtcttcaccgaccggctggccatcgccgccgattggtgcctccgcctacacggctggcctattatgccgccgctgttgggcgtctacgacttcaccgccggcctgcctccgttgccgccgactggtgtcctcgcctacacggctggcctattatgccgccgctgttgggcgtctaccacttcaccgccggcctgcctccgtcgccgccgattggtgcctccgcctacacggctggcctattatgccgccgctgttgggcctccgtcgccgccgactggtgtcctcgcctacacggctggcctattatgccgccgctgttgggcgtctacgacttcaccgccggcctgcctccgtcgccgccgactggtgtcctcgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcccgcctccgttgccgccgagtggtgccaccgcctacacggctggcctattatgccgccgctgttgggcgtccacgacttcaccgccggcctgcctccgttgccgccgagtggtgcctccgcctacacggctggtctattatgccgccgctgttgggcgtccacgacttcaccgccggcctgcctccgttgccgccgagtggtgcctccgcctacacggctggcctattatgccgccgctgttgggcgtccacgacttcaccgccggcctgcctccgttgccgccgagtggaatggatcagtcagaacatcacccccggctcgcctcgaccgccgccgactggtgtttccgcctgcacggctggcctttatgccgccgttgttgggcgtctacgtcttcaccgaccggcttgccttcgccgctgccgactggtgtttccgcctgcacggctggccttcatgccgctgttgttgggcgtctacgtcttcaccgaccggccgcctcgtctgccgccgactggtgcttccgcctgcacggctggcctttatgctgccgttgttgggcgtctacgtcttcaccgaccggcttgccttcgccgctgccgactggtgtttccgcctgcacggctggcctttatgccgccgttgttgggcgtctacgtcttcaccgactggcttgccttcgccgctgccgactggtgtttccgcctgcacggctggcctttatgccgccgttgttgggcgtctacatcttcaccgaccggccgcctcgtctgccgccgactggtgcttccgcctgcacggctggcctttatgccgccgttgttgggcgtctacgtcttcaccgaccggcttgccttcgccgccgccgactggtgtttccgcctgcacggctggcctattatgccgccgttgttgggcgtctacgtcttcaccgaccggccgcctcgaccgccgccgactggtgtttccgcctgcacggctggcctattatgccgccgttgttgggcgtctacgtcttcaccgaccggcttgccttcgccgccgccgactggtgtttccgcctgcacggctgacctttatgccgccgttgttgggcgtctacgtcttcaccgaccggcttgccttcgccgccgccgactcgtgtttccgcctgcacggctggcctttatgccgccgttgttgggcgtctacgtcttcaccgaccggcttgccttcgccgctgccgactgcgttgattggccttatcttcttcaccgccggtcgtctcgtctgctgctgactagtgccctcacctctacgtctggtttatacagctaccactactga

SEQ ID NO: 5641 - DNA, 897 bp, Oryza sativa
  misc_feature (608)..(608): n is a, c, g, or t
  misc_feature (658)..(658): n is a, c, g, or t
  misc_feature (663)..(663): n is a, c, g, or t
  misc_feature (688)..(688): n is a, c, g, or t
  misc_feature (712)..(712): n is a, c, g, or t
  misc_feature (738)..(738): n is a, c, g, or t
  misc_feature (743)..(743): n is a, c, g, or t
  misc_feature (772)..(772): n is a, c, g, or t
  misc_feature (781)..(781): n is a, c, g, or t
  misc_feature (795)..(795): n is a, c, g, or t
  misc_feature (810)..(810): n is a, c, g, or t
  misc_feature (818)..(818): n is a, c, g, or t
  misc_feature (825)..(826): n is a, c, g, or t
  misc_feature (833)..(833): n is a, c, g, or t
  misc_feature (838)..(838): n is a, c, g, or t
  misc_feature (862)..(862): n is a, c, g, or t
  misc_feature (866)..(866): n is a, c, g, or t
  misc_feature (880)..(880): n is a, c, g, or t
  misc_feature (884)..(884): n is a, c, g, or t
  Predicted polypeptide sequence is orthologous to G562
gggatccccaaccgcgatgtgctagggtttggaggcccggtgttcaatcccatcttccctccgtgcagccgctaggatcagttttatcttctttctttctttctttccgtgtcattgttattagattagattctaagttccctgttgagattccttgctgctcatgggggcctgccgaaaactacctcacctgattacgttttgtttttggttttagccccttattttttttatatgcagatagcgctcgccggaaattccaagcagtatatagaattatagatcgccgacatgtgtaggcgtttcttgtttcaggaattctcgtccgtgctgtccagatcgatgcctaatcgtcctacctccgctgaaggaggaggcgtttctgctatcaacaatgtttttaatggagctctccgtcgttttagcacggtgattcccaataaccatggccttcctttttctcaagcaaagtgcctgaattctattcaaagccctaacgcagctaccaaagcaaaccacccaacaattggtgtgggttccttttgccagcccggactttcttctcttatacaaaaccctaccacctgccttctctgggtgaaaccaantacctggattatgcagcagcagactttaaagcgtaagtctgagtactagncctgnatcaggttactttcctggtacttgnaatgatggttaattggtggcttanccccgaatcttggtctgctatagatnaaccnaaattcagcttattaatttgggccttttntttattggngggatgcatttganagcatatattggcantggaggtncccgttnnatctggntacangggaccggctggttaaggagttancggnccaaaagaagaatngganttttttgggttgg

SEQ ID NO: 5642 - DNA, 1467 bp, Oryza sativa
  Predicted polypeptide sequence is orthologous to G565
ggtggttctcttctcacaggtagaaggaagcaatggcgatgccgcccaagcccggcgatcagccctccccggggcggagccccaaccccaacctcaacctcccctgcccgctcccgcccatccctagctgcggcggcggcgcgccagatctgaggtggccttccgcttcccggacgacctgggcctcgggggcggcgcggacggcgggggcttcgacgagatcggctccgaggacgacctcttctccaccttcatggacatggagaagatcgccggcgccgaccgcgaccgcgccgccgagacctcctcccctccccgccccaccaagcaccgccacagcgcctccttcgacggcttcgccttcggggccggtgcgggtggccccggccctggccttgggaagcagcaagacggagcaggaggcgtgttctccgaggttatggaggctaagaaggccatgtcctccgagcagctggccgagctcgccgccatcgaccccaagcgcgccaaaagaattctagcaaacagacagtctgcagcccgatcaaaggaaaggaaggctcgatatataacagagttagagcggaaagttcaaactcttcaaactgaggctaccacactgtcagcacaactgacactatttcagagagacacaaccggactttctgcagaaaatgctgagctcaagattagattgcaagccatggagcaacaggctcagctgcgtgatgctctcaacgatgcactgaagcaggaagtggagaggcttaagattgctacgggtgagatggcaaagtcaaatgatgcgtataatacaggaatgcagcaggtcccgtacagcccttccttcttccagctatctgaccaacacgcagttcagcaccatgcaggcgttcagcagctgctacatcaattccaacaacctcatccaagtgtccctagccaccagatgctatcccacccaaattccctctctgatatgatgcagcaagactcgcttgggcggctccaagggctggacattggcaaaggaccagtggctgtgaagaatgaggcagaggtagtggtgaagtctgagggtagttcaatatctgcaggtgaaagcaacagcacattctaattatagacctacatgtcaacaaattgctccgtccgtttagttttctttgttcatagtctgacatgccttcctgaactgcttccctctctcccactagtttttttttttcaattcaattctttcaattttagttacattgtttgtttgttgatcatcgtgtggctgatcatgtagagacttagatatgctcgtttggaaacatcgggtttatttcttgtgtgttgtgtgttgtttgatttagggggtgaggggcactgagtgggtttccagtgacttttatgtattcttttagttatgttgtagacttgttgtctttgaaaatatgtacatttttgtgttactatgct

SEQ ID NO: 5643 - DNA, 1612 bp, Oryza sativa
  Predicted polypeptide sequence is orthologous to G565
gggagccgaacactcgctggcgggcgcgcgcgcgcgcagccggggaaccgggggggagacagggtggtggtggtgaggcgggggcgagcgcaatgcaggagccaaagcacaccgatccggcggccatgcgcggggcgcaccaccgccgggccagatctgaggtcgccttccgcctgcccgacgacctcgacctcggcggcggcggcgcgggggcgttcgacgagatcggctccgaggacgacctcttctccaccttcatggacatcgagaagatctcctccggccccgccgccgcggggggctccgaccgggaccgcgccgcggagacgtcctcgccgccgcgccccaagcaccgccacagcagctccgtcgacggctccgggttcttcgccgccgcgcggaaggacgccgccgcatcgctggcggaggtcatggaggctaagaaggccatgacccccgagcagctctccgagctcgccgccatcgaccccaagcgcgccaaaagaattctggcgaacagacaatctgcagctcggtcaaaagagagaaaagctcgttacataacagaacttgagcggaaggttcaaactcttcagactgaagccactactctctcagcacaactcacactatttcagagagacacaactgggctttctgcagaaaatgcagagctcaagatacggttgcaggccatggaacaacaggctcaactgcgagatgctctgaatgatgcactaaagcaggaactggagaggcttaagctcgctactggtgagatgacaaattccaatgagacatatagcatgggactgcaacatgtcccatacaacacccctttcttccctctcgcccagcataatgcagcccgccagaacggtggaacccagttgccaccacaattccaaccaccccgtcctaatgtgcccaatcacatgctatcccatccaaacggtttgcaagatatcatgcagcaagaccctcttggccggcttcagggtttggacatcagcaaagggcctctagttgtgaaatcagagagcagctcgatctctgcaagtgaaagcagcagcaccttctaaccaggcctacccaccgagcccacagttccattagattcgtttgttcatagcctgacatcctcgcgctgctccctgttctgtaagcttattatttattcaattcgttcgatttagttgaaattgttcgtaattgcagtggctgatctattcccttctgtggacatgattcctgtacccctcacatccatttgttttgggttcatctcctgtgtgctgtgtttgggattatcagggcaccaggactggctttctccgagaatactgtgttctttgtggtcgtgtggacttgttcaccatggattcaattcaaccttttgaaaagatgcatgtattctctgatttttttttctcagtcatgtacatgtcactgttatgctagtttgattgatgtgtactgtggaatttgtggataacaaaaggagttaagattgggattgctgtggaaccatctgtatcgtatattcgtatgtgactaatgttgggaaattgttctattcttgttcaccatatgcatgtggggtaacttttcc

SEQ ID NO: 5644 - DNA, 816 bp, Oryza sativa
  Predicted polypeptide sequence is orthologous to G565
atggcgcacacaagggcgggcggtgcagcccggttgagtcgtttgctccctccgcccccatcgctcctcctccccctccaccaccgccgctggttgccgccgtcgctcccaccttcgggccgacttcctcacagccaccgtcgtcgctcctcctcctccaccaccgtcgctaccatttgtcacctacgctcccttccatcgccggtgcgacgcttctcattctccaccaccatcgtcgggtgcaggggccacggcaacgatggtgcttgtcttgtgcactgcgatgtcgcgggggcacgatcgttggtcgggggaggagaaggaggcgcagcgggaatggcgaaggcgccactgcaggcgccgcgactgttcaacatcgtgcacaggggctccaacgatgagcttcccgaggagacagtggtggcgtacatgcgcgacaaacccatccctggcggtgccggccgtggttgccactgcccttgtcgccacgccagatctgaggcagccttccgcttcccggataacttgggcctcgtcggcagcgcggatggcgatggcttcgacgacatcgactccgaggacgacctcttctccaccttcatggacatagagaagatcgtcggcaccaactgcgacagcgccgtcgagacctcctccctgccacgccacaccaagcaccaccatagcgcttttattggcaggtttgtctttgggctggtgcgggtggcggtaggagggctcaggagtcgtcgtcgccatcgacctcctgtcatctgccgtcgcaccaaccacgcgccaccgtatcagcaacactaa

SEQ ID NO: 5645 - DNA, 2067 bp, Oryza sativa
  Predicted polypeptide sequence is orthologous to G571
aggtgacatccaaacgaaaagcttcagcccccttctttatagccttttgttacaagtataaaaacaagggtgcaaacagaagtcagttttgccattaatgtctgattttgtatcttttgctagcaagaggggatgtgcatagtgtgaggagagagaggtacaacaagaagagagaaattaagagagcagtagtagaggtgtgctgcaggaggatggtcagggccttcataagggcttcatggggggctccagagaggaagatcgtcagcaccacaatcacctcccttctgagctccccctcggcttccggagctcctcaccgacgacgatgatcgcctcttcctccatgagcaaggaatcgagcaactacgacatggccgatttcgatcaagcttcgctttttctctacctagacagtcatgatcaacaatccatccaagaacaacgacaaactctgaacatcttcccttcccagccgatgcatgtagccgacccagctcatgaagcaaagagtgctggggtagccatggccatgcttcccaatggcaaccagctgcaggttcttgcttctcatcccagcaagaagcctgatcagcaaggtggtcaaaagattaattccagtgtccctactaatccacctggccctaatcttcccttgcctaactctgccaaggataacaagaatagtagcctcattaagaaggaaggaagcagcagtgggaagggtgcaacaacatccaatgatccagaaagagaaggaaggaggacactagaccctaagacactgaggaggcttgcacagaatagagaggcagcaaggaaaagtaggcttaggaagaaggcttacattcagcagttggagtcaagtaggattaggctaagccagcttgaacaacaagttcacgtggcaagagtacagggtgctatgctgggtgctggagatcagcaccagggccttccttctggcccttcagctgcatcgttgtttgacctggagtatgggagatgggtggaggagcacagcaagctgatattccagctgagggcagccctgaacgagcagatggcggacagccagctgcaggtgttcgtcaacggcgcgatggcgcagcacgacgagctgctgagcctcaagggcgccattgccagggctgacatcttccatctcctctgtggcgtctgggctacccccgccgaacgctgcttcctttggctcggtggatttagaccctctgaggccatcaaggtgatgcttaagcaggtggagccgttgtcggaggggcagctgatgagcatctacgagctccagcaagcggcgaaggggacggaggacgccctcagccacgccatggacggcctccagcagtcgctctccgacaccgtcgccgcccctgacgtcgccgccgccggcggcttcatggggcacatgtccctcgccatgaacaagatctccgctatggaggacatcgtcaggcaggcagatggcctgaggcagcagaccctgcacaagctgcagcatatgctgaccatccggcaagccgcccggtgcttcgtggcaatctccgactacttccaccgcctacgcgcactcagcacactatgggttgcgaggccaaggccggaggaggggccggcaatgtagaataagtgtctcagagaagatcagaacatcaacaacaatgcttgcaaaatttaacctggttaagaattaggtagttagctgcatgcagtgaattgaactagggagcacatttgaagagaggtgtatgtgagagtaatgctctctcagatgtgtaacttgcaactttgtaaggtgtatatagcttcttaggtgttagagaagaaaagaagtagggaatagtggaaacttaatttgaactttcttttgtttctttttatccctgactttttctacttctttgccagctatatgtaagttcacctggaactacatcattgatttggatagtgtttctaatacttgctggtaacaaaatcatgagataaatgctctaaggggaaaaaaaaacttccagagtctcatatcccctctgaaatttgttcgct

SEQ ID NO: 5646 - DNA, 2396 bp, Oryza sativa
  Predicted polypeptide sequence is orthologous to G571
gtgatgcagagggagcatggagccaaacagaaagtctgtttcgccattaatggctctcccactcacctctctctctagaaacacatagccaagatcatcatcatcagcaaccatattagtgaattaagaggaaatcaaagcagtagcagcccaggaacagcatcatcaaagcagtaagagagggtagtttgcaagtggtgctagtgtccaaggcgccatcacgaactagagtcctagatagagctagaggtcatgcatggggtagttgctggtgtggaagaggaagagagaaagtgagtgagagagagagaggtggcgccttggctgctagcctcatagagtcaaagagtatttaggaccttgcagctatggctatagatagatagaggcacatacgcatacgtatatagcttgctaccttgccttctctgtgtatgtttcggcgtgtgttcttcttcttctcttcttcctcctctcgattctgaagaggttagctttgatttgatcgatcgatgatgagcgggagcgagagccagcaggagagggagcatcgtcagcagcaggagatgaacatctcctttgggatgatgatgaaccatggccaccatcactacggacagcatcagcagcagcaccatcatcatccgcctccgtcatcgtcttcctcttcctccatgcatgccgctgccgcaagcttcatcaaggaggcatctgcaggagcttatgatcatctgggggagctggaccaggccttgttcatgtacctggatcatggcagccatgcggcgtcgcaccaagaacaaaggcagaccctcaacatcttcccttcccagcccatgcatgtggagccatcacccaagggagagattagtttagtgctgtccccagcagctgtgggaaccaagatggcgaggtcacctgatcatcaccaccaccatcagcagcaagcagcagcagccatggaggagttggcgacagggagcaggagacaggatcaccaccacctgcagcaccaacctttcgctgctgagcctgcagggatcaacagggatgtgaagccggtgacagccaagaaggatcacaggaggggtgtatctactggtgaacgcgacccaaagacgctgaggaggctagcccagaacagggaggcagcaaggaaaagcaggctaaggaagaaggcttacatccagcagctggagtccagcaggatcaggcttgctcagctcgaacaggaactgcacaccgcgagagcccagggggtgttcttccccggcagcggcgggctgatcggcgagggaggcagcgggaagggggtcctgctgggcgggatcgatggcgtcggcggcggcggcggcggggggctgagctcggaggcggcgatgttcgacgtggagtacgggaggtggcaggaggagcaccaccggctgatgtacgagctgcgggcggcgctgcagcagcagctgccggagggggagctgcaggtgtacgtggagagctgcctggcgcaccacgacgaggtcgccgccatcaaggacggcgccatcaggggcgacgtcttccacctcatctccggcgtctggatgagcccagccgagcgctgcttcctctggctcggcggcttccgcccctccgaggtcatcaagatgctggtggcgcacgtggagccgctgacggagcagcagatcgtgggggtgtacgggctgcagcagtcggcgctggagacggaggaggcgctgacgcagggcctcgacgcgctctaccagtcgctctccgacaccgtcgtctccgacgccctcagctgcccttccaacgtcgccaactacgggccagatggccgtcgccatcaacaagctctccaccctcgagggcttcgtccgccaggctgagaacctgaggcagcagacgctgcaccggctgcagcaggtgctgacgacgaggcagatggcgcggtcgctgctcgccgtctccgactacttccaccgcctccgcaccctcagctccctctgggtcacccgccccaggcacccgcctcacgaccaccagccgccgccgcactccgccgccccccacacctgagatcaccgccgccggcaacgcatgcaaacaccgtagctcttagctagcagcttagagatatcgagagatcagaaattaagcgatcgatcgagagaggacgacgactgtgaaaccccccatggaatggatggatggatggatggatgaaccgatgtgtactgtgtttgggcattaaccctttgatgtaaacaaagtaggcgtgtttgactgcttggtcgatcgatcgagatctctgtcgataggatcttgaattagcggatcttacctcagcaactggttcatcaagtgttgatgcagctcaatcaaactttttcctgatg

SEQ ID NO: 5647 - DNA, 2843 bp, Oryza sativa
  Predicted polypeptide sequence is orthologous to G571
gatcgattcctcccttggcaaatgaatggcacaccactcttcacgcacctctgctcccctctgttggtttccatcagaaagaaggaaacaagtttctctgcgtctccgatctgcagtgcgagccacgaaggttggcgtcgtctcctcctccctctcctcctcgcgcgcggctgccgtcgagaagacgctcggcctcccttgtgcggcctcacctcctcgcgctgaatcccctactccccgtgttagatttgaccttcataatccaaaagaagaggttttagttcaagcgaacgataatggggatatccaaggtgattggcatcgctggaacaactcttctagtcacgtctgttggtctgtggaagatcggcttaagaattgtcgcggttccttttctagcaaccagtactattgcctatatcatcgctgttgcatcccacaattccatcaacataccttggatcttgggaaagaattcaaaggggaggtttccaatttggtcaagtgtactttttggtcctttcttgatacttgcccgggtatatgcaactgtgaagagacatatgaggaagaaggaggctgtgtataacatgatcactgaaggtgtttatctgggaggatggccgtttatgttgaagcatttgcccccaggagacccgtctgttattgattgcacttgcgagttgccaagaagtgattttgtcccaacaaatgagtatctttgtgttcctacttgggatacaagagccccgacgatatcccaaattgaatttgcggcatgctgggcatgtgaaaagagagccaaaggaaaaccagtttatgtacattgtgcatttggtcatggaagaagcgcttgtgtcgtgtgtgcagttctagtagcattgggcattgctgaaaactggaaggatgcagaaaacatcatccgagaaaaaagaaagataaaaatgaatgctgttcaccggaaaaccttagacgattggtcaaaatatagagcttctcagaagaaggataaataactgacattaaatcatttgacatctcaggcaaattaccatgtgagttctatgcaatctgggttctgagaaatcttcctagttctggagcttgcattgtttcccagctcatatcagtgtttcccacacgtgtcagattacttccaaaatttgttcccagttttgcttacttctgctcctatctgaaggttagtcttcaaagtccttgtaaatcagaaagctgaaaattggctttcagatggttgtgctgctatgcttagctctccacagttgccttcatctgccaccaatatcctacaggcaaataaggctccagctataaatatatgatggatgcgtccagataaatagcactacagctgctgtcctattattcttttagacttttatagaatttagttagttggctgaaagcctgaaatagttgaaacatgcatagaaagggacaaaatccatatctagcccttattttgtacaccttcacatcattgtattttatcataatcttttttaggataagggactaccactagtttattggtgtaatgaccttcaaaattatgataaaataaagtgcatgcagtatgcatgatgtgcaaaaaaaagtttgctagcttttgactacctccagtaggaggctggtccattccatgctgatttaatagggtgcattccttatatttttttgtctagtaaataatggttcagttatatgtacttcgaactttccaatcagagattaaaccttcaacaactacaggtaggaggcttatcataaaataaagaaaggaaaagaattaattgcaggtaggactagagcatggtgcttactctcggggacgagaagcccagagggagctgagggcacggaggcgattatggtactcgccaattgccaagaaacatcgagctgcctgcctaattgtcagaattctgtgcatctgatgaagagtctgttgcctcaagttatcagcctggaaatccaatttgacagttgcagttttagtacatgatgaaaggatctcactcttggcactagaaaattgaaaactagagcagatactggtagtaagtttgttttactatgccatactatagttaatcagataagctccaaagtccaaaataaggataatgtcacatgtttaggtgaccattcttttctttgtatgatgtagagataacatctctacatgttgatgccatagcatattactgtaggaaaatttgttccttttcactctttattaattaacatgttggcatgtcgcattattaaaaggataaaaatgactgtttttttgctcgactgtcaagtgattggattgctcatctagacatccacaaagttgagtcaaacagggagagaaggatcagaactggaaaaagggcaggcaacaaggacttcacctgtatgacaaagccttcaaggttggacagcttgcccagggcaagggccatgtaacccatgaagctcccaaggctggcttcgttgaccacggagccgccattggcgacggtctcagctagtgactgatgcagctgctccaggccctgggagagagcttcctctgcctgctgcgatgattgctgaaggctgcagatgccaaccacttgctgttcagtcagagggtctagctggggtgccactgtctgcatcaacatcaagagtttgtaatgaaattagaaaaaccatacttgtacttagaagatgaggtcagatttagcatggttaaaacttgatttggcaaattgttttgcacattgtgaactgtgaagtgagcttcatgtttgatgtcagattgtcaggtgcattttcttatgaaaact

SEQ ID NO: 5648 - DNA, 1892 bp, Oryza sativa
  Predicted polypeptide sequence is orthologous to G571
aaccactggttcccgttccatttcttgcacaactactcctctagccaaaagtcatcctttagcttctggtcagaagaacagccgcagggcctgcttggaaggggattaatttgagcaagtcagcaggcaagtttgggagaggaacaaaaagtttgcgggtatcgataaattcatcggttgatcatagaagatcagatgggaaagaagcaggagatggatttggattactaggctgtcagataccatttcaagatgggtgaatcatgtctgaagtgattcagaaggaaggttgaagcactgctgtttagtttaaggaagtatttttcatggcttatccttccacctctggcatgatccaagcttcttcctccctccatggcagcatcacaagaaggaaccctgaaggatatgacatgccatctgatttggatcaagctctcctcctctactttgatggccaggaacaagataagccatctactcaagaagaaccccacaaaccacttaattttgtaaaagagactctcaacatcttcccctcccagccaatggatggagagccaactccaacaccaaaggcttcgatgtcagcgccgcccatcgccggcttttccaggagatcgccggcgccagcggcggcagatggcaggccactcaccctaggcaagacctccaaggcagcattcaagaaagaaggtggcagtggcagcggcggcgccatggcagcgtcagcaagttcagagctcaaggggcccaagacgccggaccccaaaacgctgagaaggctggcgcagaatagagaggccgcaagaaagagcaggctaaggaagaaggcttacattcagcagctagagacaggcaggatcaggctggcgcatcttgaacaggagatacaattcacaagagctcagggtgcattctgcggtgctggaattctaagcccagacgctgcattgttcaacttggagtatgagcggtggcaggaggcacaccaccaagtgatcagccggctccgggccgctgtggaggagcaccgaccggatggcgagctgcagccccatgtcgatgaagccatgtcacactatggggtgctgatggctcacaaggctaggctggttggtgctgaccccctccacctcctctccggcctgtggaagggcgccgtagagcaatgcttcctctggataggcggcttccgcccctcggagcttatcaaggttgtggtccggcatgtggagcccctgacggagcagcagctcgccgccgtctacagcgcgcagcaggcggcgaggcaggaggaggacgcgctcgacggcggcctgcaggcgctgctccggtcgctctccgacgtcgtctcctcctcggacgcgccgtcgtcgtcgcagcagacgccgccggtgatgtaccacccctccgccgccgccgccatggctgcggcgagcttcatggggcagtacggcagctacagcaacctgcagctcgccatggacaagctcgccaacctcgccatcttcctacgacaggcggatgaggagaggatgcggacgctgcacgcgctgcggcggatgctgacggtgaggcaggcggcgcgctgcttcgtcgccgtcgacgactacttcggccgcctccgcgcgctcgccttgttctggaccaccacccggccgcacccggccgccggctagaaatcaattgaatcggcttagcttaggttattagccacacacgcacacatgcaaagagtagctaaggctatatagcgacatgtaagagggagacgaggagtagatatatagctagagagagcatatgcaccatcttaacgatcaaaataaggttgtatgtgtattcgatcgggaaaatagttttaaaaatagactcgacgtgttgatctt

SEQ ID NO: 5649 - DNA, 2822 bp, Oryza sativa
  Predicted polypeptide sequence is orthologous to G571
gaagccattgtcaatcgctacgagcatctagggttagggttaatccaatccaagccaatccatggcggggggagtgcatagtagcgtaccttgatgacctcggaggggcggaagccgccgagccagaggaagcagcgctcggctgggctcatccagacgccggagatgaggtggaagacgtcgcccctgatggcgccgtccttgatggcggcgacctcgtcgtggtgcgccaggcagctctccacgtacacctgcagctccccctccggcagctgctgctgcagcgccgcccgcagctcgtacatcagccggtggtgctcctcctgccacctcccgtactccacgtcgaacatcgccgcctccgagctcagccccccgccgccgccgccgccgacgccatcgatcccgcccagcaggacccccttcccgctgcctccctcgccgatcagcccgccgctgccggggaagaacaccccctgcaccatgtatagatccgtacacattttcatccataatacataatccgaattggttgtgtttgatttgatttgggtgcagtttgaattttgctcgaatttgaaattatgaaattcgcctacctgggctctcgcggtgtgcagttcctgttcgagctgagcaagcctgatcctgctggactccagctgctggatgtaagcctgtcgtttcagtcaaaatttcagtaaagtaattaatccacagtggctgaattgaagaagagtggtagtaattaactagcaaaattaatttggtttaatttgatcaaatttgggtgattgcttttgttctgaatatattgaatatatatagcctgtcattttcttctttttctttctgtgtttaattactgtttaattttgcttcactcaccttcttccttagcctgcttttccttgctgcctccctgttctgggctagcctcctcagcgtctgcatatatttacattaatcacaaaatgatacgcaaaaaagtaagcatgatcagaccaaatcatttttagtattgtccttaactcaactgatatgcacaaaaagagaacaacaactaatctctaattatttcttgagaatatcactagtatagtacctttgggtcgcgttcaccagtagatacacccctcctgtgatccttctgcaataataaaaaaaaacataaacaatatgcacattaatgtaagctaaaacataaaaacaatcaaggacagtgttctgaatagattaatcagggtgttttctttagctagcagggttagatattagttggttaattaagtggttaagtgatgatgctgaccttggctgtcaccggcttcacatccctgttgatccctgcaggctcagcagcgaaaggttggtgctgcaggtggtggtgatcctgtctcctgctccctgtcgccaactcctccatggctgctgctgcttgctgctgatggtggtggtgatgatcaggtgacctcgccatcttggttcccacagctgctggggacagcactaaactaatctctccctgccaaatcaatcaatcaatcatcacatccacaaacattaaaccaatctttgatttcatatatactacacacgagtgctacattgaaaagacaaatgacataaccaatgtgagattcagatgaaagtaagtaaaattaattaaataccttgggtgatggctccacatgcatgggctgggaagggaagatgttgagggtctctgcatcatccatgagcacaacacaaatcaagagatcgatcgagcaaaagcagaagaccagctaaccctggagactcacacaccacaactcacaaactgatcgaattgctactgaaaactctactgaagaagagagctaggctgtatatatgcaggcatgcagctggaacaagacactactgtgctactgctgctgctgctcaaattcatcatgctttgcatggcagagagtagtgtgtactatatatgcatgtaggtacgtccaaagctagctatagctgcagtactgcaggcacacaggcaacacgagaaagctgggggctacgagagatacgggagccaaggacagatatcacacagctgcacagctagctgctgctacactgcaacactgatcactgtaacctgaagctggaaacaacagaagtggatagcatcgatcgggtcaaactcgaacaaatgtgcacatcttgctactactcctagctagtagcagcaacaagaacgatcagtagcatggggattgatcgatcatctcttcggcgtgtgtgtacgtccctctttctctgcaccaggccacatgcagatgcagctcgatctcggcgaaatcattgagcagtttgttacatgtcacagtccaaaccagccggccagatcttagcagtcagagatagagagagagagagagagggaagagagaggtatagctagagagattgttggtttcatatgcatggactttgggttgctgattccctggtcctgagatgtgtgatctccacaggagtgcagtggtagtagtagcagtagtagtactgcagagatttgttgcagctagcagatatcctggtcaaaatggagtacctgagaatctgctgcatgcaggccggccggccgtataccatgatcgtttctgatgaccccagaaaaaggatgcaactttctgcaaccataggaatatatccctcctcctcctatactacagcctactgctactccctgtgtatgcttggcacatttgtttctgtgcctaagctatatatactgctgttattatgctattattactactaatgctaaatgccaaaagaagaac

SEQ ID NO: 5650 - DNA, 557 bp, Oryza sativa
  Predicted polypeptide sequence is orthologous to G571
aaggaagaaggcttacatccagcagctggagtccagcaggatcaggcttgctcagctcgaacaggaactgcacaccgcgagagcccagggggtgttcttccccggcagcggcgggctgatcggcgagggaggcagcgggaagggggtcctgctgggcgggatcgatggcgccgccgcactccgccgccccccacacctgagatcaccgccgccggcaacgcatgcaaacaccgtagctcttagctagcagcttagagatatcgagagatcagaaattaagcgatcgatcgagagaggacgacgactgtgaaaccccccatggaatggatggatggatggatggatgaaccgatgtgtactgtgtttgggcattaaccctttgatgtaaacaaagtaggcgtgtttgactgcttggtcgatcgatcgagatctctgtcgataggatcttgaattagcggatcttacctcagcagctggttcatcaagtgttgatgcagctcaatcaaactttttcctgatgaaaacgcaacctgcagtcgttgttaattcgtttaaaa

SEQ ID NO: 5651 - DNA, 2100 bp, Oryza sativa
  Predicted polypeptide sequence is orthologous to G583
atgaacctttggacggacgacaacgcgtcgatgatggaggcgttcatggcctccgccgacctcccggccttcccgtggggggcggcctccaccccgccgccgccgccgccgccgcctcaccaccaccaccaacagcagcagcagcaggtcctgccgccgcctgcagcagctccggcggcggcggcgttcaaccaggacacgctgcagcagcggctgcagtcgatcatcgaggggtctcgggagacgtggacgtacgccatcttctggcagtcctccatcgacgtctccaccggcgcctccctcctcggctggggcgacggctactacaagggctgcgacgacgacaagcgcaagcagcgctcctccacccccgccgccgccgccgagcaggagcaccgcaagcgcgtcctccgcgagctcaactccctcatcgccggcgcaggcgccgcccccgacgaggccgtcgaggaggaggtcaccgacaccgagtggttcttcctcgtctccatgacccagtccttccccaacggcctcggcctccccggccaggccctcttcgccgcccagcccacctggatcgccaccggcttgtcctccgccccctgtgaccgcgccaggcaggcctacaccttcggcctccgcaccatggtctgcctccccctcgccaccggcgtcctcgagctcggctccaccgacgtcatcttccagaccggggacagcatccccaggatccgcgccctcttcaacctcagcgccgccgccgcctcctcctggcccccccaccccgacgccgcctccgccgatccctccgtgctctggctcgccgacgcgccccccatggacatgaaggactccatctccgccgcagacatctccgtctccaagccaccacccccgccgccgcaccagatccagcacttcgagaacgggagcaccagcacgctcacggagaatcccagcccgtcggtgcacgcgccgacgccctcgcagccggccgcgccgccccagcggcagcagcagcagcagcagagcagccaggctcagcagggccccttccgccgggagctcaacttctccgacttcgcgtccaacggcggcgccgcggccccgcctttcttcaagcccgagaccggcgagatcctaaacttcggcaacgacagcagcagtggccggaggaatccgtcgccggcgcccccggccgccaccgccagcctcaccaccgcgccggggagcctgttctcgcagcacacgccgacgctgacggcggcggcgaacgacgccaagagcaacaaccagaagaggtccatggaggccacctcccgcgccagcaacaccaacaaccacccggcggcgacggcgaacgaggggatgctgtccttctcgtcggcgccgacgacgcggccgtcgacggggacgggcgccccggccaagtcggagtcggaccactcggacctggaggcgtcggtgcgggaggtggagagcagccgcgtggtggcgccgccgccggaggcggagaagcggccgcggaagcgcgggcggaagccggcgaacgggcgggaggagccgctgaaccacgtggaggcggagcggcagcggcgggagaagctcaaccagcgcttctacgcgctgcgcgccgtggtgcccaacgtgtccaagatggacaaggcgtcgctgctgggcgacgccatctcctacatcaacgagctccgggggaagctcacggcgctggagacggacaaggagacgctgcagtcgcagatggagtcgctcaagaaggagcgggacgcgcggccgccggcgccgtcgggcggcggcggagacggcggggcgcggtgccacgcggtggagatcgaggccaagatccttgggctggaggccatgatccgcgtgcagtgccacaagcggaaccacccggcggcgcggctgatgacggcgctgcgggagctggacctggacgtgtaccatgccagcgtctccgtggtcaaggacctcatgatccagcaggtggccgtcaagatggccagccgcgtctactcgcaggaccagctcaacgccgcgctctacacccgcatcgccgagcctggcaccgccgcccggtaa

SEQ ID NO: 5652 - DNA, 2517 bp, Oryza sativa
  Predicted polypeptide sequence is orthologous to G585
tgctagatctctcctccacatccggactctcgctatcaaatttacgtaagcacagtgagaaaaataattagcagggccaccagcatactgttggcgtacagctgcaaatacctgtcgagctaatcttggttaaaatgttggtttagattctgttgcttaattgctggtgaggaggagcactcactatatagctcaatccatcttcctctgcaaaacgtacgcacgacactctggttgcgatcgattatcactccctgatcgcgagttcttggtctgcgagcgtctgcaattaagggaagagttcctctttgttttgacgaggatcgaggattgtttggacgaaccagcagcagcgtacgtgccaatttcattgatagtcgctgtatctgatttacaggaaaaatacatacaacagtgtgtggtaaagtatactactattactggagtactaattaatggaagagacccctctgccatccgggaagaacttcaggagccagcttgctgctgcagcgaggagcatcaattggacgtatgccatattttggtccatttcaaccagccgcccaggagttctgacttggaaggacggcttctacaacggcgagataaagacgaggaagatcacgaactccatgaacctcacggccgacgagctggtcctgcagagaagcgagcagctgagggagctctacgactctctcctctccggcgagtgcggccaccgagcgaggaggcccgtcgctgcgctgttgccggaagatctcggggacacggaatggtactacgtcgtctgcatgacctacgccttcggccccggccaagggttgccaggcaaaagcttcgcaagcaatgaatttgtttggctgacaaacgctcagtctgcagatagaaaactattccatcgcgcgcttatagcaaagagtgcatctattaagacaatcgtctgcgtgccatttatcatgcatggtgtccttgagctcgggaccactgatccgatttcggaggacccggctctcgtcgaccgtatcgcggcgtcgttctgggatacgccgccccgcgcggcgttctcgtcggaggcgggagacgccgacatcgtcgtcttcgaagacctcgaccatggcaacgccgccgtcgaagcgacgacgacgacggtcccgggggagccacacgcggtagccggcggcgaggtcgccgagtgcgagcccaacgccgacaacgacctcgagcagatcaccatggacgacatcggcgagctctacagcctctgcgaagagctggacgtcgtgcgccctctcgacgacgacagtagcagctgggcggtcgcggatccctggtcgtcctttcagctagttctgacgtcttctccggcgccggatcaggcgccggcggcggaagctactgacgtcgacgacgtcgtcgtcgccgctttagacggtagctccattgatggatcttgcaggccgtcgccgtcgagttttgtggcgtggaagaggacggcggactcggacgaggtgcaggccgtgccgctcatcagcggagagccgccacagaagttgctgaagaaagctgtcgccggagccggtgcctggatgaacaatggtgacagcagcgcggcggcgatgacgactcaagaaagcagcatcaagaaccatgtcatgtcagagagaaggcgccgggagaagctcaacgagatgttcctgattctcaaatcagttgtcccgtccattcacaaggtggacaaagcatccattctcgcagaaacgatagcctacctcaaagagctggagaaaagagtggaagagctggaatccagcagccaaccatcgccatgtccattggaaacaagaagcaggcgaaagtgccgtgagatcactgggaagaaggtttctgcaggagcgaagagaaaggcgccggcgccggaggtggccagcgacgacgacaccgacggggagcggcgccattgtgtgagcaacgtgaacgtcaccatcatggacaacaaggaggttctcctcgagctgcaatgccagtggaaggaattgctgatgacgagagtgttcgacgcgatcaagggagtctccctggatgtcctctcggtgcaggcatcaacatcggatggtctccttggactgaagatacaggccaagtttgcctcatctgctgccgtcgaacctgggatgattacagaagctctccggaaagctatagcaagctagctagctagaaggttgagatcagtatcgtcttggtcatttgctctcatcttgtttaggaggtaccgggaaataaatcttgtcgctctgatcagtgcctccttactagtctcgtgatctgttgcaagtaatagttagacatgcatatatatcatacaacaacgtttgatcttgcatggtaggatatatatgtacaccacatttcttatatctttactcctttaaaattcagtgaggatggtaagtgatgaatctgccaccccatcaccaactccctaaaattctgaaaaaaaaaaaaaaaaaa

SEQ ID NO: 5653 - DNA, 365 bp, Oryza sativa
  Predicted polypeptide sequence is orthologous to G585
atgtccgagagaaggcgccgggagaagctgaatgagatgttcctcattctcaagtcactggtcccgtccatcgacaaggtggacaaagcatccatccttgcagagccgataccctacctcaaggacctggagaggaggttccaagagctcgagtccgggaagaagatgtctagcccgcccaagaggaacccgtgctcagagacgatcatcggcggtgccgcccgcgccggtcccggagctgttaaagggcaccaccactgggtgctctccgagtcccaggagggcaccccaagcgacgtgcgtgtgatcatcatggacaaggatgagctgcacctggaggtgcactgccggtggaaggagctgat

SEQ ID NO: 5654 - DNA, 1323 bp, Oryza sativa
  Predicted polypeptide sequence is orthologous to G585
atggtcaccggcggcggccataggcacggcggagcggcggccgagagaggggagggaaaggaagaaacgaggcggcggtccacggctcaccctaggtcgacggcgacgacgaaaaaggcggccggaggggtggaaggcggcggcgcggctcgggtggacttggacggcggcgctccggcgatcggcgagctcgacgagggggtggacggggtcgacggctgtgcggcgaagccggaggaggcgacgccggggcgggaggcggtttcggaggaaccaaacgtggtaaaccgaatcaccacggctttctgggagcttcagcttccggcatgctcagacgagccaattagctccggtaccccttcttccccatcatcgccgccgacgaaagaaactggagacgccaacaccgtggtcatcgacgacctcttcctcgcccacagcgatgcgatactaccagcaggaggagatcaaaaagaagaacatcagctaggcgacgacctcgggcaacaacaagcagccaccgccatggagatcgacgacgatgtgatctacagcctgatcaggaactgggataacgacagcagcagcagctggatcgagctcctggaccacgccattgtctctcccgcctcgtgctttgtgccttggaagagaacggagctggacaaggaggcggtggccggcggggaggcggcgcagaggttgctgaagaaagtcgtgggcggcggcggcgcatggatgaatcgtgccgctggtagctgcagcatcaagaaccatgtcatgtccgagagaaggcgccgggagaagctgaatgagatgttcctcattctcaaatcactggtcccgtccatcgacaaggtggacaaagcatccatcctttcagagacgatagcctacctcaaggagctggagaggagggtgcaagagctcgagtccgggaagaaggtgtctaggccggccaagaggaagccatgctcagagacgatcatcggtggtggcggcggcggcggcggtgctggagctgttaaagagcaccaccactgggtgctctccgagtcccaggagggcaccccaagcgacgtgcgtgtgatcgtcatggacaaggatgagctgcacctcgaggtgcagtgtcggtggaaggagctgatgatgacaagggtgttcgacgccatcaagagcctccgtcttgatgttgtctcggtgcaggcgtcggcaccggatggtcttctcggactgaagatacgagctaagtatgccagttctgccgccgtggtgcctgcgatgatcagtgaaactctccggacagccgtagcaggctactaa

SEQ ID NO: 5655 - DNA, 732 bp, Oryza sativa
  Predicted polypeptide sequence is orthologous to G585
atggagatcgacgatgatatgatctacagcctgatcaggaactgggataacgacagcagcagcagctggatcgagctcctggaccacgtcgttgtctctcccgcctcgtgctttgtgccttggaagagaacggagctggacaagcaggcggtggccggcggcggggaggcggcgcagaggttgctgaagaaagccgtgggcggcggcggcgcatggatgaatcgtgccgctggtagcagcatcaagaaccatgtcatgtccgagagaaggcgctgggagaagctgaatgagatgttcctcactctcaaatcactggtcccgtccatcgacaaggtggacaaagcatccagccttgctgagacgatagcctacctcaaggagctggagaggagggtgcaagagctcgagtccgggaagaaggtgtctaggccggccaagaggaagccgtgctcggagaggatcatcggcggcggcgatgccggagctgttaaagagcaccaccactgggtgctctccgagtcccaggagggcaccccaagcaatgtgcgtgtgatcgtcatggacaaggatgagctgcacctggaggtgcactgccggtggaaggagctgatgatgacacggttgttcgacgccatcaagagcctccgtcttgatgttctctcggtgcaggcgtcggcaccgaatggtcttctcggactgaagatacgagctaaggttgtctctctcacttaa

SEQ ID NO: 5656 - DNA, 1983 bp, Oryza sativa
  Predicted polypeptide sequence is orthologous to G585
gtggggttgcagaagagtgaacttggatagttggcagctagagcagccagctagctagctggagtccttcttgcattggtgggcagactggaaagagaaattaaacagctagataggtttctagacttgtgtggtgatggcatctgctcctccagttcaggaagaacccctacagccagggacgaaccacttcaggagcctgcttgctgctgctgtgaggagcatcagttggagttatgcgatcttttggtccatttcaaccagttgcccaggagttttgacttggaatgatgggttctacaacggcgtggtaaagacgaggaagatatccaactcagcagacctcacggctggtcagctcgtcgtgcagagaagcgagcaactgagggagctttactactctctcctgtccggcgagtgcgaccaccgggcgaggaggcccattgccgcgctatcgccggaagatctcgcagacacagaatggtactacgtcgtctgcatgacctactccttccaacccggccaagggctgccaggcaaaagctatgcaagcaatgcatctgtttggctgcgcaatgctcagtctgcagatagcaaaacatttctacgctcgctattagctaagagcgcgtctattcagacaatcatctgcatccccttcacgagtggcgtgcttgagctggggaccactgatccggttttggaggacccaaagttggtaaaccgaatcgttgcatatttccaggagcttcagtttccgatatgcttagaggtactaatgagcactagcccttctccgaacgaaacggaagatgccgacatcgtgtccgaaggcctcatcactcacaacgccatcgaagaggggcagatggttgtctctgatgagtgcgtgtccaacgccaaccgcgatccaatcaccatggagatcgacgagctctacagcatctacgaggacctggacctggacatggacctggacctggacaccgtgcgctttctcgaggataatggctggcctgtgaaccccagctcttttcaactggtcccggcgtcgtcaacggaggcggtggcggcggcggcggcggctaatgatgtcgacggtgttgcgaattctcaagtgtcgtgcttcatggcttggaagagcgcgaagtcaaacgagatggctgtgccggtcgtcaccggtatagagtcacagaagttgctgaagaaagttgtggactgtggtgcacggatgagcactggtcgtggtagtagagcagcgctaactcaagagagtggcatcaagaaccatgtcatatcagagagaaggcgccgagagaagctcaatgagatgttcctgattctgaagtcaatagtcccctccatccacaaggtggacaaagcatccatccttgaagaaacgattgcctacctcaaagtgttggagaaaagggtgaaagagttggagtccagcagcgagccatcacatcagcgcgcaaccgaaacaggacagcaaaggcgctgtgagatcaccgggaaggagctggtctctgagatcggtgtcagcggcggcggcgatgcagggagagaacaccaccacgtgaatgtcaccgtcacggacaaggtggttctcctggaggtgcagtgccgatggaaggagttggtgatgacacgagtgttcgacgcgatcaagagcctctgtcttgacgttctctccgtgcaggcgtcggcaccggatggtcttcttggactgaagatacaagctaagtttgcttgttctggttcagtggcacctgggatgatcagcgaagctctccagaaagctatcggtggctagcgtcgagagcggcacacgtacgttagatgaatttgaaatgcaagaagcagaagcagaagtgcagaactacaatacgatcctcgtgaaattttatttattatatgctcgctggtccagaaaaatatttgtttcggaagatagcttcaatcacatcctcatgttcatgc

SEQ ID NO: 5657 - DNA, 1893 bp, Oryza sativa
  Predicted polypeptide sequence is orthologous to G585
atggccggcggcgaggcgcatgcggcgctgcaggcggtggcgcagagcctccggtggacctacagcctcctctggcagctctgcccccaccaagggagctcgctggtgtggggggaggggcactacaacggcgccgtcaagacgcggaagtcgacggtgatgcagccgccgccggcggaggaggaggacgacgccgaccacgcggcgcgccaccggagccggcagctgagggagctctacgactggctgcagcaggccggggagaactccagcggcggcgtgcagacgtcgtcgacgacggcgagccggcggccgggggcggctctgtcgccggaggacctgacggagacggagtggttcttcctcatgtcggcatcctactccttccctcccggcatcgggttacctggaagggcatttgcaaggagaggccatgtatggctcactggagcaaatgaagttgacagcaaagtattcctaagagcaattcttgccaagacagttgtgtgcattcctgttgtcgatggcgtcctggaaattggaactacggaaaaggtggaggaagatatgggcctgattcagtatgcaaggggcatcttcatggatcaacatggcatccacatgaagcctaccctctcacagcactcaacatccaacccagtcacccactgtactcatcagcatccaatccaggttcagatgcaactaggtatcaccagccaaacaaagtttgattattcagatgagctcaatgcagatgaggagaatgatgacacagaagaagagggcatgtcaggttcagacactaacaacactgacactgaaaggaattcaggccagctgcaacttcaaatgcaagaccaactgaacatggtgagcaatgaccaccagacaataccaaataatgcagtttccagtgagctaatgcagtgtgagatgtcagaagtggtaagagatggctgctcaaataatattttagaggatgaaatccaaatgctgatggattgccaaaacagtaattgtcagttaaatttgcaagggccagatgagccttgtcactcttggcattttctctgcgaggagttacaaaatgattaccagccagctactgaagatcaagtggcatcacctgaaaatacccattacccaaaaacactcatgacaatcctacattacaacacgctgcgacagcaagagatgaacatcaagaactacttgccagtttcagagaaatcatcattctccagatggactactcctgaaggaagggagcagaaacacctgaatcaaggggcgggaaaggcgcaagtggatgccatccaaggtgatttcagtgccaaccatgtgctgaaagagaggagaagaagagagaagctcaatgagaagttcataattctgcgatctttggtacctttcatgacaaagatggacaaggcgtcgatactaggcgacacgatcgagtacgtgaagcagctaaggaaccgcatacaagagctcgagtcgtcgtcgtcgtcgtcacgagcagccgcccgggcgccatcggcggcggccgccgggaggcggaggaagagatccgccgccgccgccactgccacggcggcggaagggatgagcagcagcaatggccgcaatggcggcgaggcggcggaggtggtgcaggtgtccatcatcgagagcgacgcgctgctggagctccggtgcggttgcggcggcggcggcggcggtgtggtgctgctccgggtgatgcaggcgatgcaggagctccagctggaggtcaccgccgtccaggcctcgtgcgccggtggcgagctgctcgccgagctgcgcgccaaggtcgtcgttatgatcctgatctgcatgaaaatgcaaatgcaaatgcaaatgcagaattaa

SEQ ID NO: 5658 - DNA, 714 bp, Oryza sativa
  Predicted polypeptide sequence is orthologous to G590
catcaatgaacctctccacctcaccccgcgacgcgacgcgacgagccgtacaccgaccgccccgcgccgctgctgccggagccggagagagaagctgaagccgaagcagaggcagccgcagcggcaaaactcaaaagacgtcgtcaaaagctctgccgcgcttgcagctttctcgggctcaaggaaaagccatcacaaaaccagagacacagagagagagagagagaaactgaagaaaggtggcaactcctgcagcagctgcagcagcaagcgctagtgtttgtggtttgctggtgctgtggcgaggcgatgatggatgggcgaggaagccaggaggaggagcacctggatttgatcatgcgacaccacgccagcatggggctggatcgctgcgagagcgaggaggcgctggggtcgtcggagtcggagcagcccaccaggccggcgcggccgcgcggcaagaggagccgcgccgccgaggtgtacaacctctccgagaagaggaggaggagcagaatcaatgagaagatgaaggccctgcagagcctcattcccaactccagcaagacggacaaagcctccatgcttgacgatgccatcgagtacctgaagcagcttcagctccaggtccagatgttgtccatgaggaatggtctatatctgcccccagtgaacttatctggggcacctgagcatctgccgatcccgcaaatg

SEQ ID NO: 5659 - DNA, 536 bp, Oryza sativa
  Predicted polypeptide sequence is orthologous to G590
acgggcaccgcgcgcgccgccggcgcgtcgtcatcgggcgggtcggggagcaggagcgggagctacccgccgttcaagcgggggagggacgagcttgttgacagccttagcaagtttgccgacgaaacccggccgtcgaagcggccggcggcgaagcaccggactcgcgccaccgaggtccataacctgtcggagtgggtaaaacctcaagaacaccaaccaaccattgatggatagatggtgttgcctcatttgcaacaaggtgaatgttacttgattttttctgttcttgctgcagagaagaagggatcggatcaaggtaaaatattttttgcgaaaaattgtgggaaattttgttattctgtttctgaaagggtttttgtctagagcaattatatggtctatgaggtaccaaaaatttagtgtaaaatttggtacctcatagtacttgggtacctaagaggtactaaatttacaatagaaaaaatgatacctcatggtatcttcttaaggactgtaaaaaaaaaaaaaaaatt

SEQ ID NO: 5660 - DNA, 1102 bp, Oryza sativa
  Predicted polypeptide sequence is orthologous to G591, G793
atgagggccctgcaggacttggtccccaacacaaacaagacagacagggcagctatgctagacgaaatccttgattatgtgaagtttcttcggcttcaagtaaaggttctgagtatgagcaggctgggtggtgctggtgcagttgcgcagctggttgctgatattccaatctcagttaagggggaggcaagtgacagtgggagcaaacaacagatttgggaaaagtggtcaaccgatggcacagaaaagcaggtagcgaagctgatggaagaagacatcggagcagcaatgcaattcctccaatccaaagcactatgcatgatgccaatctctcttgcgatggcgatctatgacacacagcattcgcaggacggacactcagtgaagcctgaacccaacactccttcatagtatagtaacaataacactagcatgcacacctactactactaggcgtcgacctatccaaagtgtaggatatactggacattttgatttgctaactggaaaaggcctaaggatcctctcctcaaagtagtacccatggtatatgatgtcgtctcctcttttcttcttttcttcaaaggtgctttgattgcaaagatatggtaagcgatgttctcatgctcctacatctttcaatgcccctatcgagtgtgagtgatgggtagagctaccaaagagtctggcatgcgctcatatcatttccttttgggtctgtagtgcactagccatacactttgtggtggggtcggtcagtcttttggtagtggacgtttggactaatgaaaagaagctgatgtatgtgtgttaagtctgcacaaatggttgacacaatttaaaagaatgttcagatggaagatgatgttgacggtgaatggtggtgctatttcttgtctatttttccaaagcggcaacggatgttttagtcaatggaggcgaagcgtgtattaatctggttgctagtgggagcgtgctccttatgtgctttacttttctgtctgcaagtcatagtcttgataagaacctgccctcttaaagtttttagcctcttgtattattggttcactcatgaaactatatatatcatctgtgctgactt

SEQ ID NO: 5661 - DNA, 1636 bp, Oryza sativa
  Predicted polypeptide sequence is orthologous to G591, G793
atggccgggcagcagccgcagcagcagggcccaccggaggacgactttttcgaccagttcttctccctgaccagctccttccctggcgccgcgccgggcggccgcgccgccggtgaccagcccttctccctcgcgctcagcctcgacgccgccgcggcggccgaggcgtccgggagcgggaagaggctcggggtcggcgatgacgccgagggtggcggcagcaaggcggatcgggagaccgtgcagctcaccggactcttcccgccggtgttcggcggcggcggcgtgcagccgccgaacctccgccccaccccgcctacccaggtgttccacccgcagcagtcgaagcagggcggagcagccgtcgggccgcagccgccggcgccgaggccgaaggtgcgagcgcggcgtgggcaggcgaccgacccccacagcatcgcggagaggctaagaagagagagaatagcagaaaggatgagggccctacaggaattggtccccaatacaaacaagacagatagggcagctatgctagatgagatccttgattatgtgaaattcctgaggctgcaagtaaaggttttaagcatgagcaggctgggtggcgcgggtgctgttgcacagctggttgctgatattccactttcagttaagggggaagcaagcgatagtgggggcaaccaacagatttgggaaaagtggtcaacggatggcacagaaagacaggtagcgaagctgatggaagaagacatcggggcagcgatgcaatttctccaatccaaagcactctgcatgatgccaatctcgctcgccatggcaatctatgacacacaacaaacacaggatggacaaccagtgaagcacgaacccaacactccttcctagtatagtaatagcaactgtaagtctgtaacatgaatcgttacaacccctagtagacatcaacctatcaaagtgtaagataaaacagctcgttttgattcactaacaaggaggcaggaaaagacctaagagatcctctccacttgaagttgtaccaatggtatatgatgtcacctttcgttatcatcttttgttcaaaggtgctttgattgcaaggatatggtaagcaatagcctgctcatcctcctacacctttcaatgcccctatgagcgcgggtgattgagagagctactaaagagtctggcatgctctcacattgtctcttttcgagtctgtagtgcaccaaccatacactttgtggtggggactgcttttttggtagtgggtgtttggactaatcaaaagggattgatgtatgcctgtgtctgcagcctgcacaatggttgacggaatttgaacacaagatgaaatggaagatgattttgatggtgatgttcatttatctccatttttccaaagtggaggcggaggctttggtcaatggaggctgagcgtgcgctaagctgatcgctagtgggtctgctatctacatctacatgcactactgttgtatctattgtgacatactcttgataagaaactgcggtataaagtttaatctttctattggcgattaatccatagaattactttgtattttctgccatgagttctcaactacccacattatttgtgaagaacagctgttcttgt

SEQ ID NO: 5662 - DNA, 663 bp, Oryza sativa
  Predicted polypeptide sequence is orthologous to G592
gacggtttctcatcgagtgctagaccagcaggatcatcactcggtgaggttcgccatggcgccatgagcagcagcagcaacaacaacaagaagatgaaggccccactgagcttcgctagcagcaggcagggctccggcggcctctcccagatatccgaggacggcatcccggacctcactgacagcatccatggcgccgctcatcatcatgggcgctccgaggagaacgtctccacccacgaccacgtcgtccgctccttctcctccggtgggttctcgatcgggtcatgggaggactccaactcatcgtgttctccacgtcgacgggcaaatcaggagcgcacggcaacgacgacatcatcgccacccttacaactacgaatctcagctttgttgcgcccaaggagatggtggcgtagagaaatacctgcagatgcagcacgacccaggtgcattcagagtacggccaagcgtgggatgcgcgacgcacccacggagcatcgcagagagggagaaaagacgaaggatcagcgagaactcagggaagtttgcagcccctggtgccccacatggacaagcaaccaatactttaaacttctgactttaacaggttgatcacattaaggggattgcaaaaccgcttgcaacttttaaaggaaaaca

SEQ ID NO: 5663 - DNA, 2033 bp, Oryza sativa
  Predicted polypeptide sequence is orthologous to G592
ggcatccccccgcaaaagcaatccgccgattaaactaacccaaaaaaaaaagaaaaaaaactactcctcctcctcgcccaaccccgcaaaagcagcggcgacctcgcgaagccaagccaccaccacttcttccttcgctcgctcgcgtattttcttttgcttttttgtgtgctcatttcctcgccgtaaagaagcgaggaggaggaagcgtagcttgagaggctggagagatcgatcgagagagcttagcaacagcagcaaagtgattggagttgagcttgtccgtcttgaaaagtcgctgatcttttcttgtttactttcttctttttatttctttcttgtgttgctgaattgaggttgtgtgggcggccatggcgaggaggcggagataggaggtgggtggttgttgttgttgtttgatttggtgggttgaggtgggagaattggagttttgttggagaagagaggagagaaggggatgtacggctcgccggtttccaaggatctgaacctcccggtgcagccgccggcgatgagctcgtcgggcttgctgcggtacagatcggcgccgagcacgctgctcgccgagttctgcgacgacttcctcccgcccgccgccgcgccccgcgccgccagccccgacgccgacaacgtcttctcccgcttcctcgccgaccaccagatccgtgacaagtctccccccgccaccgccgccgccgccgccgctgccgctcacttccccgacgaccccaccatggccacccagcaccaccaccagcagcagatgatgttccagcaccacccgcagcagatggcctctgtcgaggggctctaccgcaccgtcagctccaccgggattgacgccgccaccgccgccgccaacgccgccggtggcggcggcggcgggctgctccggcagagtagctcgcccgccggattcctcaatcatttgaacatggacaacgggtacgggagcatgctgcgggcgggcatggcggcagccggcggtggggtggggttcaggaacggcgcgaacgccgccgccgcggccgactcccccggcggcagcgggggcaggctgaaggggcagctcagcttctcgtcgcggcagggctcgctcatgtcgcagatctcggagatggacagcgaggagctcggtgggagcagccccgagggcgccggtggcggcggcggcggcggtggccggggttacctctccgggtacccgatgagctccgggtgggaggagtcgtcgctcatgtcggacacgaacatctccggcgtgaagcgccagcgcgactcgtcggagccgtcccagaacggcggcggcggcggcggcctggcgcaccagttcagcctgccgaagacctcgtcggagatggcggccatcgagaagttcctccagttccaggacgcggtgccctgcaagatccgcgccaagcgcggctgcgccacgcacccgcgcagcatcgccgagcgggtgaggaggacaaggatcagcgagcgaatcaggaagctgcaagaactcgtgccaaacatggacaagcaaaccaacactgctgacatgctggatttggctgttgactacatcaaggatcttcagaagcaggtcaagggattaaacgacagccgagctaactgcacctgctcagcgaagcatcagcagtactctggctagaaagctttgtacaagtcatggagacttcagaaaagaacacaagattgttttggagattaggcaggactgagacgatctctgaagatgtgtaatggttaatttcatttgtttgggggggtttaattagagaggcacatggaagaaaaggctcttgtgtgccaaagcactgtataagcaaagggcaatggagcagtggcatcatcaggattcaagtgataaaaagaaaaaggaaaaacaagggagaaaaagggtgggagatgggtgaaacaattgtatagttttcttgtaacttttgccatatatacccctgcatgccccatgtccagtgcattttcgatagaaatttattactgcc

SEQ ID NO: 5664 - DNA, 1921 bp, Oryza sativa
  Predicted polypeptide sequence is orthologous to G592
gactcacctcctccctacctctcgccattattaaatcctctcctctcctctcttctccacatccacaagaaatttcgtagcggaatcacgagccctcgtctcgatcgtagcttgagcttgagctgagttgctggtttggtgtgtggagagatcagtggggtgggtgggggtgggtgatgtacggcgcgccggtgtccaaggacctgagcctgcagccagccggggtgcggacgccgccgcagatgagctcgccgggcttgctgcggtacaggtcagcgccgagcacgctgctcggggaggtctgcggcgacttcgtcctccccggtggtggtggtggtggtgggcagctgcagctgcagctgcagcagcagcggcctgggagcccggaccacgccgcggacaccgtcctcgcgcgcttcctcgccggccatggcggccacgacaacaagcctccccgccccgccgcccacttcgccccaccggaagactccatggcctcgcatcagcagcagctcatgtaccagtcgcatcagcagcagcagcagatggcttccgccatggagggactctaccgcaccgtcagctccggcggcacggagtccaccgccgccgccgccggcaacagcctcctccggcagagcagctcccccgccggcttcctcaaccatcttaccatggacaacggatacgggaatatgctaagagcgggcatgggcggcggcggctggtggcggcgacccgcggctcaaggggcagctcagcttctcgtcgcggcaggggtcggtgatgtcccagatctcggagatgggcagcgaggacgaggagctcgccggcggcggcggcagcccggaggctggcagcaacggcggtggcgccgcacgcggcggctacggcggcgggtacgcgatggggtcctccgcctgggaggagccctcgccgccggcgacgtcgctcctcccggacagcagcctcccgtccaagcgcccccgcgacgacctgccgcggcagctcagcctcccggcggcgtccaagaacagcagcaagcccccctcctccgcctccgccgccgcgtcgccggagatggccgccatcgagaagttcctccagttccaggacgccgtcccctgcaagatccgcgccaagcgcggctgcgccacccacccccgcagcatcgccgagcgggtgaggaggacgcggatcagcgagcggatacggaagctgcaggagctcgtccccaacatggaaaagcaaaccaacactgctgacatgttggatcttgccgtggactacatcaaggagctccagaagcaggtcaaggtgttaaacgacagccgttccagctgcacctgctcggcgagcaagcagaagcacttcgccggctaaatcaatcaagtcaatcaatcgccatgaccggtgcagcagtgcgcaacacacgaacggccgcaaaaggcatgcagcagaagcatctgcaccggcagtttttctaagcttcgtttccttctttgttgatgaattcgctggtctatctggtaaattgaacatgagggcattggattttggagcagtggcatgcattcttcagagttcacaaagatgatgggttggggtcccacatggtagtggtagactactgtagctgcaaagcttgattaattaattagcctgttcttttgataatgaaggagaggagagtaactcacaagtgtatagatggttgtctcatctctgtttgtcatagtacacaccaagtgcaagttgcagctgtgtctgcttgcaagaatgcatgcccatgtacattgcatccccctttgcttgacaaatgacacatccagacagcctccatatcctgtttcctctcgttgctacaccctgtttttgtgaagtacatgcatcgcaacaatgttcacgaataatcctggtc

SEQ ID NO: 5665 - DNA, 900 bp, Oryza sativa
  Predicted polypeptide sequence is orthologous to G594
atgcctactccccattccccagcgttagggttccaggccgcgacttctccgggccagtggaacgaagttgccgcatcaatcgacaaggttgttgagatgagagcagcagcgccaccagcggacccaaccgtggtgatggcttcgtcgtcgccggagaagaagcatccacctggttgtggctctcgggactcccagcccatcgcttgcacggacgatccccccttgtctgaatccccaacgacggacctaggctgccacgatccgcgcgaggaggacgccgaccacccggcaccacccatgggcagagaggccggagatataaatcattttaattatctggaaaattcagattcagacgacatctttgcctcaaccaactcagacaatatgaatatgttgatcggtgacatcgacgaggatagtgatgatgatggttacgtagacgaggagacaacttgcccagggcagaacttcacgaaggagcaggaaaaggaaataatgcgcaagtggctggaaacatacgacaagaagaatagagaattcatggtggcgtgcgaggagttccaaaagcagggaggagatgagacgagtgcttctcgtccggtatttccttttaaaccgctccccgagacaacagatttttgtatcaccaagagtttatgctatcaccgtgaatacaagaccaatgatacttctgagactgcatccactattgggtggcgtgaacccaaggagatgctccagatcttctcaaagaagttgtccagctccatgtcctatcctattagtgtttacggaatctttgcagtacgtgattacttggaccctttgcggaattatgtcttcaaccgtaccagagatgatcctgtcatagttgaacagtgctacattttggtataa

SEQ ID NO: 5666 - DNA, 483 bp, Oryza sativa
  Predicted polypeptide sequence is orthologous to G594
atggcgccgaccaccaaaggcagaggggcctgtggagcggaggagggggctgagttagtggaggagttcaagtttggagaacatggagagagagagtcaactgttgttgccaatgctgcctcttgccgaatagaggaagaaggaaaaaaagggagggagaaggcaagatcatatagaaacgaggctcatatggagggaaaatggaagaatcagcaaagaaagaaaatcaaatgtggagagcctcatatggagggcgattttctgccaagcgtgaccatcatcatcatggatggtggtcgcagagcagtgccaggccagtccaccgtgccaaggcatcggcccaggcatgacccaactatcgggccgggccagcacaggcccgacaccagtcgtgccatgccgtgcttgagccgggccaaatggccgtgccatgggtcaggccatcaggcctcggaccatatggctatctataccaatgattaa

SEQ ID NO: 5667 - DNA, 2184 bp, Oryza sativa
  Predicted polypeptide sequence is orthologous to G597
ggcttcacctcacctgctcattttttatttcccaaattataaaaccttttcttttttgttccccaaagattacgtgctagtaggggcgttaagaaaaaggaaaagaaagagaaggaaaaaaaaaacggagagagaaaaattggagaggcgggcgagttaggggaatttacgtaggagacaagcgaaatccctaaattttctctcctctcctcgcgagttgttttgagtgagtttctgcgagtgctcttgagcttccatctttccgcataaggctttgcaagctttgctctagccttttttttttgttcagattattttcttgcggtttgttcttaagtactcgctagtgtccctaatttcctggtaatttcttggtaatttttggctgcttactttgctcgagctgggatctgtgtttcagtgctcacttgctaaatccgaaccaaattaaaccttggattttaaaactccttccagctatttttccgtttttatttgggaaattgtgggtttaccatttcttcctccgattttcttttccattttctcccctcatttgagcttccttctcacccattccaagaaatcaccatccttccgctgtaaaatcgttgaaaaaaaaattgttccacagctttgagcagcgcggggtttatggtggtttttgcagctctcgtcttcttcctcagctcgccttgaaatttcggtccaagaaatcactgagctgagtgagctgctgagctgagcttctgcgagagaaggtgtgggaatgatggaggtgactcaggtgagggcgtcgtcggagatggcgggaggaagggagccgttcgtgctgcccaagagcccgccggcggcggcgcctgcgccgccgccgccgtcgtccggcggcatgcagagcgtgcgcatggcgtacacggcggacggcacgcccatcttcgctccggtgaactccgccccggccccggccccggcggcgacgtacccgcccgcaggaggcaatggcgcggcggctctcgacgccggcgagccggtggtcaagaagaagcgtggccggccaaggaagtacggccccgacggctccatgtcgctggcattggtgcccgtgtccaccgcggcggtggcggcctccgggcctttctcgccggcggctgccgcgaagtcgccggacgccgtgtcgtcggcgccgccgccgggggcgaagaagagggggcggccaaagggctccacgaacaagaagcacgtgccctctttcggaattggagatatcgggtcagcaggagctggattcacacctcatgttatttttgttaaagctggagaggatgtatctgcaaagatcatgtcattctcccagcatggaactcgtggagtatgcgttctgtcagcaaacggcgccatatcaaatgtgacacttcggcaagctgctacttccggtggaacagtaacatacgagggacgatttgagatactgtcgctgtccggttcattccttctatcagagaatggaggccatcgtagtcgaactggtgggctcagtgtttctctagcaggccctgatggtcgcgtcttgggtggtggagttgctggacttctgacagctgcttcaccagtgcagattgtggtgggaagcttcaacaccgaagggaaaaaggggccaaagctgcaagctccttcagacccaatgtctgcaccgctaaagatggtgccgatgagcgggacggggccaagcagcccgccatcaaggggcacattgagtgaatcatcgggcggcccggggagcccgctgaaccaaggtgtcacggccagcaaccatggccagccagggctacccagcttatcctggaagtgagctcctcctcctcatcatcatcagtgaccagaccttggtcccgtctgaccgccgtagaacttgcgaaaggaaatgtcgtggcggtggtactcgaggtactccggtgcgacgccatggatcctaactagcccccctatctagtgtaatgtctgaacctgaatcagggaagaaaactgtagccgttgcatctctagctagctcttctggtgtaggtgctgttactattggagactagactcaatgtgttatttaggtggttaaattgtttttttatcttccagacaccgatgaaaaagctcattgcttctatgtaactatgttggcatgttgcggtt

SEQ ID NO: 5668 - DNA, 1794 bp, Oryza sativa
  Predicted polypeptide sequence is orthologous to G597
gtcgcctcgccacctccccccctgttttctccatttctcctcccaatttttttctccgcatccgcagaaattctgtcccctcctcctcctcctccatttccgatgtattttattcgatttcgagatttgttttccggtgcatagagctcacgtacaaccgccgcgccgaacggtgcatgtgaactgttcggcgaaacgcgcaggtgaggagaggtcgcgaggagcggctgctgcggcggcggcggcggcttcgattcaggtgggggtgggtgccctagggtttcgctgccgggatggatggccgggagcagcagcagcagccgcgcgtgagctcgccgccgccggccggcggcggcgtgatgatgcctcagcacccctacggcgccgcgccggcgatgccgccggggtcggcgaatgttatgcacggggtgccgctctcgttcaaccccatggcgtcgccgaccgcctcgtcgcctatgaagcccgcggatatgtcggggaccatgtaccgcaccgatcccgtcgtgcagggcatgcagcagcagcccggttccggcggtggcggcacggcggtcggcggaggggagctcgtgaagaagaagagggggaggccgaggaagtatggtcctgacgggaacatcgggttgggactgaagcccgcggctgcagcagggacggaggccggcggaccttcaggtggtgcaggatcgaactcgaaccctgacgggaagcgcagagggcgacccccaggatccgggaaaaaaaaacagctagatgctttgggatcttccgggacatcttttactccccacataataacagtgaagcctaatgaggatgttgcttcaaaaataatggcattttcacaacaaggccctcgcactacatgcataatttcagcaaatggcgctctttgcacagcaacactacgtcaaccagcaacttctggtggtatagtaacatatgagggccactttgatattctctctctgtcgggctcatttctgctcgcagaggatggcgacactcgtagcagaacaggtggtttgagtgtggcacttgctggaagcgatggacgtatagttggaggttgtgttgctggaatgctgatggcagcaacgcccgtgcaggttgtagtggggagtttcattgctgaaggtaaaaaaggcaaggaagaacatctgaaacgtgagccaacatctgccccgacgccgaaccacgcagctggctttggcgcagccacggctgccagtcctccgtctgatggatcatcaagcgaccactccgatgacccagggagtcccatgggacctaatggcagcacattcaataattcaggtcatcccatgcattcttcgtatgctcctgttagctggtcgctatctgggaatcaaggccgttacgatcccgacctgaagatgatgaccgactagataatcctgtgtttttaagctctgttagctgttgacccagtagagtgtagggatcagggattcagtgtttcctgcaccgacaccaccggcagcgttggccaataatccggtgcgctagtagtaatcagtatcacaatgcctgaacaaaagagatcaggaacaaataagtagccccagcgcatggcttggcctgtcaggtagctaatttttatttttctcaatcggtagcttatttagcatgctttgtcagttgtcagcctagttgtacggttttcttatgaatgtttgtacacctttttcttttctcgctagtattcggcgtgtacgaatcttaattaagattggaatgacatgttattgg

SEQ ID NO: 5669 - DNA, 1526 bp, Oryza sativa
  Predicted polypeptide sequence is orthologous to G597
gtagtgctttacttaccagctgcctgttttttcttctctttccttgaaaaaaaaaaccatctttatttttgttaattagggaaaagaaagagtgcatgtgaagtcaggagtaggagaggttggaaaaaaatagggggaaaaaaaggagatatatattgatgaaggatagttgagatataagcaagaatttgtgagaggctagtaggttcccaaatccctagccctaatctcctcacgtgctcgtgagctctcatcggtggatacgaatttccgcggctttgtgttagagtttttggtgatacaagaagaagcgcgggcggccgaggaagtacggccccgacgggtccatgtcgctggggttggtgacctcgccgacggccgccgcgtcgacgccggtggcgcagggcgtcccagggccgttctcgccgacgcagccgaagccgccggcgagcttcttgtcgtcggggtggccggacggggtgaagaagcgtggccggcccaagggttctaccaacaagccgcgcatcgacgccgtcggatcggcgggagttggatttacaccacacgttattacagttctagctggagaggatgtgtctgcaaagattatgtcgtttgctcagcatggaaatcgtgcggtttgtgttctttcagcaaatggtgccatatcaaatgtaacacttcgccaaactgctacttcaggtggaacagtaacatatgagggccgattcgagatactatcgctgtctggctctttccttctaaccgaccatggaggccagcgtagtcgaactgggggactcagtgtttcactggctggtcctgatggtcgtctgttgggaggcggtgttgccggacttctcatagcagctactccagtccagattgtggttggaagcttcaattctgaagggaaaaaggagccaaagcagcatgctcattcagaacccgcatccgcgccatcgaaagccgtgccgacggccgggatgggacccaacagcccaccttcaagaggcacattgagtgaatcctcaggtggagctggaagcccattgcatccaggcattgctcctcccagcagcaacagccagccgccattcttgtctagcatgccatggaaatgaaatgagaccttttcatccttcaccaaacctggactctgaatctctgatagactttgtcgatgaactgcatcttctgccagaaagtagtagcaaccgttgccacacgttttctctaactagctcctatgatgtagtgtaaatctgaagtttaattaggggagaatttgtagctggtaagtgtagctgtcgtgtaggtttcaccctggatttattatgtattaggtaggtagtggtatcttgagagacatatgatcatgttatcctaatgtcctatatgcaatgttatcaaagattattgttattattatggcctctagttacatcaaattttctcatgggttcatgcatttcaatggatgaaaaaaaaaagaaatagaaaaaggcttgcctagaatgaattgc

SEQ ID NO: 5670 - DNA, 1602 bp, Oryza sativa
  Predicted polypeptide sequence is orthologous to G597
cctccacctttgccctcctgcattttgcttgcaaaggataggagttgcagtactagtattgctctctcattgcatgtgaagctagcaagcaagcaagcaagagagagattctaggtgagtggtgtttggtgtgaagggaaggagcatggtgatggtggcatggctgatctgctgctaatagcaaggagtagtagtaataataatactactagtcactcatcatccttctccctcccttgagcttagctatagagtggagaagaaagaaaggagagtagtcaaagcgactctttctttgttttcttgcgcttcctcctcggctgagctcagcagcaagcaaacctgctcctgctacagcagcgagcgagcgctagatctgaccaaatggaggccaaggacgtctcgccgctcgtcaccgtcccgcccgcgcccgccgccgccgcgccgccacctgcggcagcgcccgcgccgccgccgtcccagccgccgccgccgccgctgccgttcgcgcagcaggcgccgccgccggccgccaaccccgcggcggcgcccatgcggctgtcgttcgaccagatggcagggaaggcgcccgggggggagcagcagcaccaccaccacccggggcccatgctgtacgcggcggcgcccgcgggcggcgccgcgccgccgccgcagggcggcaatgtgatgggcatgggcgagctgatgcgcaagaagcgcggccgcccgcgcaagtacgcgcccgacgggagcatggcgctcgcgctcgcccccatctcctccgcctccggcggcgccgcgccgccgcctccgccgccagggcaccagccgcacggcttctccatcagcagcccggcgtcggatccgaacgccaagcgccgcggccggccacccggctccggcaagaagaagcagttcgaagccctaggctcatggggcatcgccttcactcctcacatcctcaccgtcaaggccggcgaggatgttgcttcaaaaattatggccttctcacagcaaggccctcgcacagtttgcattctctcagcgaatggtgcaataagcaatgtaacacttcggcagccagctacatctggtggacttgtgacttatgagggccgatttgagatcatctctctatcaggttctttcctgcttgcagaggatggcgacactcgcagcaggactggtggcctgagtgtcgcacttgcaggatctgatggccgagttcttggtggatgtgtagctggaatgctgatggccgcaacccctgtccaggttgtcgtggctagcttcatcgcggaaggtaagaaatcgaagccagtcgagacaaggaaggtcgaaccgatgtcagcgcctccacagatggcaacctacgtgccagctccggtggcgagcccgccatcggagggcacatccagtggatcgtccgatgactcgggcagcccgatcaaccacagcgggatgccgtacaaccactccgggcagcagcagcaacaccagcagcaccagcacatgccccctgcttacgcatccggtggctggtcgctctcagctcatcatcagaacaggcacgactctgacatgaagatgatgtcgaactaa

SEQ ID NO: 5671 - DNA, 1597 bp, Oryza sativa
  Predicted polypeptide sequence is orthologous to G597
gtattgtgcgcggagggggtagctgggcgaggtcttggggggtgatttttgcggagaaattctgttgttgttggatgcaaggaggggccatgtcggcggcggcgacggcgacggcgagcgaggcggcggcgtacggcggcgtgggcatgagcaagagcggggccctgcagcctcagccgccgcacggcgccgccgccgcggtgcgcctcgcctacacccacgacggcatcgcggtgtacaagcacacgccgccgccgccggtgtaccagacgccggccgccgtcgccgccccgtcgccgcccgtccgcggcaatggcggtgcgcccgcgtccgccgagcagcacaagcgcaagcgcggccgaccgcgcaagtacgccgtcacggacgtgccgctcgccgtcgtgccaccctcgccgcgaaaggctgcggccgccgccggcgccagcgccgcccagtctccggcgacgcccacgctgccgccgggcttctcgtcgggcctggccgcgtacggaggcgccgcggcgagccagccggcgccacgtcaggctccgccggcatccgggcgcgtgctacctcacaagaagaggggccggccgccgggctccggcaacaaacagcagcagcggcctcagcacaagaaggcagcagctccaggatctagtgtgattggattgaagcctagcgtcatcacagtgcaagttggagagggtgtagtgtccagggtgatgtcctttactaagaatggatgggctgtttgtgttctcccagctaatggtgctgtatccaacatgacactgcgtcaagcaggttcttctggtgcaacaacagtaaattatgagggccattttgagattctttctttgtctggctcatatctgctgtcagaaagtgttggcctgagcagtcgagctgggggacttagtgtttcacttgctggtcctgacggacgtgttttaggtggcggagtagcaggacctctgaatgcagctacacctgttcaggtggtcattggaagctttctggctgatgtgaagaaggggcacaaacaggccatgccgagtggggctccgtatccaggtgtgagcactccaacatccagagggactcccagtggatcctcaggtgggcctggtagccccctaaaccaaagtgcaagtggctcatttaacaccagcaaccaacaagccttggctgacttcccatggagatgagcttggtggttctgatgatctttcagccttcagctaaagtcattggtggttctgatgaggggattggggtttgtagctattgggcctcaagaggtaaacataatttggtggtttcggctgtcgcttcgtttattagacaggttgttatctctcaagtttaggtgctgaaaatgtcagctcttagtttaggtgctcctagacacctagtgttcagagaaatcagcttgaaaggaaaagctgagaaaaaaatttgttggcttcaatgcacccctggatgtcatgtggttaagttaccatgtcgaaatgtgtggtgctgttttaaggtacacctgttcttattactctttgtttagtgagggaatgctgcatggttgcttatgcacacg

SEQ ID NO: 5672 - DNA, 1234 bp, Oryza sativa
  Predicted polypeptide sequence is orthologous to G598
gcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctc

SEQ ID NO: 5673 - DNA, 982 bp, Oryza sativa
  Predicted polypeptide sequence is orthologous to G598
ggcttccactcttctcctccacctccaagtactccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 5674 - DNA, 1528 bp, Oryza sativa
  Predicted polypeptide sequence is orthologous to G598
gaccactcaccaccacagctcagctcggagaagcgaagaggaggaagaagagcaagacgccgatggttacgcgtgtgtgctagtggctgagcactagctgcggcggcggcggcgacggcgacgacgacctcacccacggcggcgacacatgttgagtgaacaaacggcggctagtggtagcagcagcagcagccgcggcgccgacgaccgggagattgtcatcagcaccggccgggagatcgtcgtcagaagcagcgggggtgaggagagggaggaggaggtggtggtggaggaggagctcgaggagccggagttcagggacatccacgcgctgagcccgccgccgacgccgacgccgagccagccgtcgtcgtcgtaccaccggcggaggagggagtcgtgggagtccgcggcggggagcaggcacacgtcgatccgctccgtggggagcgacaccgccccaagtgagctcttccctactatgagcagggagttctcggccatggtcgccgcagcagccaacgccaacgccgccgccgccgcagccgcgaacggcggcgactccagccgcgccggggtggacgacgcgctggggaggatcggggaggatgagctcgaggagacgaacccgctcgccatcgtcccggacagcaaccccatcccgtcccctcgccgcgcccacctcgcgctccccgcccccggcgacgtgtcgtcggcgggcggcggccacggcgacgaggtgtcggtggggcaggtggagaagtaggaggtggagtccaagatcgccgcgtggcagatcgccgaggtcgccaaggtcaacaaccgcttcaagcgcgaggaggtcgtcatcaatggctgggagggcgaccaggtcgagaaggccaacgcctggctcaagaagtacgagaggaagctggaggagaagagggccaaggcgatggagaaggcgcagaacgaggtggcgaaggcgcggcggaaggcggaggagaagcgggcgtcggcggaggcgaagaggggcaccaaggtggcgcgcgtgctggagctcgccaacttcatgagggccgtggggagggcgccatccaagcgctccttcttctgagcgaccgcgccaccctcttcccctcctcctcctcctctctgctttgctcgccgccgtcgccgtcgtcgtcgtcgccggcgccggcggctgatcgttcaccgcttcgcttcacacgcagggatcagtgctgtgatgtggttgctgtgtggaactctcgttttagtgttgtatccacatgtatgatgtactgtcatcatatcctctcttttttttctttttttcttgttctctttactttcttgtgcttgataagggtattgcaaagttgggagggacagacagaacaagtaaatagcataagttggatggtgctctgccccttatagcttatggtgagggggacaagagctgcctgtaatttgttttttgtcatcatcaaggattgtgtatgtcaatatgaacaagatatggagctacctgttttgtgtt

SEQ ID NO: 5675 - DNA, 982 bp, Oryza sativa
  Predicted polypeptide sequence is orthologous to G598
tgcttccactcttctcctccacctccaagaaccccgcatccatccatggccaccaccgccctctgatccgatcgatactgatcagccagtagctatgctgggttcggaccagctcgagcaccgcccggcgccgtcggctccccgcgccgagccggacgatgtcgccgacgacgtggaggtggaggcgttccgggacatccacccggagccgtcgcctccgcatctaccgccgccgccgctcaggcagccgtcgtgggacgccgcgagccaccgctcgctgtcgtcctccggcgcgggcggcggcggcgacgtcgagctgttcgccaccatgagccgcgagttcaccgccatggtggcggccgggtcgtcgtccgcgcccagccccgacgttcccggcgacgcccccgccgccgccgacctgaacctgctgcagctggcgcgcatcggcgagaacgagccggcggccgaggcgaacgcgctcgccatcgtgccggcggcggcgggcagcggcccgccggcgccggtggagcaggtgaagaaggaggaggtggaggcgaaggtggcggcgtggcaggcggaggaggtggccaagatcaacaacaagttcaagcgcgaggaggtcgtcatcaatggctgggagagccagcaagtcgacaaggccaccgcctggctcgccaagatcgagaggaagctggaggaggagcgggcgaaggcgacggagaaggctcgcaacgaggcggcggcggcgcggcggaaggcggaggagcggcgggcgtcggcggaggcgcggcgcgggaggaagacggcagaggtgctcgaccgtgccaacttctgcaaggccgccggcagggtgccatccaagcgctccttcttctccttctaaagttctaaccaaagctagctagccttgctcaattatatcatctctagctagctaattatgattattacttgttttctacttaattgatcaatcaatttc

SEQ ID NO: 5676 - DNA, 1287 bp, Oryza sativa
  Predicted polypeptide sequence is orthologous to G598
cgcaccacctcagctcgccagcagcaaccacggcggcgcttcggatgcacggcggcggagcctccacgacgaccaccgccatcgccgccgcgcgggtagcacatgttgcatgagcagcacgcgccgccgccgcagccggagccggaggtttcgctacagctgtcggcgcccgccaccgccgccgacgatgtcgctgcaggcgacgacgaggaggtcaccgtcgtcaccacgtaccgcgacatccaccctctgacgccgccgtcgccgacgacgacgacgacgccacccacgcggctcgggtccgccgcgtactcgtgggacacggccagcagccaccggtccgtgtcgtccgaggagcagttcatgacgatgagccgggagttcacggccatggtcgccgccgggacgaccatgcagactggccccaacgacggcaacaacggcggtgaccagctcaccagcatcggcgaggacgagctggaggagaccaacccgctggcaattgtgccggacagccacccgatcgccacgccggccaggagcagggcgtcccagctggaggttgtccccgcggcagggccatcgccggcgccgccggtggaggcgaggcaggtgaagaaggaggaggtggagacgaaggtgtcggcgtggcagacggcggaggtggccaagatcaacaaccggttcaagagggaggaggttgtcatcaacgggtgggagaccgagcaggtcgagaaagcatccgcatggctcaagaagatcgagagaaagctggacgagcagcgcgccaaggcgctggagaggacgcagaacgacatcgcgaaggcgcggcgcaaggcggaggagaagagggcgtcggcggaggcgaagagaggcctcaagctcgccaaggtgctcgagctcgccaacttcatgaaggctgttgggagggtgcctaccaagcgatccttcttctagcttcctgcagccagcctctgcaaaccttcgatcttgatcgatctgctgctgctctgtttctttcagtgccttttgtgtgctggattaatctagctgccgttcttcgtgtgatgtttgcttagctgtgcgcatccgagaacctaattgtaaaaaagattttaaaacaagttgtatatttgctgttgctgctgttgccctctgctgcttgtgatcacagagtggcccttgtttttcccctggcttgtattatccatacggcataaatggtttgtttgctcaaatcttgcaaacattcagttcgacactagtactagcacttcatttttcttc

SEQ ID NO: 5677 - DNA, 2308 bp, Oryza sativa
  Predicted polypeptide sequence is orthologous to G600, G2768
atcgccatcaccacccaccctcacgcataccatcgtgccatcaagaacaactcgttttccatcgagcccggctcagtaagtcagacacctgccggtaaccgcaccgcgcgcgcacccgcgagcaagcaacgagggcgagacatagggagcatcaggaggcgctgggagcacgtgcagaaagaaagacaagaagaagaagaaagacgaggtcgagacaggcgctggggagcagtagttggccgcgcagactgacccacagattgtccctattgtcccagacagagactcctgaattgaaaagacgagccttgtttcttgcaggcatttgagacttccgtgcgcttttggctgcctcctcaatacaaaggcctcagagctctcgctgtacattacttgctctcccccgtataatattatccctacttgcactgaggatatctgaacccgcgcgcactctgattacacataccacgacaatcaccgctcagctcatcttggcagctgaaccacaggacatctgaggacgtaaggcagaccggttcttcggtgtactttctcgccagaacagccgccaccctcgccgcacaacaatgtcttcctctattttcttcaagttcaagtcgcagaaagaaccctctcagataacatttgatggcaccagtctgtctgtgtttgaagtgaagcgcgacattatcgccctctccaagctcggtgatggcaccgactttgatcttgaaatcaacacctccgacacaaatgaacgctacgacgatgacacagttcagatccctcggtcgaccaccgttatcgcccgccgattgcccgcgaccaaaccaggtgccggtagagccgcacgctacgtctccggcaagatgcctgtgaacgctaagaagcctgaggctgtggacgagaatggcaaaatcgatgtctctcaattgccggccggtgccatgtacacagctaatggcgagtgggtcattgcaaagccagacgaggcttcgtgggacaaatttcagcagacacaaaaggtagcggctgatcaagccaaagaactcgaagcagacaaagaagtcatgcgtgctcgtggtcttgaatgctctttagatcataagatgttctccgatcctgtcaagacgccttgctgtggtcagatctactgccgcacttgcatcgaaaatgcattgatcgattctgacttcgtgtgtccgaattgtggcgaacagtgtctgcttgagagtcttgaatctgacgtcgagactttggataaggtgaaagctttccaagaggaaatgaaatctgaaaagcaaaagaagcaagccgaagaggcgaacaagaagagcccatctgctgcgcctaactctcctggcaagtcgccccaaccttcagactcgcgccctggttctgccaacggcaagaaacgtgctgccgacgaggaacttgagaacacccacaagcctaccggacccgccgagatgaagcgagctggatcaaaggaggccactcctgttcagcctgcccagcccaacgcagccaaaaacaacgcggcacctgtcatgcccatggcgaacaacttgcaggatttcgccatgcagatggacatgatgtctcgtatgtccggcatgcctggaatgcctccaggtggcatgatgaatcccatgatgatgggcatgaatccgatgatgatgggcggacccggcgccggcggcatgaacccgatgatgaacccgatgatgggtcaaatgggtatgggcggcatgaacggcatgaacggcatgaacggcaacatgaacggaggcttcggctttggtcctcagggacagcaaggcttcggaggccacaacggtggtggaccgcccgcaggcccgagagcttggcagcagcaacagaatcagcaccaccagcaacagcaatggggcatgcacaacggccagaacggcgcgcctcaagggcccgcggccaacggcgcctacttccgccagccagtcaacccgggcagggctcagaacagaggtcgcggacaaaggagcgtggactacaagcagcttggccagtgatgaagatattggtgggcatcagcatggtgagagatttcaagcatgggcttgctggaagccggcagcatgggaggatgttttagcgatggcgttggtggtttgctgatcccatgatggattggctgtgttttgcatcttgcagcggaggactcatgatgtcgttgaatatgcatgggacttttgcttttagtggtccaggactgttctttatcttaaccctactctcgtatacaaccacaataaatcatccaaac

SEQ ID NO: 5678 - DNA, 1555 bp, Oryza sativa
  Predicted polypeptide sequence is orthologous to G600, G2768
gttcgatctcacaatcactgctgctgcaccattcgtccattcctttcctcctccgttctccgacgatcgctgctgcacaattcctttcctcctccgttctccgacgatccagctcgaggaacgatccatggcggtgttctacaggtacaggagcggggtggacaccttctccgtgcccatgcaggagccttccgtctccgtcgccgagctcaagcgcctcatcatggccaccgcgcgccacggccattgacgttcgcgcggccgcggccccagggagagcgtcgcgctgtacagcgacaacaccggcgaggagtacgcggacgaggccgagctgatcccgagcggctgcacggtcgtcgtgcggcgccgagtcgcggggccacctgcagagacgatcgtcgagttgacaacaaagaagccaatgtcgcagggcggtggtggttcttcgtcggactctggagcgacgtcgacgggagctgaagtcgacgacgaggagaaagctatcagcgccgtgatcgacgccgcacagctcaagtgggaggccccgacgtcacaaggaggccactgttacggtcaccgcggcgcacacgcgggcagggcgccgccggccgggtacgtgtgccaccggtgccgcgtcccgggacacttcatccagcactgccccaccaacggcgatccaagattcgacatcccgagggtggcgccaactccagcgtcctcaccggcgccggctgagtccggggaatctggcggcgtcatcccggcggagctctactgcaagatttgccggaacgtgatggccaacgcggtgctggcgagcaagtgctgcttcgacagcttctgcgacaggtgcatccgggaccacatcgccgccaagtccaggtgcgcgtgcggggcgcaggcgcgcgccggcgacctgatccccaacacgacgctccgcaccaccatcgccaacctgctcgccaccaccaccggcgccgcagcaagcgcctcaagtggaaccgacaagacgaggagctccgccggcagcaacgcgccacagccggcggcgccgcagagcccggccgcttcgcaggcgagccgcagcaacgtgtcttccaagaagagcgccacgatctcatcgggtgtcctcggaccaagaaaggcgcgggagatggtggtgccgggcgaccactcagcacaatccggggctctcgccgtcgacggcgatcgccacggcagctacggcttcccgttcggcccggcgccaggctacgtcgaccccttcttcgccgtcggcgtgccattcggagccgatccttacatgtactacggcggcgcgccttacggctgtggcggcgctgcttacggctactacggcggcgaggatcgccgtgacacgaagaggacgcgcctgcgatgatcgcacgtcaccggtcaattgttgcctgctggctgcgctcaacgctagcttggagatattttcttctctcctttttgtgttctccgatgattcggaagacaagtagcgagtcaaaacatgtatgattcttgtatagttgtatgtgtaaatgct

SEQ ID NO: 5679 - DNA, 1621 bp, Oryza sativa
  Predicted polypeptide sequence is orthologous to G600, G2768
ttaaagcatcagttttccgctcaatttaagggcgaaggcaaaattttttgttatttactgctgttctctatcgaataatctgctctattacagaagaagagggggggggggaaaagccaacaaaaaaaatagaaagaaaaacaaaaaaaataaaaagataaattcagaagaaaagaaaaaaaaactgagtgggcattatggctgtatattacaagttcaagagtgccagagattatgactcgattccgatcgaggggcaattcatctcggttgccaacctgaaggagcggatttttgagtccaagcatcttgggagaggcacagattttgacctcatgatttcaaatgcgcagaccgacgaagaatatgctgatgaagctactatgataccaaagaacacatcggtgttgattcgtcggataccaggaagaccaaggaagcctattgtaacagaaccagaagagacaaaagccatggaaggtagggtagaagaaaccatgccttctggtagtgcttttcttgctgatgcatctatgaaatatcctgaagaatctgagtgggatgacgagtttggcaatgatttatatgtttctgattcagtcccttcacagctcggtagccaggcggttgatgcatctgaaaataaagttgatgaagatagtaaaataaaagcacttattgatacatctgcactcgactatagtcaaattcctgatgggtatggtggtggaagaggctatggaagagggatgggtggaagaatgatgggtggtcgtggttttggacgtggtggtctggaacgtaggacacctcctgcaggctatgcctgtcatagatgtaaagtgcctggtcatttcattcaacattgcccaacaaatggtgatgctagatttgacatgaaaaggatgaaacctccaactggcattccaaaatctatgttgatggcaaccccagatggctcatatgcactaccaagtggggctggtgctgtcttgaagccaaatgaagctgcttttgagaaggagatagagggattacccacaacccgctcacttggtgatcttccaccagagttacgttgcccattgtgtaaagaagtaatgaaggatgctgttctaactagtaaatgctgctttaggagtttctgtgataaatgcattagggactacattataaacaagtcaatgtgtgtctgtggtgccacaagcatattagcagacgatcttctccccaataaaactctaagagaaaccatcagccggatattagaggcaccaccaactagcagtacagaaaatgtgggaagcatggtgcaagtacaggatatggagtcagctattcctgtacagcccaaggttaggtctccagctgtttctgctgcttcaaaggaagaaccaaaaagaacacctgcacctgtagaagagtctccagatgttgagagccatagcgaagtgaaaactacaaatgttgatatgagttcttcagataagaaggtccccgcattaccagatgttgttgaaggaaccatggagtctaaaattctgaaagaaaaaacaccagaagcaacacctgttgtgaaagagtcacaggaaaaaatgcctgttgtgggcgaacaagtcgt

SEQ ID NO: 5680 - DNA, 678 bp, Oryza sativa
  Predicted polypeptide sequence is orthologous to G600, G2768
atgagtgccgaatggaggacgccgtccgggggatctagcggcgtcatctcatcggaactctactgcaagatttgccgaaacgtgatggccgacgcggtgctggcgagcaagtgctgcttcgacagcttctgcgactggtgcatccgggaccacatcgccgccaagtccaagtgcgcgtgcggggcgcaggcgtgcgtcgacgacctgatccccaacccaacgctccgcaccaccatcgccaacgttctcgccaccaccagcggcacagcgagcgtttcaagtggaaccgagaagccaaggagctccgccagcagcaacgcgacagaggcggcgccgcagagcctggccgcttcgcaggtgagccgcagtaacgtgtcttccaagaaaagcgccacgatctcatcaggtgtcctcggaccaagaaaggcgtgggagacggtggcgggtgaccactccacagaatatggagccctcgccgtcgacggcgatcaccacggcagctatggcttcccgttcggcccggcgccaggctacgtcgaccccttcttcggcgtcggcgtgccattcggagctgatccttacatgtactacggcgtgccttacggctgttgtggtgctgcttacggctactacggcgacgaggatcgccgtgacacgaagaggacgcgcctacgatga

SEQ ID NO: 5681 - DNA, 3201 bp, Oryza sativa
  Predicted polypeptide sequence is orthologous to G600, G2768
atgacaaagacgcagccgcaactagtggagtcggagccggtgaagaagctccaacgcttgccaccagtgtttagtcgtgtgttggagcttccattcccaagggataccaatgttcgtaagctctttaccaccaacgctgacctcttttttgtgccacatggtgtcggtggtgaacctgatgttgttaaggtacacattgtgagactcgagcgctgggatatgactagggtggtggtgcacattggacctggggagccagacttaaggaatgatctagtctatgacaagtggcgcttccccctagctgagacatccattctatcgatggttatggcagggatggatgcaagcggtgatggtgggaatgaggggatcccaatgtggcccaacattgataaaagaggaggaggaggaggaggaggcggcggattcgggcttcttgctggtgcaagctacattcctaccaagttttcaaggcctcgaaattctcagaaagttgaaaagtgtgtgttggataaggtgaaagcctctaagttcaagagtgccagagattatgactcgattccgatcgaggggcaattcatctcggttgccaacctgaaggagcggatttttgagtccaagcatcttgggagaggcacagattttgacctcatgatttcaaatgcgcagaccgacgaagaatatgctgatgaagctactatgataccaaagaacacatcggtgttgattcgtcggataccaggaagaccaaggaagcctattgtaacagaaccagaagagacaaaagccatggaaggtagggtagaagaaaccatgccttctggtagtgcttttcttgctgatgcatctatgaaatatcctgaagaatctgagtgggatgacgagtttggcaatgatttatatgtttctgattcagtcccttcacagctcggtagccaggcggttgatgcatctgaaaataaagttgatgaagatagtaaaataaaagcacttattgatacatctgcactcgactatagtcaaattcctgatgggtatggtggtggaagaggctatggaagagggatgggtggaagaatgatgggtggtcgtggttttggtcatttcattcaacattgcccaacaaatggtgatgctagatttgacatgaaaaggatgaaacctccaactggcattccaaaatctatgttgatggcaaccccagatggctcatatgcactaccaagtggggctggtgctgtcttgaagccaaatgaagctgcttttgagaaggagatagagggattacccacaacccgctcacttggtgatcttccaccagagttacgttgcccattgtgtaaagaagtaatgaaggatgctgttctaactagtaaatgctgctttaggagtttctgtgataaatgcattagggactacattataaacaagtcaatgtgtgtctgtggtgccacaagcatattagcagacgatcttctccccaataaaactctaagagaaaccatcagccggatattagaggcaccaccaactagcagtacagaaaatgtgggaagcatggtgcaagtacaggatatggagtcagctattcctgtacagcccaaggttaggtctccagctgtttctgctgcttcaaaggaagaaccaaaaagaacacctgcacctgtagaagagtctccagatgttgagagccatagcgaagtgaaaactacaaatgttgatatgagttcttcagataagaaggtccccgcattaccagatgttgttgaaggaaccatggagtctaaaattctgaaagaaaaaacaccagaagcaacacctgttgtgaaagagtcacaggaaaaaatgcctgttgtgggcgaacaagtcgtaaagaaaaagaagaagaagaaggtgcgcgcaccaggaaatgctgaggactggaaaccctatcaggactttggagctgaaaattttgctggaatgcctatgggtccggcaggaggcttcaacccttactggggaggggggatgccattgccaatggattacatgggtgcgccatttcctggtcccatgccatacatgggttatccaccaggtcctttcgacccttttggtgggggagtcctcccacaagatccatttatgcccccaggatacatgatgccagcagttcctagggacctttctgaattagcagttaacagtatgggaatgaatatgggtccaccggttgttagcagggatgaatttgagctccgaaagcctgataataggaggagacgtgaaatggagcgattcaatgaaagggagagggagcgtggacattcccgcgagagagaaagagaaagggagagggagagggagagggagagggagagggaaagggaaagggaaagagagagggacagagaccaaaatcgagatcgcgatcgagaccaagagcgggatcgggatcgggagcgagacagggaaagagaatctcgaagggaagcgagggaatcatccggagccaataacgatagtactacctcaatgaggccgaaggctaggtcaaggtcgtcgcagccggcggacaggtcggcgccgcctccgccggcgagccccgaccgccactcccggcgctccccgcaccgctcctccggctccggcaagaagcgctcctcctccgaccgctacgacgacctgcccctcccgccgcctccgccgcccgcgtcgcgccacgaggcggccgagcacgcccacgcgaagaatacggcggcggcggccgacgcgcggtccaaggccaagggcagcgtcttctcccgcatcagcttccccggcggcgacggcaacccttccgacgccaagcgcagccgcaggtcctcctccgacaagcccccggcgtcctcttcttcctcctccaagaaagcacgtgccgctgtggcggaggacaacgacggccgccaccaccgccgccaccaccgtgaggcggccgccgcggcggaagagaggcggaggcccgcggccggagactactacggcgaggaggaggaggacgacgagagcgaggaggagcagcatttcaagcggcgcccctcgtcgtcgtccaggcgggagcgggagcatcaggaggcgcaggaggagccgcggcggtccagggagcgccgcggcggcggcagcgacggcaaccaccaccacaaccatggcggtggcggcggccacaagcgccggtga

SEQ ID NO: 5682 - DNA, 2874 bp, Oryza sativa
  Predicted polypeptide sequence is orthologous to G600, G2768
gcgcggatttctcccccaaattccaccccccccaaaatccccttctattcggcgaacgcgacggaaaccctagctctccggccgcctccggcgaggactccgcctccgcatccgcatccgcatccgggccagcgacgccggcggaagtcgaccgcccgcccgcgcgcgctcgcccccccccctccccgccatcgcctcgactcggcgccttcctctactccgcccgcctctcgcgttccgactccgggcaggcctccttcgtcgggactcgggactcactcgcgcggggttcgtcttcttcctcctcggcggcgaagggacacgccggccgccgatcgacgcgattccccccgtagatcgattcgatctgtaactctctatctctgtgtattatttgtgtattttgatatctgagggaaaaagtctcagcctctctcgccgaaagaaaaaaaaataattgtgcagaagaggcgagaaggggaaaaaaaacttgatatcaacaccatgggtgttgtgtattacaaatataagagttcaaaggaaactatttctgtgcccgtgccccattcttttgtctctgtttctgaactcaagcagctcatcttgacgagcgacaaacatggccgtggccgcacccgtggccgcggccccagagaagatattgtcctctccaacgcccagaccggcgaagaatttctagatgaaaatgccatgataccgcagaactcgactgtgttggtccgccgaacttctgggcaacaatcagagaaaatcgtcttgttctcctcgcgggaagttatagaagatggtgctatagcttcaaacaagtcagagattactgaatcaacctcaaaatcttgttcctctacagaagtacaggatgaggatgctgcaatcgcatctataattgatgcagctgaactcaaatgggaagacaagccatctaaaagaggacagactggtggaaggtttacgtcaggacgttatggtcatggaccggtcgaaggggagacacctccaccaggctatgtgtgccgcagctgtggagttccaggccatttcattcaacattgccaacaggagagaaagacacctccatctggctatgtctgctacagatgccgaattccagggcattttattcaccattgcccgaccattggtgatcccaaatttgacgattacaagaagccccatactcttgtgccagaagtatctgcatgtcctattgatggcattccatcagctcttgccccagctgcatctgtgagtgttgttgacgacttgccagctgagctccattgccggctatgtaataaagtgatggcagatgcggtgttgacaagcaagtgctgcttcgacagtttctgtgataaatgcattcgtgattacatcattacacaatccaagtgcatttgtggagtcaaggttcttgcagatgacctgattcccaaccaaacacttcggagcacaatcagcaatatgctggcaacaagggctagcagcatcactagtggtacagggaagcacaggagctcttcaggcagcaacgtggatcctaattcagcaagccaaactccttcagctgccttggaaaagcaatctaaggatcaccacatatcatcagctgctcctgatgctggcctccaagttgctacagaacatgttagccatcttgagcataaattgacaacaggtgttgatctcgaagtgaaagatgaaggcaattctgcagggatattggtagagaagattgtaccaactgctgatgccagattaaaagatgtaactgactccacttcaaagccggccactatttcaggaaccatggaacccaaagcttccaagactgatcaattgaagaagaagcgcaagaaggcagattcaactaaaattgttcatcctaacaatgctaactatggttacagcattccatttgaccctgcgtattgcaacccttacgtcagtgggtatccttggttaaccgatccttacatgtacggcccagcgggcatgccttatggtggctatccgatgggcccttatggtgtcaattccatcggcaacatgccactgcaatttccatcagcaatgcaaggcaatttggcaaatactcactgctgggaaactcaatctatgattcactgggcaaacgaagacgctgcacgtccaaggctggcggcgaagcccaaagaacctgaacctgccaatcagtctcgatcatcagagcgtaaccagcgtctgagctcttctcatggcaccgatcccagttacaagaccagcaggtcaagctctgacaggagggaccataggcgctccattgattacgtcgaggatcaccgctctagtgattacgccgaggatcaccgcagcagcaagagaatgcgcgcgtcttctccatctccaaccggtggtgacaggcacagcagagcgaggtccaggtacagttccaggaagcttacttacgaggattcatctccaaccggtggtgacaggcacagcagagcgaggtccagtcacagttccaggagccttacttacgaggattcaagcgatgatgagcgcaacttcaagaggagatggggaggcaaaagatagataggtcaccgtggacgcaacacaaggccgtgatacctgaatgaatgaagctgatgaacatcttgcatcattccatatcaaatgcttgttgatggatgtatgtgttaattgtaagctgaggagaaatctccgaaagcgattttcctcttaacggaattgtaattatgagctactattaatgtaaaatgaatgagagcaattctcatcccctctatgtaatgacaatgtcctccaaagatgagtggaacaatccttgacctttaatagtcgtttact

SEQ ID NO: 5683 - DNA, 907 bp, Oryza sativa
  Predicted polypeptide sequence is orthologous to G602
gtatcagtcggtattcagtacgcactacgcagcagcccgtgagtcgtcgtgaccaaacgtatagtatactagctaccaaaagcagtacggtgcctggtttcattgtaagcagccgcgccgagtcagtagcgtagcgtgagcgcggtgaagatggccggggaggcattgaaggaggcgggggcgacgcccgccgcagcgaacgcgggggaggagaaggccgtcatcccggcggcttcgacatcgccggtgatctccaagaccgatgatgacacggagccgccggccgatgactccaaggctctcgtcgtcttcgtcgagaaggttgctgataaacctcatgctgagaaggcaacagcaacagcaacaccaacaaggacctcaaatgacagagatattgcccttgcaaaggtggagacagacaagcgagaatcgttgatcaaagcatgggaggagaacgaaaaggcaaaagcggagaacagggcctctaagaagttattggatattatttcatgggagaacacaaagaaggcagtaataaaaactcaactgaaaaagaaggaagaagagttggaaaggaagaaggcagagtacgctgagaaggcgaagaacaaggaagcaatcgtccataaggaagctgaagaaaagagagcaatggtgatggcccggcgcggtgaagaagtgatcaaggccgaggagatagcagctaagtaccgtgcaaccggagtgacaccgaagaaacatatcgggtgttttggggcataagaaacatcgatccgagccatatacttgtttttctttctctttcgaaagttatttgtgttgggttgtaacttgtaagtgtgtacttttttttctttggaaaaattggaaccatgccattataattttgtaaaatttgagatatgct

SEQ ID NO: 5684 - DNA, 1022 bp, Oryza sativa
  Predicted polypeptide sequence is orthologous to G602
gagttcgtgtgcttctctcatttgttccttgatatatttgctacgtcgtcagagaactcgtgcagatagcttctttggctgagttgttggagatggcggaggtggcgccgccggcgccggcgccggagccgaccaaggacatcgccgaggagagggccgccgtgccggcgccggaggagtcgaaggccatgaccgtcgtcgatgatgctgagaaagctgcagcaacaggtggctcacacgaaagagacgctctcctgacgacggtcgccacggagaagaggatatcgctgatcaaggcgtgggaggagaacgaaaaggccaaggccgacaacaaggcggccaagaagttggccgacatcgcctcatgggagaactccaaggtggccgagatcgaggccgagattaagaagtaccaagtaagttcagctcagctaagttcatcaacaagcagaacaaggagagatcaattatgtgtgtgtgaatcattgagttgatcgatcggttcatatatatgcaggagtacctggagaggaagaaggcggagcaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctcttcggttgaatctcttctcggtcatctccattgatcgtcgtcgtcgtcgtcgttgttgtaaatgtgtgtgcgacagtgtgagtgtaccggtgtcaagttcagatagctagtggttggatgtattttctcagttgtttgttttcgtttaatttcatgtacagggcagctattgcagtctcatgtgaaaaagggaacatttattatgtacagacatgatgttttggggtctttattcggattcggcggtgaaattgtaacatttttgtgcctgtggtacttggctagtactcatgtataagaggcttacccatttgacattatt

SEQ ID NO: 5685 - DNA, 1847 bp, Oryza sativa
  Predicted polypeptide sequence is orthologous to G605, G1944
ggctcttgctgctcctcttctcctcgcttcgtcttcttcctcctctcgcctcttcgttgcgagtagagagatttttgttgtgatttttgagggaatatttttggatttttggtttatttttgtgtgggtttttttggaggtgtatttattttgtttttttggtggtgatttatttttgagaggttttaagggattaagggaggtgtgtgaggaagatggggttagtgtgtgtgagctccaatggcgagagctcgtggcggaaaccctactaggttgaggaggaggaggaggtcgtcgtcgcgctcgcgtgtggaccatggaggccaagtcgggggaagcgagcgttgcgccggtggccgtggcgaccgaggcaacggcggcgacggtgagcttccagccgcaggcggcggtggccgagcagggtagctcgagcggtggtgtgctggtgccgccgccgcctatggcggcgggaggaggaggagttgtggtggcggcggcgccggtggcgggggtggtgaaggtggggaagaagagggggaggccgaggaagtatgggccggacgggagcctgatccggccgctgaacgcgacgccgatctcggcgtcggtacccatggcggcctccgcggtggggccctacacgccggcgtcggcggtgggcgccgccatgaagcgcgggaggggtcgccccctcgacttcgcctccacggccaagctccatcaccaccaccaacaccagcaccatcaccagcagcagcagttcggcttccacttcgactccattggtgaaatggtggcttgttctgctggtgcgaattttactcctcacatcatcactgttgctcctggagaggatgtgactatgaaggtcatatcattttctcaacaaggaccacgagctatctgtattctatctgctaatggtgtgatatcaaacgttacactgcgtcaacctgattcctcgggtggcacattaacttacgagggacgttttgagttgctatctttgtctggatcgtttatgcctactgaaaacagcggaacacggagtcggtcaggtgggatgagcgtttctcttgccagcccagatggccgtgttgtcggtggtggagttgctggccttctggtggcagcaagtcctgttcagattgttgtcggaagcttcctaccaagctatcaaatggaacagaagaataagaagcctagggtggaagcggcacccgcccttgcacagactcctcctgctgttccaatctctagtaccgatacgcacagcagcgagcaagggcagcacagctccgtcgccccaagaacaacaaacatcgtaacctcagcatacaacccagaccagagctgggcatctcctgctcagtcgatacctgacagcgcgagaacaccatcgggcgatgtgaaggtcaccgcctctggagcctgaaactgagatgaactgaccaggatccatgaaattcctggtctgtcactgctgcagccgcacaccatgatcgccggtggcggccaaagatggcttcatttctttctgacttgtaaaagatgtatctgagttccagtaggttttccatcttcaggcagaagagtctaactgcaattgctgtagctgtcccgatattagtcactgtttaagcatcaggctaccctgcttccttgtaacaccatgtcggtcttattggagattggagagttctgtagttacaaaattgtactattagttctgtgtgtgtgtgtgtgtgtctctaggcttctttttcattttgttggattactccacttaatttgctcctggtgtaccccttattaaattagcattagaattttttttcactctaatt

SEQ ID NO: 5686 - DNA, 1167 bp, Oryza sativa
  Predicted polypeptide sequence is orthologous to G605, G1944
atggagcccgcgacggagaccacggcgacttcgccggctgcggctgccgctgcgcagccggaggcggaggcggaggcggaggcggagtcggcggcgacgccggtggcagtggcggcggcggcggcggcaacctatcagccgccagcgccggtggttccagtcgccgtggcaggtgcggcggcggggagagggaacgggaagaggaagagggggaggccgaggaagtacgggccggacgggagcctgctccggccgctgaaggcgaccccgatctcggcgtcggtgccggacgactccggcggggggcagtacacgccggcggcggcggtgggggccgtcatgaagcgcggcaggggccgccccgtcgggttcgtcagccgcgcgtcgccggtgtccgtggccgtgacggccgccacgtccaccgccgcggtggtcgtctcgtctccggccacccacacccagacgccgctcgggccgctaggtgaattggtagcatgtgcttctggtgcaaacttcacacctcatatcattaacgttgctgctggcgaggatgttaatatgaaggtcatatctttctcccaacaaggtccaagggcaatttgcattctgtctgctaatggggtgatttcaaatgttacattgcgtcagcaagatactttaggtggtacagtgacttatgagggccggtttgagctgctctccttatccggatcattcacgccaactgatagcggtggaacgagaagccgctccggtggaatgagcgtctcgttggcggccacggatggccgtgtcatcggaggcggagttgccggcctccttgtggctgcaagccctgttcaggttgtggtaggaagcttcctgccgagctaccagctggaccagaacgccaccaagaagcccgtcatcgagatcacgacggtgccgccgccgccgccggccatcggcttcaccatctccagcggcgaccctatggaggactcctacagcggcagccatggccagcaccgctccggcgccgccgcggcgacgacgacgacggcgaaggccaactcgacgtcggcgttcagggtggagaactggacgccaccggcgccgccggcggcggaggcggcgaggacgaagacgccgtcgtcggaggccaaagtcccagtccccggagcctga

SEQ ID NO: 5687 - DNA, 575 bp, Oryza sativa
  misc_feature (496)..(496): n is a, c, g, or t
  Predicted polypeptide sequence is orthologous to G611
ataaaagcgttattataacccattttattcatagatcagcacaaattacaatactacaatacctgacacaaaactacaactgacaacaccaaaggcacggatgttgcgtacctatagcttttgtttaaaaacatatacatacatacatacatactaactagccgggggtacccagtttacacacagcaaatgcaatcctttattgaccaagcaaacagctttagggataattaagtagctttacaagcacattatcatgcatgtttagcaaatacatatatttgtaagggtttatgggggcgtttttatttggcataatccattattcgttcgggtcttgcctcgtcgggctcatgaacaacaaccggggcacttgcctttccacttgcaacatgggccgttatggccgctgcaataactcatgcacttgccgtcatagtcgcagcagcctttacagttgcaaggcccccacttgccgtcgggaaaggcgacgttnacaacgggagatgccgccaccagcctcaggaaagcgaacacaacgaaagccttgttggaccccattaatttgggcaagc

SEQ ID NO: 5688 - DNA, 685 bp, Oryza sativa
  Predicted polypeptide sequence is orthologous to G611
tttttttttttttttttttttttttttaacacaaactccaaactgtggacaaaaaaacttacgggggcttattttttttttattcgcctactagctatctcatattatttaccacggaacttaggaatatagaatatgcttattatgccaccgattggtcgaataagggactaggattgaaatatgggtttgaatgacagtataattacacagctgaaaatatcatttggagctgctggtggactatctagcaactttgtgcgctcgggggtgagagacagatgcttcatccttttttagacccttccggtctcctagcccaagctggggctaggccaggtccataccggggatcataatagagatcctccctagccctaatgcggtcctttgcatgagataccaactcgggggagcgccagccaccaacagatccttctaataggagacaggactgaacgagggatttgtaaactatagtttatcccccgtgagacaagcatccagccaatactgctcatttagatccgaacggaccgaggaggttggtcgagtcagacattttgccacccttaaccagggctatatgagaagaccaattgccggggggttccccaagggaattcacttctattcactgggatcttattgaggtggccccaacctggaacattagatatttcaa

SEQ ID NO: 5689 - DNA, 3133 bp, Oryza sativa
  Predicted polypeptide sequence is orthologous to G611
cggcggggtctcatccgattggaaacagattgggaagggggagggggtaggaatacgtggcgtcggcagtattaggtatagagagaaaccctttccatcctttgtctcttagccccgaaggagagagaaaaatcagaaaaaaaaaaaccctccgcgtgtgggggaagcagagctccggacgctggcgccgctcgcgccaccgcacccgcaccgccatggcgtcgtcctcgtccaaggcctccgattcctcttcccaacgccccaagcggccggatcaagggccatcgggcaaggacgcggccggcctcgtcgtgctgcacgggaagctggcgcagctgaagcgtcaggtccaatccacccgcctcgccgcgatcaaggagagggtggaggcgaacaggaaggcgctgcaggtgcacacgtgcgctctgttcgacgtcgccgcggcggcggaggtggcgtcgcggggcgccgagggcggcaacgcgctgtcgcggggcgcggcggaggggcactgcaggctcgtggggtgggactcggcgagcgggccgggggagagggagttggtgcatgtgcaggaggagaatctggtcgccgggacgctcgtgctctcgagctctggtggtagcggcgcctcgcataggaccgtcgtgcagcttgcgaagctgcctgtggtcgacaagattccgccctacaccacgtggatcttcctggacaaaaaccaaagaatggccgatgatcagttagtttgtaggaggagaatttactacgacccaattgtcaatgaggctctgatctgcagtgaaagtgacgatgatgttccagagccagaggaagagaaacatgttttcacagaaggagaagatcagctaatatggaaagctactcaagatcatgggttaagtcgagaggttttaaatgtcctctgccagtttgttgatgcaactccttcagaaattgaggaaagatcagaagttctttttgagaaatatgagaagcagtctcaatcttcttacgagacagattttcaactttttcttggcaagaccatggatgtggctttagattcttttgataatctcttctgtcggagatgtttggtttttgattgccgtctccatgggtgctcccagaacttggtattccctagcgagaagcaaccatatggtcatggacttgatgaaaacaagagaccgtgtggcgatcagcgctaccttcgaaggagagaagtatatcaagatacgtgcaatgatgaccgaaatgcttgtacaacatataatacggattcaagatcttcctcactcaaagttagtgctaccatattgtctgaatcagaagattcaaacagagatgaagataacatcaaatccacttctattgttgaaaccagcagatcaaaaataactaattctgaatatgctgacaaaagtgtgacaccacctcctggagatgcttctgaaactgaaaatgtgtcccctgacatgcccctaagaactttaggcaggcgtaagatttcaaagcatgcctccaagtctaacgatcattcacctgataaaaggcagaagatatatagctcaccgtttccttttgcaatgagtgtactgaacaagcaatctgttccagaaattggtgagacatgtccagattccatagaatctgcagttgatcaacttccaagtctggatgaccctaacaagaaaatttctaccaaagatatgtgtgctggaagcacaactaacactactgaaaatacattacgagataataataataatttgttcatctccaacaaggagcactctatttctcattggagtgctttagagagagatttgtacttgaagggaattgagatatttgggaaaaacagttgtctcatagctagaaacctattgtctggcctgaagacctgcatggaagtggccagctacatgtacaacaatggtgcggcaatggcaaagagacctctatctggtaaatccattttaggtgactttgcagaggctgaacaaggttacatggagcaagatttggtggcaaggacaagaatctgtcgtcgtaagggccgagctcgaaagctcaaatacacttggaagtctgcagggcatccaactgtaagaaaaagaatcggtgatggaaagcaatggtacactcagtataacccatgtgggtgtcagcaaatgtgtggcaaagattgcgcctgtgtggaaaatggaacttgttgcgagaagtactgtgggtgctcaaagagctgcaaaaataggtttagaggatgtcattgcgcaaaaagtcaatgcagaagcagacagtgcccgtgttttgctgccagtcgtgaatgtgatccagatgtttgcagaaactgctgggtgagctgcggagatggctcactaggtgagccactggcaagaggtgatggctatcagtgtggaaacatgaaactcctcttaaaacaacaacaacgtatattgcttggaaaatctgatgttgcaggttggggtgcattcattaagaacccagtaaatagaaatgattaccttggtgaatacactggcgaattgatttctcatagagaagcagataagcgtggcaaaatatatgatcgagcaaattcatcgttcctatttgatttaaatgagcagtatgtactggatgcttatcgcaagggggataaactgaagtttgcaaatcactcgtcgaatcctaactgctatgcgaaggttatgttggtggctggcgatcatcgagttggtatctatgcaaaggaccgcattgaggctagcgaggaactcttttatgattaccgctatggacctgaccaagccccagcttgggctaggagaccggaagggtcaaaaaaggatgaagcatctgtctctcaccaccgagcgcacaaagttgctagatagtccaacagcagctccagatgataatatcaactgtaaattataccgtcattgaaacacatagttcaatcctagtccattatacggccaatcgttggcataataagcatattctatattccttagttccttggtaaataaactgagatatcgagtatgcgaataaaagaaaaataaggcactgtaagtttatttgtacaaagtttggaatttatgctatgtatagttttgcc

SEQ ID NO: 5690 - DNA, 3205 bp, Oryza sativa
  Predicted polypeptide sequence is orthologous to G611
gcttccctttcctccacccacgccgcgacgacgagtcgccgccgcggcctcgccggcgaccaggtctccggcggccccgccgcccgccgtgacggggctccggccttccgccctcctccccgcaccgcccgctatctcggctccccgactcctgcattcccccgactctcccccggccgccgccgccgccatttctgactctttctccgcggcgcgtctctcctccgagagcacgccgaccgcctcccgaagcggcgtcgcggccgcggcggccgccgccttctcccgcccctgatggctggcgattcccgaaatgagccgatgttttgcgaggaagggagcagtgaatcgggctatgttctatgtgttattgattcgctgaagaagaaaatcacatcggaccgctttgtttacatccagaaaagggtagaggagaatagcattaagcttagcccgattacactgcactctcacaatttgtcaaaaaataggcaaactagtacatccaacagtacagatttagtctcgaatttgctcacaaagaggaaagaagatgccctgtgtgctgtgaatagtcgtgagtcatctcctgatgaaagtgaaggtgccaattgccaagatgagtgttcatcgactgttattgtgggtggaaatctatccgcgaggaattctgtccgtccgattagactaccagaagtggcaacactccctccatatacaacttggatatttttggacaggaaccagcggatgcaagaagaccaatctgtacttggtcgtcgaaggatttactatgatacaaactgtggcgaagctttaatttgcagtgatagtgaagatgaagctgttgaggacgaggaagagaaaaaggagttcaaggattctgaagattgcataattcggatgaccattcaagaatgtggcatgtctgatgctgtgcttgaaactctagctcgagatatcgaaagggctcctgatgatataaaggccaggtatgagatcctacggggagaaacctgagggttcttccaagaaagtgtctgaacttaatgtcaaaatggaagacgtgtacggtgataaagatctggatgcagcattggattcctttgacaatctcttttgtcgccgatgtttggtttttgattgcaagctacatgggtgttctcaagatttagtatttccgactgaaaagcaggcaccattgtgcagctcggatgagggtacaccatgtggtattcactgttacaaactggtctctaaaccagatgctatcatggagattgattctcatttgcttgttgatgttgaggagccaacatcggacaatctaaaggatcagatagggtcaaataagaaaaagcttggttctagtgggcagaaaacaaaatctcaacaaagtgaaagttcttcaactgcaagggtttcctcagaaagcagtgagtctgaagtacaactgttaagcaataaatccccgcaacactctcctggcctctcaaaaaataagcttggcgcaaaaggtggaatcaagaaaagtactaacagaagaattgctgagagaattctaatgagtgtgaaaaaggggcaacaggaaatgtcaccggactctaattctattgttaatggatgccattggcctagggatatgaagcttagatctgatactaggagtggtattaaggattctgttgtatcctcacagtgtaattctccaagcacaaggagtttagaaagaagggcacacttcaaatggagaataactcatcttttgtggatgctcagagtgattcaatggaggatacaaataatgaacattcagcaacagatggttgtgatagttcaaggaaagaggaatgtgttgatgagagtatatgcaggcaagaagctcatggcaggtcctggaaagtgattgagcaagggcttctattgaaaggattagagatttttggaaagaacagttgtttaattgctcggaaccttctgggtgggatgaaaacatgcacagatgtttttcagtatatgaattacattgaaaacagcagtgcatctggagctcttagtggtgttgattctcttgttaaaggatatatgaagggtaatgaattacggacaagatcaagatttgtgagaaggcgaggaagggtccgccgtttgaagtacacctggaaaactgcaggctaccattttataaggaaaaggattacagaaaggaaggatcagccttgtcgacaatacactccttgtggttgccagtctgcatgtgggaagcaatgtccatgtctcacaaatggtacctgctgtgagaaatactgtgggtgcccgaaaatgtgcaagaatcgcttccgaggttgccattgcgcaaagagtcagtgtcgcagccggcagtgtccatgctttgctgctgacagggaatgtgatcctgatgtgtgtagaaactgctgggtagggtgcggtgatggtacattgggagtccctaaccaaagaggtgataattatgaatgccggaacatgaaactgctgcttaaacagtaacaaagggtcttacttgggagatctgatgtttctggctggggagctttcctcaagaatagtgttgggaagcacgagtatcttggcgagtacactggggagcttatctcccataaagaagctgacaagcgtggaaagatatatgaccgtgagaattcatcgttccttttcaacttgaacaatgagtacgttcttgatgcctacagaatgggcgacaagctgaagttcgccaaccattcccctgatccaaactgctacgccaaggtcatcatggtagcaggcgatcacagggtggggatcttcgccaaagagcggatcagcgcgggcgaggagctgttctacgactaccgctacgagcccgaccgggccccggcgtgggctcgcaagcccgaggggcccggtgccaaggacgacgcccagccttccaccgggagagcaaagaagctcgcccactgaagaagaagaagaagaagaagatcagccgttgattcttttgttgtcttggttgattctttcgttattggtgagggggaccgagaactctgacggtgattagcgccgtaaggaaaactttcctgccattcgttggccccctcgattcgattcgttgattttccctgaattctgtaactgctgcacctgtcgcctgttcaacttcaaaagatttttctgattctgg

SEQ ID NO: 5691 - DNA, 1363 bp, Oryza sativa
  Predicted polypeptide sequence is orthologous to G616
ggcacgagcagggtgagggcgacgggggggaaggacaggcacagcaaggtgtacacggcgaagggaatccgcgaccgccgcgtccgcctctccgtcgccaccgccatccagttctacgacctccaggaccgcctcggcttcgaccagccgagcaaggccatcgagtggctcatcaacgccgcctcccccgccatcgacaccctcccgtccctcgaccccgccgccttcgccgccattccccacgccgccgccgacgccgcgcccacgcggcggcgttcgcagcagcagcagcagcagctcagcaacaagtccggatgcagtagcacgtcggagaccagcaaggggtcggacaaggaggtcaccgtggcgagcgccccggcgcaggccgcgtcgttcactgagctgctcattgctggggtggcggcgtcgtcggcggggggtggcgccattggcaacggcgccgactgcgtgggcatcgcgcaccccgggaaaggaggcgcggagggggcgtccacgtacggcttctccgccgcctcgagcttcggcgacgcgccaccgatcggcatggtgccggcgccgccgttcaacttctccgcccccggcgccgacatggcggcgcactactcgctcgcccaggaccagctggcggcgcctccgcctcctgccggaggcgactacaacctcaacttctccatgtcctcgggtttcttgggtgccaatagggggacccttcagtccaattcgccgtcgaacatgtccggccaccaccaccaccaccatcagcagcagctccagaggctggacggctccaccatttccttcctgcttggccacgccgccgcggcggcgcacccggcggcgtccgagggccagatcaccagcaccgccgcgttgcagctgtgggatggattccgccactccggcatgaaggagaagagcaagaactgatcgatcccagcaacgcatcctccaaaggaactgaagatatcatcatcagattaattgttgtcacctttccagcaagagctcaccgtggggagctgctacaagtttattgcgatgactgcccgtgttcttttagctgggtcatcgttctgctatgctgttttttggccatcatgaacaccctgccgctgctgctacctgccattgccatcactcagacaatcttgtgaatttccttctttttcctagatgaagctgctgtacaaatttttgtgggagacgtgagtttcgaacaagaataagcgtgtcccgtagccagcgttaaacctttcccttccagaaatatttttcgagtgaattgaaattcatatgtgcctctggttattggagtggcaaaaaaaaaaaaaaaaaaaaaaaa

SEQ ID NO: 5692 - DNA, 1248 bp, Oryza sativa
  Predicted polypeptide sequence is orthologous to G616
atggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgccgccgccatcgacaagctcccttcgcttgataccgcttccttccccaccaaccccgcctcctccgccgctgttgctgctgctgctgctcctcctcttccccatgccgaacgcgagcagcagcagcagctcaccaagtccggatgcagtagcacgtcggagaccagcaagggctccgacgccggggacgacgccgccacccccaccgcgcccaccgccgcgcccgcctcctcgcaggcggcttccttcaccgagctactcaccgggatggccgcagccaacgcctcacccgctgaccacaagcagcagcaggcgtggcagccgatgaccgtcgccgcggccaccgccgactacatcggcttcgccgccgccgccgcgccgcatacgcagccgcggaaatccgccgcgggccatcactccgcgatgccgcacaccttcgcatcacccgctccccacctcgccaacatcacccccatcgccatggcgcccgcgcagcacttcaccctcacacccgccgccgccgagcaccacgcggagatgacgcactactcgttcgaccacttcatgcccgtccacgcggcagcagcggcggcggcggcggcctccaccccggccggcggcgactacaacctcaacttctccatgtcctcgggtcttgtgggtgtccacagtagggggacccttcagtccaattcgcagtctcacctctccagccatcaccaccaccatcaccagcaacagcagcagcagcagcagctgcagaggctgtctgctccgctggatgcgcccaacattccgttcctcttcagcccggccgccgcgcccaccgccgcggacacccagttcgccgccgcattgcagctctgggacgggttccggcacgccgacatcaaggagaagggcaagcactga

SEQ ID NO: 5693 - DNA, 497 bp, Oryza sativa
  Predicted polypeptide sequence is orthologous to G616
gcacgaggccgatcgcctcgccgccttaacccccacccccgatctccttcctcaccgacgacgcgcgccccactccccccacctcaatgcgcgcttcctagggcatatgaccggtactacgacaaccatcacctctcgccgtcaccgtcatcgtcgggatggagctcgccggcagcaacaacaagcgggggagggtgagggggcccaacgacgacgacgacgacgccggggagccggacgccaagcgccatcaccaccagctgctgttgccgtggccgcagcagcagcagcagcagcatccggcgtcgcggatctaccgggtgtcgcgggcctccggcgggaaggaccgccacagcaaggtgtacacggccaagggcatccgcgaccgccgcgtccgcctctccgtctccaccgccatccagttctacgacctccaggatcgtctcgggtatgaccagccgagcaaggccatcgagtggctcattaaggccgccgcc

SEQ ID NO: 5694 - DNA, 1674 bp, Oryza sativa
  Predicted polypeptide sequence is orthologous to G618, G2057
tcttgttttaattttcgctcttctcctttccggttaactgtgggtgagagggagctcaagctggaggaagacaagaaccagttgtccaagggcttagacccttggacgagcaaccctaccgccagcgcgagcaccttgcactacctgctccaggagaaggagagggcgcagcaagcgcatgagcagcttcagatctaccagcagcagcagggattcggcagcttcctgcaacaccggatcaggcagccggcgagccgggggccgggaggtggaggcggcggcggcgatggcggcggcagcagcggcgagtcgacgcccgtcgaagcgctggccactgcattcggggcaggccgcatcgtgcggtccgcggccgggcgcaaggaccggcacagcaaggtgtgcacggcgcgcgggctgcgggaccggcgcgtccgcctcgccgcgcacaccgccatccggttctacgacgtgcaggaccgcctcggctacgaccggcccagcaaggccgtcgactggctcatgcgcaacgccaaggccgccatcgacgagctccccgaccgcgccgaggccccgccgccgcccgccgcggcgtcgacggagcagcccgaggccaccgagcaggcgacctcgacgtcctacgggttcggcaacactaccggcggcaccatgaccagcgccgcgtcggccgctgctggctccttccttccacattcgctgggggcagatcgagtctccgacagcgtcaagtccctgttcccctcctcgtccacagccagcggcgccgcctccgccggacacgacgagtacaggggatccccgccggacctcctgtcgcgcacgacaagcaaccagcagccgcaggagctgtgcctcaccctacagtcgaaccagcaccagatcttcagccatgtctcgtcgaaccaccacggtatgatctcgagtgcaggcgttccaggttggcccgaccacagccagagaatgcaggcatggcatgccccggagaacagcacaggagacggccgcggcggcggcaatggcgacggctacatgttcgccatgccgtcgcggcaagggctggaccagagccagctcttctcgcatggggaaccccttcagtccagcggtcgcgggtgggcgtcagcccgcgcatggctagaccccctcgcagtcgcagccatccaccaccagccgtcgacaatggctgccggacaggtcggcttcggccatctcgttggcggcgccggtggcggcggcgggtttatggggtttctcgcgccggcggcgcagcggcttgagggcgaggaggagcacggaagtgaggtgatcaggtgatgagaagagactgaagaattgatgcatggcgcgcatgcaggaggtgtgtgctttctattaattaacacacttcactgatctgcttaagggtacgtgtatgtcatttcatgtaggattttggctgatgaaatttccctcattattatctgctgtcttcatgcatgtgtaaccaaggcttaattaattattaagagtacgttcccttggaactaggcagctgttgctgttgcattagttgctattgctgttttcccctttattctcggcatggacaagatgtgatgatgaagagatgatatggtctaaaaaaaaaaaaaaaaaaaaaaaaaaaaaaaaaaaaaa

SEQ ID NO: 5695 - DNA, 2442 bp, Oryza sativa
  Predicted polypeptide sequence is orthologous to G618, G2057
cgagcggccgcccgggcaggtcacaaacccaacaagagagtgagagaggagcaaaagctttggctggccgtcccccctgttaaaatgtgatgtccaatccatgggattgcgtctagtttagtcccccactcctctcctggttatgggatccggcgaggtggatggacgcgcattggagcagcaacagtagcggcggggaagaaggcggcgggggatctggatccgaggcaccaccaccaccgggtcacccacggcggcgacggcggcggcgtaggaggaggaggaagcgggggacaggaggaggcagatgagcagcagcagcagcagcacgaccaccaccggcttctccagctccaccaccaccagggtgtgcagcaggaccaagaaccgccgcctgttcccgtcttccacctccagccggcgtccgtgaggcagctgtcgggctcctccgccgagtatgcccttctctcgcccatgggcgacgccggcggccactcccaccaccaccaacacggcttccagcctcagctcctctccttcggtggcgtcggccaccaccaccacctgcatcagttcacggcgcagccacagccccccgccgcgtcccacactcggggtcgtggaggtggaggtgagattgtccccgcgacgacaactccacggtcgaggggcggaggcggcggcggcggcggggagatcgtggcggtgcagggcgggcacattgtgcggtcgacagggcggaaggaccggcacagcaaggtctgcacggcgcgcgggccgcgcgaccgccgcgtgcggctgtcggcgcacaccgccatccagttctacgacgtgcaggaccggctgggctacgaccgcccgagcaaggcggtggactggctcatcaagaacgccaaggacgccatcgacaagctcgacgtgctgccggcgtggcagcccactgccggcggcgcaggcgcgggcaatgccgccgcgccgccgtcctcctcgacccaccccgactccgccgagaactccgacgaccaggcgcaggccatcaccgtcgcgcacaccgccttcgacttcgccggcgggggcagcggcgggaccagcttcctcccgccgtcgctcgactcggacgccatagccgacacgatcaagtccttcttccccatgggtggcaccgcaggcggggaggcatcgtcgtccaccacggcggcgcagtcgtcggccatgggtttccagagctacacgcctgacctcctgtcccgcaccggcagccagagccaggagctccggctgtcgctgcagtccttaccagaccccatgttccaccaccagcaacatcgccatggcggcggcggcggcggcggcaatggcaccacgcagcaggcgctcttctccggcgccgccaattactcgttcggcggcggagccatgtgggccaccgagcagcaggcgcagaaccagcgcatgctgccgtggaacgtgcccgaccccggcggcggcggcggcgccgcctacctgttcaacgtgtcgcagcaagcggcgcatatgcaggcggcggctgcggcgctgggtggccaccagagccagttcttcttccagaggggaccccttcagtccagtaaccagccctccgagcgaggatggccggagaccgtcgaagccgacaaccagatgagccaccaccaaggagggctgagcccctccgtgtcggcggccatcggttttgccgctcccggcatcggcttctccggcttccgcctccccgcgaggatacagggcgacgaggagcacaacggcggcggcggcggcaatggcgacaagccgccgccgccgtcgtctgtctcctcggcttctcaccactgaccgcagcagtggcgagcagatgacttcaccaccaccaatccaccatgagcaaacaccacaccatgtaccagactatcagctagctcctccacttccatcacggaattgtcgattgcattcgggaggagcaaagtttggaggtagcacaagtgcactactactgatgctactacatatcggttggttggttggttggttttccatcgatctcttctgctgctgcgcatgtcattggtttttgtttcaagaattcactcggagcttcttagaattaggcttgtgagaatgcagcaacacgatggcaagctttagcttagcttagcaagcctctgtgtctgttggctgttgcgttgcgctaggtgtagttgatcgatgtaggttcgagcttgctttgctttgttttgatttttactcttttgttgctgatgcatggacatgcttttgcttcctcctgtgggttcaggagcagttgctactagaccgatgttgttctcaaaactgataagtgggatggtgatggattgggagaggagcctatctttcatcttttccaaaaaaaaaaaaaaaaaaaaaaaaaaaaaaaaaaaaaaa

SEQ ID NO: 5696 - DNA, 663 bp, Oryza sativa
  misc_feature (32)..(32): n is a, c, g, or t
  misc_feature (54)..(54): n is a, c, g, or t
  misc_feature (66)..(67): n is a, c, g, or t
  misc_feature (82)..(82): n is a, c, g, or t
  misc_feature (162)..(162): n is a, c, g, or t
  misc_feature (170)..(170): n is a, c, g, or t
  misc_feature (180)..(180): n is a, c, g, or t
  misc_feature (246)..(246): n is a, c, g, or t
  misc_feature (353)..(353): n is a, c, g, or t
  misc_feature (623)..(623): n is a, c, g, or t
  Predicted polypeptide sequence is orthologous to G618
cggggtcaaacttttcttgtgttcgccccttnccgtctgtcgttcctgagtccncgagtggtccannctcatatgatggtgnctctatataaatatgggggacacaaatggtaaatttccaccattgccgttctgatatatttgggattcgattgcttatcntattgccncgtcggattngattaatgtaaactcccggtatacgatgatgcggcctcatgaacacctcagggacaagatctacanggcatgcaatggtgtattggtcgtggaaaccttcatggcacaagcggtgacggatacgcacaccgggtactagatgacaacaatgcccatgcgaactatcaagttgnaccatgagtttgtatcggattggccatgtgagggattgttgccaatgatgtgaaccatggtgtggtgacatgtgacatgaatgttgtgtgtgcccctgctgcgttgggatgctgcatgaaaccagctgctgcccttggctgctgtgttggactggtgatgtatgactgcagagcatgcattggctgatggacacttggacacttataaactacacaagtgtagggtggtgttgcgactgagactgactatgccccagctaatgcttaccntgcttaatgtgattctacctaatgcaaaaaaaaaaaaaaa

SEQ ID NO: 5697 - DNA, 398 bp, Oryza sativa
  misc_feature (211)..(211): n is a, c, g, or t
  misc_feature (318)..(318): n is a, c, g, or t
  Predicted polypeptide sequence is orthologous to G618
tgtaattgtgatgctcagagggagatctgtactctgtctgtgcacgctgtctacccctcttgccgcgaatatggcctgaagatggaagagggaatactgcctgtctgatgcccagtgatatgcccaccctgagagtgtggagtggatgaaatgtaaatgaatggaggacgcccgcaggataatgtgtgcccaatgtgtctgtcgtggcgtnttgagtgccgtgagagtaatgttcgtggcttgtgaagtgttgtgggttgtggtttatgtcgcctttgctatgggtcgtgattgcagtggttaaagttgatgcatgtnttggcttgcatcaatggggtggaataaagagaggccaagtctgaatgtgttctgctaaccaaaaaaaaaaaaaaaaaaaa

SEQ ID NO: 5698 - DNA, 705 bp, Oryza sativa
  misc_feature (652)..(652): n is a, c, g, or t
  misc_feature (678)..(678): n is a, c, g, or t
  Predicted polypeptide sequence is orthologous to G618
ttttttttttttttttttttttttttaagtcggcgaacgtgtcttggggtatattagctagtaatcatccgagtctaaatcactcgtgtccgtaaggctatgcgacgaagcttcttcctcttcctctaatcgagctcgttgggtttcctttggtctagcgagatactcctcaagcccttccgcagtcgcccacggtggaataccgattgcgtcgtcatcttgtttaacgccaaaaagtacgggctcatcaatgcgtacgacgtcctcaccaaagtgtaagtccagctccgtcttcctgagccacttaatgattctttcggtctggcccttggaagaaatggttgggaaaagtctttttaacttggacctgtcctcgccacatatttctgcctcgaccaccaagcgtatggagttcagtcgaaggtccgggagcgcttgcaaccatgacatcgatggggagtaatactcgttgcgatcatgaacgaaatgctttttcagctgcttgatatacttgcgcgcgtccggctcgtccgagaattgggggttgagcacgatctggagatctttgagacctgtgaactttcgcatggcttttttgtctgggagacgcccgaatcctaagaatctggtgaagtcttcgggtaggccgaantagatatgttcgagcacgattcgcangcgcttgaatgctctcaactggggcgg

SEQ ID NO: 5699 - DNA, 516 bp, Oryza sativa
  Predicted polypeptide sequence is orthologous to G618, G2057
cggcgccatgaccagtgccgcgtccgctgctggctccttccttccacattcgctgggcgcagatcgagtctccgacaacatcgagtccctgttcccctcctcgtccacagccagcggcgccgcctccgccggacgcgacgagtacaggggatccccgccggaccttctgtcgcgatgacaagcaaccagcagacgcagtcacgcaggagctatgcctcaatctggtgagcaattttaggaccgacgaagtgacacttctctgtgttggctgcctctacaggggtttggatattctgcaaaatatgtaactagaagtatatatgcaagtgatgtatagttcctgtaggttcttttgtaagtactctgggagtgattgaattatgatgaaagtgatataaaggtcctctgtgcttttattaagtactctgtaagtgattttccaaatgcaatcaaaagctgcctcaaataatttgtttccaaaaaaaaaaaaaaaaaaaaaaaaaaaaaaaaaaaaaa

SEQ ID NO: 5700 - DNA, 1078 bp, Oryza sativa
  Predicted polypeptide sequence is orthologous to G620, G1821
aatggaggccggctacccgggcacggcggcgaacggcgctgccgccgacgggaacggtggcgcgcagcaggcggcggccgcgccggctatacgtgagcaggaccggctgatgccgatcgcgaacgtgatccgcatcatgcgccgcgtgctcccggcgcacgccaagatctcggacgacgccaaggagacgatccaggagtgcgtgtcggagtacatcagcttcatcaccggggaggccaacgagcggtgccagcgcgagcagcgcaagaccatcaccgccgaggacgtgctctgggccatgagccgcctcggcttcgacgactacgtcgagcccctcggcgtctacctccaccgctaccgcgagttcgagggggagtcccgcggcgtcggcgtcggcgtcggcgccgcgcgcggcgaccaccaccatggtcacgtcggtgggatgctcaagtcccgcgcgcagggctccatggtgacgcaccacgacatgcagatgcacgccgccatgtacggtggcggcgcggtgccgccgccgccgcatcctcctccgcaccaccacgcgttccaccagctcatgccgccgcaccacggccagtacgcgccgccgtacgacatgtacggcggcgagcacgggatggcggcgtactacggcgggatgtacgcgcccggcagcggcggcgacgggagcggcagcagcggcagcggtggcgccggcacgccgcagaccgtcaacttcgagcaccagcatccgttcggatacaagtagtaacagcagcagaatggcgatcggtctgcacctgcatgcacacgtatcgcatgcagatcgagctagtagtgcaactggctaacttgaaccagttaaaaacttaagacttagtgatcgtgtgtggtttaattaatttgctacgttcaggtagtgatcgatgagattttaatttcctactgtcagtttaattcaccgttcatgtactcgatccagctagtactactcctagttacccttgttctaatcttaacgcaattgtgtcgatcggacgatcgcacgtttatcttcaagtggaatttgtcttataacact

SEQ ID NO: 5701 - DNA, 1072 bp, Oryza sativa
  Predicted polypeptide sequence is orthologous to G620, G1821
gtcgacccacgcgtccgaatggagcccgcatttcccaacggaggtgcggctgctccaccaccgcccatggcggcggagcagctgccgccggcggcggcggtggtccgggagcaggaccgcctgatgccgatcgcgaacgtgatccgcatcatgcggcgcgtgctcccgccgcacgccaagatctccgacgacgccaaggaggtgatccaggagtgcgtgtcggagttcatcagcttcgtcaccggcgaggccaacgaccggtgccaccgcgagcaccgcaagacggtcaccgccgaggacctcgtctgggccatggaccgcctcggcttcgacgactacgtcccgccgctcaccgcctacctccgccgcatgcgcgagtacgagggcggcggatcaggtggtggtggtggtggtgaccgtggcgccgccgccgcccccgccgtcgtgccgccgccgccgccgccgcctcccgaggacgcgttccgctacgtgcaggtccatcatcccgtgtacgcggcgccaggtgagccggtgcaggggtacggttaccccgtggccatgtcgtctgctctgccggcgccgcacgtgcacgtcggcgtccgcggcggcgggcagcacgaggtgttcggtggcgggccggcgcccctggctgtctactacggaggagcgccgtacggcgaggccagcagccgcggcggctgctctgccgccgacgaggggagctcgtcgtcgagcgcctcgccggcgccggtcggccccaactatgagtaaaaacaaaagaagaagaaaatcaaactcttccccggctgacaggtgatcgagctcgtcgtctacaaattatcaatcgtctgtcgatcgattagcatgtaatctaataaaaaaacttaagctagcttaagacttaattagacatgttctgttcatctttccgccaccgtttcatcgaaagagattaagaatgtggtagtagctagaaatcatttcgagctcgaattacttaatcgtgttgattaattgcaatgatgaactaacaagaggaaatgatgtagtagtattaaaaaaaaaaaaaaaa

SEQ ID NO: 5702 - DNA, 932 bp, Oryza sativa
  misc_feature (190)..(190): n is a, c, g, or t
  Predicted polypeptide sequence is orthologous to G620, G1821
ctgcaggtacggtctggaatcccgggttgagacttgagagagcatggcaggaacaaaaagcgtggtggcaggaacatggatcaggtcgagaaggcggcagtgagatcggatggggtgggaggtagtgcgaccaacgccgagctgccgatggccaacctcgtacgcctgatgaagaaggtgctcccagggnaaagcgaagatcgggggagcagccaagggtctcacccatgattgcgcggtggagttcgtcgggttcgtcggcgacgaggcctccgagaaggccaaggcagagcaccgccgcaccgttgcgccggaagactacttgggctcattcggcgaccttggcttcgatcgctacgtcgaccccatggatgcctacatccatggttaccgtgagtttgagagggctggtgggaataggagggtggcgccgcctcctccggcggcagctacaccgctgacgcccggtggaccgacattcaccgacgcagagctgcagtttctccggtcggtgatcccctccagaagtgatgatgaatatagcggctcatcaccagccataggcggctatggctatggatatggctatggcaaaaatatgtgaacaacttgatgcatgtgtgtgtgtacactgcatgcatgcgtggagggtcaaacagagtcaagactcttgtggtggtgtcataagtctctagtgaacatataagttgtgtatcgtgttccttgtaaaaaaagtcagtatgtgtgtgctcacgggaacctacggggtgggtatggaaaagaatgcgtgctaaaaaacaagggcgctaggcaagagacttgagaagcttaggcgaaaacggcgaagagagacggcactcggacctagggaacgacaggtggggttgttcctctttttgaagtgcacaaagcaccacagcaaacgagacgac

SEQ ID NO: 5703 - DNA, 2844 bp, Oryza sativa
  Predicted polypeptide sequence is orthologous to G622
atgtcgtcgccggcgcagccgcccccgacgcggccgccggtggccgccccgcccccatccctcgcggcggcggcccccatctcggtgcagccgcccccgctccagccgaaaccgccgccgcatccgcagcagccgcctcaggcggtcgtctcggttggggttgggccgccgccgccgacgccgcagcatcagcagcagcagcagggcccccccggtcacgcgccgccgcagcagcggcccaggatctgcttcaacgcgcactgcaaggaccccaaatccgacggcccgcgccgccgcggatggcgactccgcaacggcgacttcgccgagctctgcgaccgatgctatcactcgttcgagcatgggggcttttgcgagactttccatttggaggttgccgggtggaggaactgcgaatcctgcgggaagaggctgcactgtgggtgcattgtgtcggtccatgcatttgttcacctcgacgccggaggggtcgagtgcgtcatgtgtgctcgcaagtcgcatgctgcaatggcaccaagtcagatatggtcatcttccatgcatatggctcaaaatgtagctgatagaaaagacaattttgtcaagagctggagacctcctgccgggcaattttcaagccagtggcggcagaataatatgtggagtatgtccaccatgcagtctgacttgcagcagcgcctagcttttgagtttgataggcctagtggcagtgaaaaattgcttccagggcgcacttttattcatgcccatgagaagaaatttgatgacatgcatgacagatcaacaacacctgctggcatgaaccagattatgagggagaggtatgccaatgggcatactcagcacaccaccctggatccgacgtacgcttacactctctatcacagagaaggaacaaatccaaatcttcatgaccatagtcaccatgcaggagaaaatgaccatttgactgcaaggaaaggagtaacttcagatccttgttcctctgtatctactaccttcaagcttgattcacaccatccgtccattttgaaagatgatccatcagccgtaccagctgggttgtcttctaatttttcatcagcaaatggcccaaaagaccatatcagaattggaccaactcagcagcagcagcaaatggcttcctcctcattgcagaaacaattctattcccatagtgtgattgataacgattttcaagcgcaattgcgcaatggaaggcctagaatggatgcaaaggcgagatctcagttgcttccacgctattggcctagaataacagatcaagagctacagcacctatctggagactcaaattctgttattacccctttgtttgagaaaatgttaagtgctagtgatgctggacggattggtcgtttggtgttgccaaagaaatgtgctgaggcagaagggcttcccttaaaagttcaggatgctactggtaaggaatgggtgttccagttccgcttttggcccaataataacagcaggatgtatgtattggagggtgtcacaccttgcattcaatcgatgcagttacaagcaggcgatacagtaacctttagccgaatagatccagaagggaagctggtcatgggatttcgaaaggcaacaaatctttctgcagaacaggaccaacctacaaagcctgccaatggtgtactaccccctccagaagcaaataataaagttgttgtcccagattctagtcctaatgctgctgtacctcgaccaattaaagtcaacacagagagcaaaagttccagccctgtggaacaagccactgcctgtaaaattgacaaaggtgcattaccacaaaaggaagggccaggaacttcaagttcctccccactacctgtcaagagaaaggcaacttctgttggtccgaagatcaaacggttccacatggacagtgaggaatccatggaattgaagataacatgggaggaagctcaagaattacttcgtcctcctcctaaggccccttcaattgttgttgttgatggccatgagtttgaggaatatgaggagccaccaatacttgggaggaggacatattttgtgacagaccaatcaggtgagaatcatcaatgggctcaatgtgaggattgctctaagtggcgtaaactgccggtggacgcccttttgccctctaagtggacctgctctgacaataaatgggattctgaaaggtcttcctgtgattctgcccaagagataaatatggaggagcttggcgaaatgattcctatcaaacctggtgctgcaaaaaagaccaaagggaaggtagatactgacaatattgatgtttcagatgggctggacacactcgcaaatcttgcaattcttggtgaaggtgaatctctcccttcccagccaaccacaaggcatccccgccatcgccctggctgctcatgcatagtctgcatacaaccacccagcggaaagggaccaaagcacaaacagacgtgcacttgcaacgtctgtatgacagtgcgacgccgtttcaggacgcttatgatgcggcgcgagaagcgccagcagtcagagaaggactctggggtgcctcgcaaaagagagccaggtcaatccagcgagccagttccacaatctggctctggtgctcatccaaccagtactagctctcctcaccagagagcagataccaacggcgaaggtcctgaagacatgtccattgacaacaagaggacctcctctcctgtcaagaaccagattgacctgaacagtcagcctgagcgggaagacgagcagtcaccgaaatccgatgcgacgagactcctcagggacaacccaacctag

SEQ ID NO: 5704 - DNA, 2023 bp, Oryza sativa
  Predicted polypeptide sequence is orthologous to G634
aatctcccttctgcatatacagcaccctcctccttgcctcctcttcgccattgtcctaattcccatctccttgtccctttctccccgggagaaaaaccactcatacgcagtcggccaagcacttgatgcttactatgcctctgcgttagatgcttctcctgcccgtagaagctcgcggagttgggctacaagagaagcgccaagaagtgcaaggagaagtttgagaacgtccacaagtactacaagcgcaccaaggaagggcgcgccgggaggcaggacggcaagagctaccgcttcttcactgagctggaggcgttgcatgccgctgcgccgcagacgccccagccgcagcagcagcagcagcagcagttgccgccggttacaagcagcgcacccgcgatgcacgccttcgcgccgccggttcccgcgccaccgccgatgagcgcaatgccaccgccgccggggccgatccagccggccccgatatcttctgcggctcccgcggtgcccctggagctgccgccgcagccgcccatcaacctgcaaggcttaagcttctcgtccatgtcggggtccgagtcggacgatgagtctgaagacgacgagatgacggcggagaccggcggcagccaggaccgcctcggcaagcgcaagcgaggcgccggcggcaaaaggccggcgactttcttcgaggggctcatcaagcaagtcgtcgacaggcaggaggagatgcagcggcggtttctggagactatggagaagcgagaggcggagcgcacggcgcgggaggaggcgtggcgcaggcaggaggtggcccgcctcaaccgcgagcaggagcagctcgcccaggagcgcgccgcggcggcctcccgcgacgccgccatcatctccttcctccaacgcatcggcggtcagtccgtacaggtcccacccgccgccaccgtcatccagatgcccacaccggtgcagctccagacccctccgccggtcaagcaacctgccaggcagcaccagccacagccaacgccgccgccgccgcaggcggcgccaatcccagccgcgcccctccagcagcaaccgccgcagccgcagcacaaggagacgattcaccacgaggcagtgacgccgcgcagggcgccaccgacgtccggctcatcactcgagctggtgcccgcggcggagcagcacgtcgagagcgggctaggaggaggggagggcgggtcggcgtcgtcgtcgcggtggcccaagacggaggtgcaggcactcatacagctgcgcatggagctcgatatgcgctaccaggagaccgggccgaagggcccgctctgggaggagatctcgtcggggatgcggcggctggggtacaaccggagctcgaagcggtgcaaggagaagtgggagaacatcaacaagtacttcaagaaggtgaaggagagcaacaagaagcggcccgaggactccaagacatgcccgtacttccaccagctcgacgtcatctaccgcaggaagcacctcaccggcggtggcggcggcggcgcttccgcggccaatgtcgccgccacggcaatcgagcaccagaacccgaaccggcacgagatagaggggaagaacataaacgacaacgacaagaggaagaacggcggaggcggcggcgcgcaggtgcccaccagcaatggcgacacggcaccgaccacggccacgttcgacgtcgatagcggcatgaagaagccagaagacattgtgagggagctgagcgagcagccgccccgggagttcacaacggacgagaccgacagtgacgacatgggcgatgactacaccgacgacggcgaggaaggcgaggacgacggcaaaatgcagtacaggatacagttccagaggccgaacccgggcggcgccaacaccgcacctccgccggcaacaaccccggcgtccgcggtgccaacctcgactccgacgagcaccttcctcgccatggttcaataggcgcgcgaacgatgcatcaccaagtacgtacttgttc

SEQ ID NO: 5705 - DNA, 3478 bp, Oryza sativa
  Predicted polypeptide sequence is orthologous to G634
atggccatttattacctggaaagggagggattaacccacaacatgccaatgcatggccatttttatactcctctgcccctgaaccattggcacgcggataccaccaacgcggctgacatgacacgtgggcccatgcgcatgtgggccccacatgtcagtggcatgaattttatatttttcatctcaaaagaaaaggtattgatgagagtagaaatggtgagctctcctgatgtactgatcattccatcacctccattccccagtggtaacactcgtgggggaggaggaggaggaggaggtagtagcatgcagcagcagcagccagggggaggagggggaggggtgcagcagttcggcgcggtggcgccggagatgtcgccattctcgccggcgggaggaggcggcggggggcggatctccatggcggaggccgcgtcgcccatcagcagccggccgccgccggcgcagcagcagttcgacgagctcggcgtaggcggcggaggcggaggcggaggtgggtttgacgccgaggcgctggcggcggcggcggtcggcgaggagggagccagcggcggcgcgggggggaaccggtggccgcggcaggagacgctggcgctgctcaagatccggtcggacatggacgccgcgttccgggacgccaccctcaagggcccgctctgggaggaggtctccaggaagctggcggaggagggttaccggaggagcgcgaagaagtgcaaggagaagttcgagaacgtgcacaagtattacaagcgcaccaaggagagccgcgcggggcgcaacgacggcaagacgtaccgcttcttcacgcagctcgaggcgctgcacggcaccgccgccggcgtcgtggcagcgccatcgccggtgacgtcgctggccccgccgccggcgacggctgtgggggtgtccggcggggtgcgcgcccccgccgagccgccgcccgcggtggtgatggggaacgtgatgagcttctcgacgtcgaacacggaggagtattccgacgaggaggactccgacgacgaggggaccgaggacatgggcggcggcggcggtgatgagagggggaagaggaagaggttgtcggagggtggcgccgccgcgggcgtcggtggcggcggcggaggaggaggagggagcgggaagatgatgaggttcttcgaggggttgatgaagcagaagatcaccgggcagaccatcccaatgccgcccatcatcgccgcccccgccatcaccgtcatgcccccaccggcgccatcccagcagcctcagccgccgccaccgccgtctcaccccacccccatcacctccgtcgcgccagctccgccgccgccgccaccagcagcagcagcagcagcagcatcccagccatcgccgcaggccaccaagtcgccattgccggcgacgccgcagacgcaaagcagcatggacattgtcatgacggccgccgaggcgcacgacgcggggtacgacgggtccggcggcggcggggggcagccgtcgtcgtcgcggtggcccaaggcggaggtgcacgcgctgatccagctgcggagcaacctggacaaccggtaccaggaggccgggccgaagggcccgctgtgggaggagatctccgccggcatgcggcggctgggctacagccggagctccaagaggtgcaaggagaagtgggagaacatcaacaagtacttcaagaaggtcaaggagagcaacaagaagcgccccgaggactccaagacctgcccctacttccaccagctcgacgccctctaccgcaacaaggcggctctcaactcctcctcctcctccgccgccgccgccgcaccggccctcccgccgccggagcacgcggagccggcggtgacagtcgccgcgccgatctcgcagacaccgccgccgccgccgccacagcccgtgacgacgaccaagaacggcaacggcaccagcagtacaaacggcgcgaacggcgaaggaggaggaggcggctccgggggcatgcaaatgcaggcgagcaacggcagcgtcgtcgccggcaacaagttcttcaccggcgcggcggcgaagaagccagaggacattatgaaggagatgatggagcagaggccgcagcagccggcggcggcgaacaacgccttcaaccgaacggacggcggcggtggcggcggcggcgtggacagcgacaacatggacgaggacgacgaggatgactacgacgacgatgacgacgacgacgacgacgacgtcgacggcaacaagatgcagtacgagatccagttccagcatcagcaccaccaccagcagccgccgcagcaccgccaccagcagagcgtcgtcagaccgaacgccgccgcctccgcggccgccggcggcaacccgcccggcaccgccgcccccgccacggcggcggccgcaacgacgaccaccggatctttcttggcaatggtccagtgatccatccatccatccggtgactctctctccttcctacacatgcatacctccatgcgcgtcaatggcttcttcttcttcttcctcctccatctcttgtaccatttgtatctacctacctgtcgcctcctccatggctcgtccatatctcaacaccatcaaaaagctcaaaaacctaaaacctcaagaattctcttcctcctccggcatatttctccattgattcctcatgcaagctagcagctatacatctccatgccaagaaagaaaaattcgcccatttcaagctgcatgcatgcccatcgatcgttcgtcgctggatgttcctagcaagaaaaagctagtagcatcgatccatttcttgattcgttcttgtgttaattacagtggtctctcccatctcgcgtctcctcttagctagtgttaaaagcaaaaaaaaaggaattggtggcgtggtaatttattgatttgttgtggtaaatttaataaggaccctccattcgtgagggttcacggagagggtttaaaacttggtgcggtgaaaaacggcacagaggagcggtaataacacctcgctctcgcggttaaaaaaaaaggaagacaagggtatatatgcaaaatgttgcggtggttgtggttgttacaaattattacacctcggtaaaaatttgtttggctatgtgtactactgctcgatctactgtggcatgttgcaagggcgcggtgaaaaaaaaatcgaaggtgaaaaattaaagatgtgctcatcaagtgaagtggcagtgaaaaagcaagagagctggtgctggtgtatgccggaatttttcccatttctcttttttttctcttttctctccttcttttatatgttttgttttgttttttctaattacctaaactgtccattatgtattacctgagtttttttttcttcctttcccaaactgttgttaccgaagttttacagtgtatactcgcgacatattatatgttacattcttgctattcttatacc

SEQ ID NO: 5706 - DNA, 1623 bp, Oryza sativa
  Predicted polypeptide sequence is orthologous to G634
gaagcgcaccaaggaagggcgcaccgggcggcaagacgggaagagctaccgcttcttctcgcagctcgaggcgctccacgccgcggcgccgccgccgccgccgcagcatcggcagggcatgccggtggaggacccgcagccgctggcgatggcgtggatgatgttgcccggggcggcggacctcgggttcttgtcgatgtcgtcggagtctgagtcggacgatgagtccgacgaggaggaggaggaggaggaggcggtggcgccgggcggcggcggtcgggaggggcttggcgatgatggtgacggtgatggcgaagggggcagcagcaccaggaagctgatggccatgttcgaagggatgatgaggcaggtgacggagaagcaggacgcgatgcagcgggtgttcctggagacgctggagaagtgggaggcggagcgcaccgagcgggaggaggcgtggcggcggaaggaggtcgcccggatcaaccgcgagcgggagcagctctccaaggagcgcgccgcggcggcgtcccgcgacgccgcgctgatcgcgttcctccagcgcgtcggtggcgccggcggggagcccgtgaggctctccccttcgtccgccggcgccacccgccacgacgcggccgcggcggggctgcagctggtgcccgtgccggcgccgagagcgaaggcggaggacgcctgggcggcagcaggaggagacggcagcgggacgacggcgccgtcgcggtggcccaaggaggaggtgcaggcgctcatcgacctgcgcatggagaaggaggagcagtacaacgacatgggacccaagggcccgctgtgggaggagatcgccgccggcatgcagaggatcggctacaaccggagcgccaagcggtgtaaggagaagtgggagaacatcaacaagtacttcaagaaggtgaaggagagcaacaagcggcgccccgaggactccaagacctgcccttacttccaccagctcgacgccatctaccgcaagaagcacttcgctggcagaggcggcggcggcggcggcgtcacgatcgccgcctcccactccagcctcgccatcgtcaccgtctccgagcaggacaacccgagccagcgtgagctcgaggggaagagcagcaacgacgtcggcaacgtgcagctggcggtgcccctccttgtccacaacgccccagacaagaaggtggaaggctccgaaggcgaaccaaatgtcacagcagcagcggaggagacggacagcgacgagatgtgtggagaatacaccgacgatggcgacgacgacgacaaaatgcagtacaaaatagagttccagaagccaactgcgggcggcggcggcgacggcaacgacgcacccgtgccggcgacaactgcggcagcgacgagttcagccccaaccagcaacaccagcttccttgcggttcagtaggtggcagtgcgcgcagagtgagggggctaaagaaagccaggcaggcatcaccgtcttctttttcagttcaagagggtcacaattgccctattatactttttcagttgttttgctgtgatgttggcaacatcccgtataccatttgttgatttctttctgtggtaactagcaaactatcc

SEQ ID NO: 5707 - DNA, 1335 bp, Oryza sativa
  Predicted polypeptide sequence is orthologous to G635
taaggattgcatctgatggcgttatttttgtcagcatggaaatcttccgacctcagaaggaacttgcttcatcacagtcaggattgaaagggaagttcaaaataacaacaagatgcctatggcttgataatggaagactattagatgcactttacaaagctgcatatgctgcattatcaagttgtccagtgaattgtccacttagtcacatggagaggatggtatctgaaatcttgaggaaaatggtaaggaagtatagtgggaagaggcctgatgtcattgcggttgctacagagaacacaacagtgagttttgtagaagactcagaaactaaatcatctggaaagtttggatctttctcagctcctaggcattcgagcaggagttcaggtaggggtcttgaagaaagtgataaatcatgcccagagaatacagagggagaggctaaagaaaatcttcctgatgtcctgggaacaacacgtgatgatgcaaccacaagctccaatggcgaagcatttttctcctcagatttgcataagcctaaaacactagagcatttttgggactcattcaaatcccctacagctgtaaaaattgcaagaattgtcaatggttcagctcaagggagtaaatcaaagattggcaagatcagcatagtgggtaaggactctagcgatccttcttctgctccagttaaatcttcaaaaaagaacaagtggaagcctgaggaaattaagagcttaattcagatgcgtggcgaaatgaatgagcaatttcagactgtgaaagggagaatggttctgtgggaagagatatcttctagcatgttgagccaggggataagtcgtacaccagcacagtgcaagtctctatggacatcattggttcagaaatatgaggagagcaagaaagatgaggaaagcgtaaagacgtggccgtatttcttggacatggacagggttttatcaagccaaggggaaatggcaacccaatgatcccaaggccgtagtttagtggttgtaattttggagggtgatggcataatcaatcaagtggcaggatgagatggctgcagcgtgttcttctccagagaatatacatgccataattcattccacgaaaagggaggcaggcacttggaatgactaagctgctacgtattcaccatgagtgtgctacagggctagggatagctgatattatttgatcaactatactagattaagtaattgaatagctaagttttgttgtgctattatttttggtgtaagaagacaccaaatgctaatccgaaggctttcaattgagctacccacatgcctatgcgtgtaaatt

SEQ ID NO: 5708 - DNA, 1239 bp, Oryza sativa
  Predicted polypeptide sequence is orthologous to G643
atggccatggatccggacgccgcggagtggccgtgcatcatccaggcgctcccggcgttgccgccgtcgccgtcgtccaccggggtcccgaggctgccgaccatggtgcaggcgctcccggccgccacggacccgccgcccgccgccgccaggctcaggcgcggcgccgagccgcccagcccgcgccgcacgcgctccggcggcgcgccggagtggacccccgcggagacgctcgcgctcgtggccgaggtcgcggccgtcgacgacgggtggtcccgctccgtctccgccttccagaagtgggccatcgtcgccgagaacctcgccgcgtcgcgggggagggcggcgcgggggagggggagggggagggcggcgagcgagtgcaggcggcggtgggaggcgctcgccgcggagtacggggtggttcgccgatgggaggtgcggggtgcgggcgggtactggcggatgagcgccgccgccaggaggaaggccggcctccccgccgacttcgacgccgaggtctacggcgccatggaggctctcaccctcgtcgaggaggcgcttctcgccgatgccaccgccggtgctggtggtgctgagattggtgaaaagagcgccgccgccgctgaggtcggagaaggcgacgaagttgaggctggggaagaggatggaaatggagatcgcggcgaggttggagaagaggatgaaggtgaggttggagaagatggtgaggaggaggatggcaatgaaatggtggaggtggaagacgatggcaacgccgacgacaaagacgcgcaaccagatggtggaaatgctgctgcttctgatgatttggaagtctgcgaaacgggagcaaacaacgagggcaagaaaagccaaaccgatgcatgtgaactggccaacaagttacaagagaacgcgcagcacatccatatgctactcaaagaggaggcaggcgaaaatgagaaccataaccttgctatctcatcggattctatggaaaccactcgccaaaaaggtgatgagctgatcaaatcgctaggtgggcttgtgagctacctgaaccaattcactgatctgatcaaggagaatggattcgagaatgtcgtcggtttgtggcagacattgctacctgcattggcatcaccatttctcagcgccattgtgtacttcagtgtctggcaatctgctgttctggggcgtttctctgcactgtacagcagaatcccaggattttag

SEQ ID NO: 5709 - DNA, 2316 bp, Oryza sativa
  Predicted polypeptide sequence is orthologous to G646
tgcagagatagggaggaggcataattccactcactgccccaaccacaggacattctcttctctctctcccttctgctcaagaaatccaccagctgctgcatcaggaggtggagctcgctcgtcgtcttcgtcttcgttgcgcttcgtctcctcaggtgcccggaggagcaagaattgttgggggggcagcgaggtagacgcagttggagagccctcttgcatggatgcagcccactggcaccaggggctagggctggtgaagcccatggaggagatgctgatggcagcgaacgcggccgccggcgcgaatccgaatccggcggcgacggcgccgtcgtcggtgactgggggcgcactgaggggcggcggcggcggcggcgcgccgccggtggcaggtggcgcgggggcgggtagcacggagcggcgggcgcggccgcagaaggagaaggcgctcaactgcccgcggtgcaactcgacgaacaccaagttctgctactacaacaactacagcctccagcagccgcgctacttctgcaagacgtgccggcgctactggacggagggcggctcgctccgcaacgtccccgtcggcggcggctcgcgcaagaacaagcgctcgtcgtcgtcggcggcatcggcgtcgcccgcgtccgcctccacggcgaattccgtcgtcacgagcgcgtccatgtccatgtccatggccagcacgggcggcggggcgtccaagaacccgaagctggtccacgagggcgcgcaggacttgaacctggcgttcccgcaccacggcgggctgcaggcgccgggggagttcccggcgttcccgagcctggagagcagcagcgtgtgcaaccccggtggcccaatggggaccaacggccggggcggcggcgcgctctccgcgatggagctgctccgaagcaccggctgctacatgccgctgcaggtgccgatgcagatgccagcggagtacgccacgccggggttcgcgctcggtgagttccgcgcgccgccgccgccgccacagtcgtcccagagcttgctcgggttctcgttggacgcgcacggctcggtgggcgggccatccgccgcggggttcggctccagcgcggggttgcaaggcgtgccggagagcacgggcaggttgctgttcccgttcgaggacttgaagccgacggtcagctctggcactggcggtggaggcgcaagcggcggcggcgccggcgtagacggcggccatcagtttgatcacggcaaggagcagcaggccggtggcggaggcggcggcccaggcgggcacgacacgccggggttctggaacggcatgatcggcggcggcagtggcacttcttggtaatgcggcggcggcggccatgcatgcatgcatggctcatgcaaaagcctccgcgctgtggtggcgtgggttcaaattggagataggcagtagagacgacgagggttttaataagaggttggcattggcgataatccatcactgattcactgttactccgtataaggtgttttgatctctcttcttcttctttcccggtgttgcatcatcatcttggtgttctttcttctcccttttgctgtctttcatgtgattgttgatcggctttggtgctcaacacaacaaccgagctcacatgattcctcaaaaggatcatgatgcatgatcgatctctttctgaattctgatcttccagttctctccattgatcactgttactactagtcatcgcttgatcgatgtgtggttagagagctgcatgcgtcagtgcagtactagactagtagagcatgggaagcttctttttaggctggcttcgagtccgatggcgtgtacgtacgtggtacacaggcatgcatgtggtgtgtagctcattggttttgcaggggcattgtgaagcgaaggatgaagggaaggactcggttggggaggaagaaagaaaaatggacccccatcaccatgcatgtatgtcaaacttagctacagtatgtttggtaacggcaatgcatcaagcttttggttgtagatgtagatcttgggaagggtttgcagctgatctatgactttgtgttgatccaaacagtagtgattccatccttttctagcttaacttgttattgttgttaacttctatgggatgtgtagaggtcatataaagttatagtagtagtagttgcaaaaggggtttttgagcgcatgtaatttaatttgtatagtactcctactatcttattgttatatttacagccaaactataatgcacatctttttgctccttgtttctgaaaaaaaaaaaaaaaaaa

SEQ ID NO: 5710 - DNA, 518 bp, Oryza sativa
  misc_feature (55)..(55): n is a, c, g, or t
  misc_feature (73)..(73): n is a, c, g, or t
  misc_feature (150)..(150): n is a, c, g, or t
  misc_feature (159)..(159): n is a, c, g, or t
  misc_feature (254)..(254): n is a, c, g, or t
  misc_feature (451)..(451): n is a, c, g, or t
  misc_feature (467)..(467): n is a, c, g, or t
  Predicted polypeptide sequence is orthologous to G646
tggagagccttgaaaattgggccacataatggtgaaccaataaatgggtgggccnactgctgtgtggccgtgnggcccccttgtgaaaattgtgaaggcgaatataagcgcgacttttgaattcttgacggcgcccggaataggccctanttgtggtanacgattgcgggggatgcaaggggctaataagcttgtagtaacccttgccttgtgtgcaatgggcgcaatttgggcctacctgttgaggatacctntctggcgggaacctctggtaacggatgggtgatttggaaataagaaagtgggaagctgaccatggattgggaaaccacatgctgtgttgttgctgcttgctgtggtaccataagtggttgtaatacttaatgatcgcaagtatgatgcactgcaaggctgtgtaacccatggcttatgattgctactgtagaacctngtaatcatgggtaatncccagtcaaagcagataatattactatctagctaaaaaaaaaaaaaaaaaa

SEQ ID NO: 5711 - DNA, 1744 bp, Oryza sativa
  Predicted polypeptide sequence is orthologous to G646
gatgttcttgcttcttggttcttgctaattgtctagtattgcataacttagttctaggtttgtgttgatacttgcaattgcaacatctaatggagtgcaacgacatgtgtcaatcaccaggggctagggctagtgaagcccatggaagagatgctgatgggtgcaaatccaaatcctaatgggagctcaaatcagccaccgccaccgccgtcctcggcggccagcgcccagcggcctatcgccccaccggcggctggagcggccgccggcgcgggcgccgccggagctggggctggcacggagcgccgcgcgcggccgcagaaggggaaggcgctcaactgcccgcggtgcaactcgacgaacaccaagttctgctactacaacaactacagcctccagcagccgcgctacttctgcaagacgtgccgccgctactggacggagggcggctcgctccgcaacgtccccgtcggcggcggctcacggaagaacaagcgctcgtcgtcctcggtggtgccgtcggcggccgcgtcggcctccacctccgcggcggtgtccggctcggtccccgtggggctggcggccaagaacccgaagctgatgcacgagggagcgcaggacctcaacctagcgttcccgcaccaccacggccgcgccctgcagccgccggagttcacggcgttcccgagcttggagagcagcagcgtgtgcaaccccggaggcaacctggcggcggcgaacggcgccggtggcaggggcagcgtgggcgcgttctcggcgatggagttgctgaggagcaccggctgctacgttccgctgccgcagatggcgccgctagggatgccggcggagtacgcagctgcggggttccatctcggcgagttccgcatgccaccgccgccacagcagcagcagcagcaacaagctcagaccgtgctcggtttctccctggacacgcacggcgcgggtgcaggcggcggctccggggtgttcggcgcgtgcagcgctgggttgcaagagagcgcggcgggcaggttgctgttccccttcgaggacctgaagccggtggtgagcgccgcggctggcgacgcgaacagcggcggcgatcatcagtacgaccacggcaagaaccaaggtggtggcggcggcgtcatcggtggccatgaggccccagggttctggaatagcagcatgatcggcaacggcagcagcaatggcggcggcggcggcggttcttggtaaggtggtgcgagctgctactgcttgcccgccgccgccatgcatggctcatgcatgcacgcgtggtggtcagcagctagcagcatgtggagatagagaaacgagatagagacaaggggggttaataagcctgtggtgattagtgttacatatggcgttttgtttctctttgctttgtttggtttttcggtttcatggtgttgcttctttgttgtttgttcatgtgtgtgtggttaattatcggcttgggggctggctaacacagcaggatacacagatttttaagggtggtgaacttggtgatattatacagctgctgatctattcaccaatcaatctctcattttgtgatttaatcatgtcatgtagaatctgcactgaagcatgatactcttatcatttttttagttttgatggctgtgtgtgtgtccacggacggtacgtacgccgtttgagttactgtatgtagtctgaacaaacaacatgttggttagttgcatatgtc

SEQ ID NO: 5712 - DNA, 1083 bp, Oryza sativa
  Predicted polypeptide sequence is orthologous to G646
atgctgatggcagcgaacgcggccgccggcgcgaatccgaatccggcggcgacggcgccgtcgtcggtgactgggggcgcactgaggggcggcggcggcggcggcgcgccgccggtggcaggtggcgcgggggcgggtagcacggagcggcgggcgcggccgcagaaggagaaggcgctcaactgcccgcggtgcaactcgacgaacaccaagttctgctactacaacaactacagcctccagcagccgcgctacttctgcaagacgtgccggcgctactggacggagggcggctcgctccgcaacgtccccgtcggcggcggctcgcgcaagaacaagcgctcgtcgtcgtcggcggcatcggcgtcgcccgcgtccgcctccacggcgaattccgtcgtcacgagcgcgtccatgtccatgtccatggccagcacgggcggcggggcgtccaagaacccgaagctggtccacgagggcgcgcaggacttgaacctggcgttcccgcaccacggcgggctgcaggcgccgggggagttcccggcgttcccgagcctggagagcagcagcgtgtgcaaccccggtggcccaatggggaccaacggccggggcggcggcgcgctctccgcgatggagctgctccgaagcaccggctgctacatgccgctgcaggtgccgatgcagatgccagcggagtacgccacgccggggttcgcgctcggtgagttccgcgcgccgccgccgccgccacagtcgtcccagagcttgctcgggttctcgttggacgcgcacggctcggtgggcgggccatccgccgcggggttcggctccagcgcggggttgcaaggcgtgccggagagcacgggcaggttgctgttcccgttcgaggacttgaagccgacggtcagctctggcactggcggtggaggcgcaagcggcggcggcgccggcgtagacggcggccatcagtttgatcacggcaaggagcagcaggccggtggcggaggcggcggcccaggcgggcacgacacgccggggttctggaacggcatgatcggcggcggcagtggcacttcttggtaa

SEQ ID NO: 5713 - DNA, 909 bp, Oryza sativa
  Predicted polypeptide sequence is orthologous to G646
tggtcctgcaggtacggtcggaattccgggtcgaccacgcgtcgcccacgcgtcgcgacacctccaaccgcgccggccgacgttccaggaccaccaacagctcctccgaccgcagcagcagtacaccggcgcaccgttcggttacggcaacctgcagcaagccggcggcgccggcaccggcgccggcgacatgttcagccacgcgctgagctcggccgaggacaggttgctcctgcagagcctccagtcagctcagatgcctacttccgccgctaaccacagcgctaatggttacttcgcctaattaaccaacggttaatcgaagacacatcacaagcaaagaagattcatggaccagttgtgtttaaccccctacaagttaattttaccctctcctcgatcgtgtgcaatttcttttcttcttattactttcacatgtttgttcagttaagagagaagatcactaaaatcagctgatcagctatccatgctgcagcgatgtaaatactcctaattttttcttcaattcgatttcgctctttggtcaaaaaaaaacacacaacaacaaacaaacacaacaacaaccacgaaaacacaacacaccacataccagaccaccaccaccaccacaacacacaggggggccgctctaagggactcaagctacgtacccgtgattgcacgtcaaagcctctatagggtcccaaactcaatccctgggcgaggtttacacgtcggactggaaacctggcgttcccacttaatgcttgaggcaatccctttcccacgggtatacaaaaggcgccgtgtcctcccaagtggcccgagtataggagcctatggggaaaaggggttgtgtcccgacgaattacgcagcgcatagtcacttcacggcccaaagaccggtac

SEQ ID NO: 5714 - DNA, 581 bp, Oryza sativa
  Predicted polypeptide sequence is orthologous to G646
tagtgctacacaactaaacaagaaggaggttcagtcaaacaagtcaaggagaattagaacttggattgataagctacgcaaggggaagcgcaacaatcctaaatctgcaaaaccaacaaaagggagtaaagaaaaatgatgctttacagccacaggtacaagttaaggatgatggcagccacaaagaaagagacgtggagcttcaacaatacaatatcattagcgattttacccaccttgtgacagcaccaagttgtgatgatgatattctctgtgatcaagatctgttctaatctttgcaagatggttagatggcttgtggacagcatggttatatggcttttgtacaggatagtttgatgtttttggacaggaatggttagatgccttctcgacaggactaactatagtattttgtggtctctgtttagtattttggacagggccaacgatagtattttgtggccaaattgtacaagtgaatatggcctacccttggaatagttttctatatgctccacatactagtttgaatgacatgtacgatccaaaaacttatctcacaacattatcaacttcta

SEQ ID NO: 5715 - DNA, 1682 bp, Oryza sativa
  Predicted polypeptide sequence is orthologous to G651
acttgttttctttcagtctttctttcttcttcttgtttgctgatcttgttccttggtggaaggatgcttgtcacctactcctttttgagttccccactctcctcacacttgttctacctctcttccccataaaactattatcatctttggagccaaaagccaaccaagaggagaaagcaaagggaggagaaaagaagcaagcaaagcaaagcaagaagcaagaagcagctgctcagctcagctcaagcaagtaagtgaattcttgcttgatcgatccatcgatcgatcgatcggtttgctggtgatggacaagcacacttgcaagctctgcttccgccgattccacaatggccgcgctctcggcggccacatgcgctcccatgtcatggccgccgccgcggccgccgcgtactgtccgtcgtcgccggcgatgtcactggcgtccacgtcgtcgacggagatcgagatggatgagaagaaggagatgacgaagaagacggagcaggagaagacgctgacgtcgtacgtgttgcgcgagaatcccaagaggagctacaaggtgagcgccggtgaattctccggtggtggtggtggtggtggtggcggcggcgagtcgtcggtcgtgcaggacggcgagagcgacacggagtcgtccccgccgcgcggcggagcggggtcgttcttcgccgtgagccggaggcggtcgaagcgggcgcggcggcggcgtcgcgcgccggatcccgaaccggcgagcagcgtctccgacgcgacgacggaggaggacgtggccatgtcgctcttgatgctgtctcgggactcgtggacgcgttccagatccgagcacgagacccaccaccggggggcgagctcggaggccgagcagaacaacaacaacgtcgtcaacgtgttcgacgaagaagacgaggacgcccgcgacgtggccggcgaggatcacgacgaggagctcagctacggcggcggcgaggcggcggcggcgcgccaccgcaccagcaggttccagtgcggcgcatgcaggaaggtgttccggtcgtaccaggcgctcggcggccaccgcgcgagcctcaagagaggcaagggcggcggctgcgtgccaccgccacgtccggcgccggcgagctccgccgccgcgccggccatccacgagtgcccattctgcttccgcgtgttcgactccggccaggccctgggcggccacaagcgcgcccacatgccatccggcggcgcgcggtcctcgccctcgccgtctccggcgaaatgcggcgagagctccggctccatcgatctcaacatgccggcgacaatggaggacgacttcgagctctccgccgtgtacgacgccgagttcgccagcacgagacagtgaccacacaccaccaaccagctgatcatccatggctgccgactccagatcaccaagaaatcggtaggacaaactgcttcctagctgcatgcaaggatggattcattcgaggtaagaagctctgcatctcttgcaagaaccagaataccagatcatggagaattctctgtcttgttgcttaagcttcagttactgttgctgttgctgctattgctagagctgaaaattcagttgagcagctgaaaattctttttttcattttgggcgctctgtatctaaatcaaattgatatttttgctcc

SEQ ID NO: 5716 - DNA, 1792 bp, Oryza sativa
  Predicted polypeptide sequence is orthologous to G651
ctgcgtactactttagctccccgtttgctccatggatcctctcctcctcctcctcctccagctagcttgctgctagcttgaccgcttcttcaatcttgatccgtccctctcactagctcgattgccttttcatcattcacattgttcttcttcttcttgatctgatcgagtattcgacttctctcgctggttggttggtttcttgatccgccatggacgacgacgatgtggtggtgcttagtagtgctagtgcgacgcggcacagctgcaaggtgtgcgggaaggggttcgcctgtggccgctcgctcggcggccacatgcgctcccactcgctcacggaggtggacgcggtggcggcggcggtggcgccggcttacgagcgagccgatgacgatgagggcggcgacgggaagacggtgcggcggtggatgcagagcggcggcggatatgggttaagggagaatcccaagaagacgcgccggctctcggcgggctccggcggcggcggcggcggcggcgacaacgacgatggagacgcgtgccatcaccgcggcggcgatctcctgtcgtcgtcgtcgtgccggccggtgctcggccgcgtgcgcagccatgcgccaccggcaggcggggcggcgtacgccgacgactccgaagatgtcggcgtggacgtggacggcggcggcggcgacgatcgttaccgggaccgggagatgctggtgatggcggctccgaggcggcggccgcggtcgatgcgcgtgccggcgcccgtgcgcgacgagttcgtcgtcgacgaggagccggaggacgtcgccctctgcctcgtgatgctgtcgcgcgacaccggccggccatggaactcgagaccaagcgacgagtactcatctctcatgtacaacagcagctaccaccaccaccacgacgccgtctccgacgacgatttggagttgtccctctcctccccgtacgcggacaccgagatcaggaccaagaagaggaggaagacgacgggtgcggcgagcaccgccggcggcgagaagcggggccggtacgagtgccacggctgcggccgggctttcctgtcctaccaagctctcggcggccaccgcgctagccacaaacgtataaacagcaattgcagccttgtcaaacctccggccgatcagccggagccgagcatcgaaacatcgttcagctctgcctcgacgtcggtgtcaccagctgacaccatgatcagcgcggccaccatctcgaagacggtgaagaaagcaactaaattcgtgtgcccaatctgctccaaggagttcggctccggtcaggctctcggcgggcacaagcggtcgcactcgatcgcaggcgagctctacgagcgcggccacgccgacggcattgtcaagctggagcaacctttgctcgccgacaggtttcttgatctcaatctgccagctccaggaggagatgatggctgaagcttaattaggaggagatgatggctgaagcttaattttggttcctccaagttttgacattttttggggagagcatgggtatgtacagattcagattcaattcattcttttggagtttcagcttagttgatcatgagggattaaataattatattgttaggtctttagttaattactccagatttttcgaccagttttgttttgaatttagtgctttttgttagctctgttctgtttttgctccacattgggaggaaaataagaacatcatatgatctcaattgagaactggtacaatgaaatgcttccagaaaagatttcagttg

SEQ ID NO: 5717 - DNA, 1473 bp, Oryza sativa
  Predicted polypeptide sequence is orthologous to G651
atccactgcgtgcgtttgtaacttcctccgcagctatctcccttgctctcgccatctcgccattctagctcccgcaaagctctccccccccgaggcgagctctctctgctcccgagcgagagctctcgccatggcgaagaacgcatgcaagctctgctaccgccgcttcgctagcccacgcgccctcgcggggcacatgcggtctcactctgtggcggccgccaacgcagccgcggctgcggcggcggccgcagccgcgaagctgcagatctcatcggcgtcgtccgcgtcgacgtcgttcaccgcggccgatggggaggaggaggaggaggaggaagaggagggcgtgggattcaagaagcccctttccatctacgcgctccgggagaatcccaagcgcagcctccgcgtctccgagtacgcgttctccgaccgcgagagcgaggccgagtccaccccgacgcccgcagccaagggcttacgcgccggcggcggcggcggcggcggcgatggcgagcccatgagctcgttgtcgtacgcgggaacgccggaggaggaggtggcgctggccctcatgatgctctcccgcgacacctggccgtccgtcgagcgcggtggcggcgggggcgagtactcggacgacgggagcgacgacggctacgcgctccctccgccgtctcccgctccggcgccggcgccggtgccggagaagcggacgcggttccagtgccccgcgtgcaagaaggtgttccggtcctaccaggcgctcggcggccaccgcgccagccacgtccgcggcggcaggggcggctgctgcgcgcctcccgtcgctcctccccctcagccgcatccgcagccgccattgccggagcacgacgcgggcgaggaagacatggacgggaaggcgccgccgcacgagtgcccctactgctaccgcgtgttcgcctccgggcaagctctgggcggccacaagaagtctcacgtctgctccgccgccgccgccgcggcccatgcacagacacccggcggcggcgctcctccgccccagcccaaaattctcggcatgatcgatctcaacttcgcgccgcccgtggatgaggtggagctctccgccgtgtcagatccccacttcccctccaatccaccaggtccttgaagcaagaaaaccagacttggcaatggcggagatgatgatctgaggtgaggcataaatcgaagaaacagaaagaataacaaaaagagggaaaaaaaaagagaagagaaggataaacacaagaacatattttttagccccttagttaatcttctggtcgtaccttttagtattccattccattgatttgtgttcagaatgtttaattaatatgttactaccatgctgttgctttgtttttttttgcctgtttaagctatggaatcgatgtagatttgagcaactgacagtgcaacaagaactagcccctgttcttgatc

SEQ ID NO: 5718 - DNA, 1339 bp, Oryza sativa
  Predicted polypeptide sequence is orthologous to G651
gctccgtttcctctgaaagctcgtatttttagctctcctaagctctgtgcctcatcaagctctatccaagctctcgccatggccaagaacacatgcaagctctgctaccgccgcttcggcaacccccgcgccctcgccggccacatgcgctcccactcagtcgccgcctcgaggtcgcagatctcctcgacgtcctccgcgtccacatccgtcgcggtcggcgacgacgacggcggcggtgatgccaagaggcccatccagggatacgtgctgcgggagaagcccaagcggagggtccgcctcgccgagtccgacttctcggatcgcgagagcgagacggagtactactcctcgccgcctcacggcaagcgcgcgaacaccggatcgggcgatgtcgagcaggtgagctcggtgtccgacgccacgtcggaggaggacgtagcgctgtccctcatgatgctctcccgcgacacctggccagccacgccgccgccgccgccgccctaccgtctccgcggcgcaggctacgacgacgggagcgacggtggcgacgcacctccggctccggccgcagcggccgcgcagaagcggacgcggttccagtgccccgcatgcaagaaggtgttccgatcgtaccaggccctcggcggccatcgcgctagccacatgcgcggcggcaggggcggctgctgcgcgcctccgcctaaccctcctccttctcccgctacgcctctccagccattgccggagtgcgacggcggcgaggaggagggcgcgaagccgcatcctcacgagtgcccctactgcttccgcgtgttcgcgtccggccaagctctgggcggccacaagcggtcccagctgtgctcagccgcggcggcggccgcatcgggcgacgatattccagccatgattaaaagcaacggcttcattgatctgaacctcccggcgccgttcgacgacgtggagctctccgccgtttcagatcctttcctctcctcgaagccaggttcttgaaagcaagcagagcatgagagagcgagcatactggctgttcagtgctctctctcctttcggttgattccaaagaagatggttagagctatggattcgagagaaagagctgcttaaccaggcagccgaaaaggtaaagaaaatatcataaaaaggagacatctttgctttggtagttttttttttctcagttgttttgttcattcagctacaaaaattgcttgatgctgtcctccattctgttctgtctttttgtttgtttcaagctacccgaacagtgtacattggggcaactagcagagcttagcatcttgcttacttcttgatc

SEQ ID NO: 5719 - DNA, 984 bp, Oryza sativa
  Predicted polypeptide sequence is orthologous to G652, G1335
gattcgcttccactcccacaccgatctagggtttctagggttttgggttgcggcggcggcggcggcgagagggcgagggcgaggtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccgagaagaaaatattcatcagct

SEQ ID NO: 5720 - DNA, 963 bp, Oryza sativa
  Predicted polypeptide sequence is orthologous to G652, G1335
gattcgcttccactcccacaccgatctagggtttctagggttttgggttgcggcggcggcggcggcgagagggcgagggcgaggtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagcctcaacgacggcgacgtcgtcgagttctccgtcggatccggcaacgacggccgcaccaaggccgtggacgtcaccgcgccggggggcggggcgctcaccggcggatcccgtcccagcggcggcggggaccgcggctacggcgggggcggaggcggcggccgctacggcggtgaccgcggctacggctgcggtggcggcggctacggcgggggcgaccgcggctacggaggcggcggcgggtacggcggcggcggcggcggaggcagccgcgcgtgctacaagtgcggcgaggagggccacatggccagggactgctcccagggaggaggcggcggtggtggctacggtggtggtggcggcggctaccgcggcggtggtggtggcggcggcggcggcgggtgctacaactgcggcgagaccggccacatcgctcgcgagtgccccagcaagacctactaggcgctgctcgcggcgtcagatccagctccctcccatgatgcgttttgctccccctccctcactgaatcaccgagcagcgggtgatcagttctatcttattagtagtcgtagatctcgttaggaaagctatggatctatcggttcgtcgtcgtcgtcgttctatgtaatgggatgggagtcttggagtggtttaatctttttgtttcgttgggtcggtttgagagacaagccatggatttgcactgtctgatctatctatgaatctatctattatgaaccg

SEQ ID NO: 5721 - DNA, 1224 bp, Oryza sativa
  Predicted polypeptide sequence is orthologous to G652
agaagggttcgtctccatcctcgaagctagggtttaaggcgaggaggggtgaggtgacgagattggaggcgaaggctaggagaggcttgcgattttcctctggattcacagattcccgaacttttgcggaagtggtgagagaaggtatggatcgtagaccgcaaggggggtggcagccggtgaagcggcgatttggggaagaggggaggggatttcgtgacctcaccgaaggggagttgagggagagattgcagagggaaagggcgagagaaggggagagagagggaagcagggagcgaggtggtgaacagcgcggacctcggtgttttggatcaccggtgggacgccgggaggggggcaggggagctggtcgcggcgacgagaactggcaaggaggtcgtccagatgtggcgcggcagggcggcggtggagatggtggctggcatgggggaagaggggatgggggcagacttggaggaggaagagcagaagttatcaaatgcttcaagtgtgctcaagagggacaccttcaaatcgactgcccgaaccctccaatctgctatacatgtaagaaatctggtcatattgctgcagaatgttcaaatttccatcgcaaggggattcatctgtgcggatgtgggattgctggccagtgctttaatagcatgacgattgagactgatgggggagaagatgatcagattcctatcagggggatattgactgtaattagtggagaaggttctgtggatcagatagaatggaagctgaagtacaaattgtttaagggagttgtgggactggaaggtgactgcaatcagtgagaaaactttcctgatatctttcccttcaaaggaggctaggagagagctgacaaaatttgatggttttgatttaagttcctctatcaaagctaaggtggaggagaccaacaggacagaggaatcttttgctgagctaagagaagtttgggtcaaagcttatagggtgcctagaattgctagaaaggaggagttgaaagatctatcatatttggttggggagccaattgaggttgatgagacaagtttgagaggtttgggaccggttagggtcaaggtggcagtatgttcaccggaggaaattcagggaagcacctctgtgttcataaacagggtgggatatagaatcagatgggagactgaagaaggaaacatggagcaactgaatccttctccaaagaag

SEQ ID NO: 5722 - DNA, 1398 bp, Oryza sativa
  misc_feature (1308)..(1308): n is a, c, g, or t
  Predicted polypeptide sequence is orthologous to G652, G1335
acgcgttcgcccacgcgttcgcgccgcatcacctccgccgccgccgtcgccgccgcatcgcgcctcctcgtccgccgcgcgccgccgcgcctgctgcgccggttaccccgcgcggcgctcgccgcctctcgcccgtcgccgccgtcgtcgtcgtcgtacggtgcagcagccgtcgccctcggccggcagccgctcggccaccgcgctaggatgggacacaccgccgccgccgccgccgccgcgggccccgcgctcgggctcaccaagcccaacgccgtcgagccgccgcaggtttcatttgctgctaaagacgtcgagatggcgtcggagagggtgaaggggacggtgaagtggttcgacgccaccaaggggttcggcttcatcacccccgacgacggcggcgaggatctcttcgtccaccaatcctcgctcaagtccgacggctaccgcagactcaacgacggcgacgtcgtcgagttctccgtcggatccggcaacgacggacgcaccaaggccgtggacgtcaccgcgccggggggcggggcgctcaccggcggatcccgtcccagcggcggcggggaccgcggctacggcgggggcggaggcggcggccgctacggcggtgaccgcggctacggcggcggcggcggcggctacggcgggggcgaccgcggctacggaggcggcggcgggtacagcggcggcggcggaggcagccgcgcgtgctacaagtgcggcgaggaaggccacatggccagggaactgtcccagggagggggggggcggcggtggctaccggtggtggtggccggcgggcggcggcggggttgttacaacgtgcgggcgagaccggggccacattcggtcggcagatttgcccccaaggaaagaaccttacttagggcgcgctgtgtcgcggggggtacagattccaagggttcccttccccattagttccgtttttgggtccccccccttcccctccaattggaattcacgcggagacaggggggttgaaccgggcccaaccttaattaaggcaagccagaacgctccccggttcggaaaacagctatgcggatccaaacacgcgttccagcccgaccggcacggccggcctatattgtacccgcgcgactggggaagcccttcggagagtggggggttaaaaccccttttattagagttccgaggatggggagtcacggggtttagaaaaaagagaacaggggccattgggagatttttgcgagccgttgggtagaggcctctaattctttagagaaaagatcatcagcttgaatatantatgaagccgccggctgaataagaagaagttatttttctctatgacggggcgagagagaaggagaaacagacacaacagacgaaacagag

SEQ ID NO: 5723 - DNA, 673 bp, Oryza sativa
  misc_feature (510)..(510): n is a, c, g, or t
  misc_feature (539)..(539): n is a, c, g, or t
  misc_feature (583)..(583): n is a, c, g, or t
  misc_feature (606)..(606): n is a, c, g, or t
  misc_feature (622)..(622): n is a, c, g, or t
  misc_feature (627)..(627): n is a, c, g, or t
  misc_feature (633)..(633): n is a, c, g, or t
  misc_feature (639)..(639): n is a, c, g, or t
  misc_feature (644)..(645): n is a, c, g, or t
  misc_feature (660)..(660): n is a, c, g, or t
  Predicted polypeptide sequence is orthologous to G653
cttttccgtttcataaatttctgattaaatttgaatcatgccattcaaaccaccagaggcttccaaatgcccaaaatgcaaccaaagtgtctttgctgccgaagaagttccagcagctggcaaaaaatggcacaaaatgtgctttaaatgtggtctttgcaaaaaaatgttagaagctatgaccatggctgaacatgaaggtaacatcttctgcaaacaatgttacggtcgtaaattcggaccaaaaggtgtcggtttcggacaaggtgccggtgccttaggtatggatactggtgaacatttgggaaacaaaagtggatccgagatgagcaacaaacccaactatgctccaccacctggcgttggtcaacaagaagaataaactggacaaattcgatcttaacatcttagtccattgattctcatgtaaaaacagtctctgttcagatgaaacagaagtttatttctctttttcttttttcatatatcttcactcgttttttttatacnattccctttagaaacatcctctctttaanaacctgtttctttctattcttattaccctcataatttcattatnattattaattcataccagatatnatatttgttatattanagacnagaccnacactnatatnnatcaaagaacaaaanaaaaaaaaaaaaa

SEQ ID NO: 5724 - DNA, 962 bp, Oryza sativa
  Predicted polypeptide sequence is orthologous to G653
aaaatcccattgctcacccgcgttatataaccgcggccggccattgggagggacgccgcgaggggtgctcgtttcagcgcgggaggagatcagatcgggctcagatcttccagctcgccgcgccgcctccgccgccgcagcaggaagagagagggtgaggagaggaggaggctacgatgtttagcgggacgcagcagaagtgcaaggtgtgcaccaagacggtgtacccgatggaccagctctccaccgacggcgtcgtcttccaccgctcctgcttcaagtgccaacactgcaagtccaccctctcccttggcaactactcctcgattgaaggagtgccatactgcaagccccatttcgagcaactgttcaaggagaccgggagctacaacaagagcttccaatcacccgcgaaacccgcatcggagaagttgactcctgagctgacaagatcacctagcaaagccgcacgcatgttttcagggacacaggagaagtgtgccacttgcagtaaaacagcgtatcctctagagaaggtgacagttgaaggacaggcctaccacaagtcctgcttcaaatgttctcacggtggctgtgccatttcgccatccaattatgcagctttggaaggtatcctatactgcaagcaccatttctcccaacttttcaaggagaaagggagctacaaccatctgatcaaatgcgcatcagtcaagcgcgccgaagcacagccggcaccaccaccggccgctgcagattcctcctgaatgtaccatatctccagtgaggcttgagggcgaaaattcggaagccctctgttttacaacctgcttgtatgccatgttccagttctgaggataccgggacctatcaatttcgtgtcctctgctgtgctagactcgatcacattggtgaaccatgaatatcatgtccctttcaaagaaatcgttgtgcaagtactg

SEQ ID NO: 5725 - DNA, 2367 bp, Oryza sativa
  Predicted polypeptide sequence is orthologous to G657
atgacaagcgataacggaaaggctccagataaggatggagagccttctggacctccgtcggctcctcaagaaggagaaatcagcaatgaaccaaaaaggcgacgacctctcaatgggaggaccaccggtccgacacggcgttccaccaaaggaaattggacccctgaagaggatgccatattgtccagagctgttcagacatacaacgggaagaactggaaaaaaatagcggaatgctttccggatagaaccgatgtacaatgcttgcacaggtggcaaaaggttctaaaccctgaattagtcaaagggccatggtccaaagaagaagatgaaatcattgttcagatggtaaacaaacttggaccaaagaaatggtcaaccattgctcaagctttgcctggacgtataggaaagcaatgtcgagaacggtggtacaaccatcttaaccctggcataaacaaggaggcatggacacaagaagaggaaattaccctcatacatgctcatcgaatgtatggaaataaatgggccgagctgacaaaatttttaccaggaaggacggacaattcaattaaaaatcactggaacagttcagtaaagaagaaagtcaattcatacatgtcatcaggtttacttacccaagtttcgtgtctccctctaaatgaatattctgcaaattgtaattcctcaccagcgatgacccaacaaaacagtgaagatagtggttgttttgctgtccgagaggttgaaaattcatcagggtgtagtcaatcatcacttgccaaggtttcttgctcccaagtgcatgatactactgtgccattgggctgtgatttgcaagtaaacgcgaattttgacaagaatgaagcacatgattctcaatcttccatgggtccccaagcatgctatacttctgcggaggctgttgcatctgctttgcctgctgtgcattgccatgtttcttcctctaacttggatccagatcaacacttgcaagaggactttgctcaaggactgaatttggacatgactatagatgaaatgccaactgttcctagttttgcagacaaccagactgtttgtagtatagaaaatcatgaaagatctctggagccatatgatgtagcaatggaggtgcctctctctatgttatcaagtgattctggagctgagcaaaaactacatttcatgtctgaggctgacttcaacagtcctaactgtctgaaatctgaactctggcaggatatttccttacagggccttctttctggacctgatgcagttgaagctgattcaatttcaagatcaaatcaccaatcggatgtatattcctctgaagcagatacccattttttagcaccaccctacatgccacagacatcaaattcttcaagtgtgatggggcttgctgatgaccagagtccacagatgtcagtacctccatctcttatttgttcaaatgctatgactgatgatgcacctttcgataatagaccagggcggaaggaaatgccactttctcaggcagaagtggttacccaatcttccagttcttctggtgatgctgaaatgtttgctaaccctggttgtagcaatgacagacatgttccttcttcaacgatggaaagcatacctgaatgtggggaccaacaggttactaatgcggaagaacctgaagccagtctagagaaagaaccatcgcttacacagagtgtgactgcaccagatgaacaggacaagggagccctcttctacgaacctcctcgttttccaagcctggatgttccatttgtcagttgcgatcttgtaacctctggtgatctccaagagtttagtccccttggcattcggcagttaatgcattcaaccatgaatgtctgcacgccaatgagattgtggggctcccctactcatgatgaaagcacgggcgttttgctgaagagtgctgccaaaagcttcatatgcacgccatcaatactgaagaaacgtcacagagatctcttgtctcctattccagataaaagaatcgagaagaaatatgggactgaaaaggatcgtggggtatcagacacatcctccaccggcattcaaacaagttgtatcaatgccactaaagatgatgcacttataactacagttttgcgtattgagcgatctgcttcttctaaatctctggaaaagaaacttgttttctctgatgaaaacaaggaaaatttgggctacacaactgaacagacaaaagatggacagagtgctggaaatgacgaacacatggacgagcagacaacaggggaacgcagttctgcaacaaatgtagctactaatgatgacctgtcaggcaatttagtaagtacttccagtttctga

SEQ ID NO: 5726 - DNA, 908 bp, Oryza sativa
  misc_feature (326)..(326): n is a, c, g, or t
  misc_feature (897)..(898): n is a, c, g, or t
  Predicted polypeptide sequence is orthologous to G668
tgacgcgtaggtcggtcggaatccgggtcgaccacgcgtcgcccgcgtcgaatgcgcaatgtttgaggagtgttggaaagatgtctaggactaagccatcttagataacagaattgatgtgttgtccgatatatcttcactcttgtccggttaaggaatcaccgaagacagcattcctggaaagcactgccaatgatgtcatgttgatgtactaacagtagctgatagctgcttggagagcacaatgtttactggcagctgaatatgctcgacgcatcccaccccatatctggattgcaaagtgcctctgagttcagatttaattnggtctggagacgtttaactcctttagaacttttagaatgataagaattttttagaacattagtgttcatagatttgatgtatttttaacagtgcatggttttgatgtctctgctgctgttgtgcgccatacccagatattcatacctgagggatgctagtcgcatcttgtgttgtccttctggaatctgacatcacctagcgcgcttccaagatctttagtgaatgccattttgagtgtcttttggctgtgcatctgtgaaattattgccagttcatgacaactaatagctttgtaaaaaccttctatttcatggttatcagtaaaagttattgatggttcttttaaaaaaaaaagggggcgctggaataaaatcggggcgtcagaggtcaagtagtagcgtatggagtcttagtctatgggtcctattaatcgggcggtacagtctgaggaaacgggtccataagctggcacctgcagggtataaggccaatgctcaatcagagaaggcctagcaaggagggtacgccagaccagcataccaggcgcagccttgccattctcatatctanngggagaggac

SEQ ID NO: 5727 - DNA, 777 bp, Oryza sativa
  misc_feature (647)..(647): n is a, c, g, or t
  Predicted polypeptide sequence is orthologous to G670
ctctgtcccagctccttctttcgtcttcgtcttcgccatcgtcgtcgggacatcgccggcggtttggtttgttctctctcggtcgtcgtcggcggcaattgcgacattgagcacggtggtggtggtggccatctatggcgaagcgggcgggcggcgcgaggaagaagctgaggagagggctgtggtcgccggaggaggacgagaagctgatgaaccacattgccaagtatggccatggctgctggagctccgtccccaagcttgcaggccttgagagatgtgggaagagctgcaggctgaggtggataaactacctcaggccagacctcaagaggggagcattctcacaggaagaagaagacctcatcatccatctccattccatgctaggaaacaagtggtctcagattgcggctcagctgccgggtcggacggacaacgaggtcaagaacttctggaactcttacatcaagaagaagcttcgccagcgcggcatcgatccggccacccacaagccgctcgccgaggtcgtcgccgccgccgcctgcgcccgcacgccggcggtgttcagcgacgccgagctcatcctgtcctccatcggcgcccagccgccgccggagagctatgatggcagccggtacagcacnggagtgcggcgccgcgagtgtcggcggcgacgggtcgctgtcgtcgctgtccgggtacagccaagcgacagcggagttcgcggtggacggcgccagcgcgagcgcgctgctgcactgcggcggcggcggc

SEQ ID NO: 5728 - DNA, 3716 bp, Oryza sativa
  Predicted polypeptide sequence is orthologous to G670
gagagaaggtcaggctgtcaccagaaagtcctttttccccggctagctcctgcatgcagctgatgagcgtcctgcatggagaagaaaagaacagatggtgacactgaattccaagaaaaaaacatatagtacaaatgcatatataccacaacagacaatgcaagcctccagaacggatgggatccgtctgcatgaggaatcaaaggacaaggatgatcagctggaaaccagattataaaatcatcaatcaatgccttttgattcgccgcgcgcttgtttaatgtttaatgggggggatgagtatccgctgtcacatgggcacaggaggggggatggatgccattacaatcctaatcatggaatcatggattaaacttttcccccttttcctttcatcaggataccaggccataatacttgcattgactagctcatttgggatgaatactataactccaaatgtttttgtctctgtcctccaggcccttgcatcttttcttttctttttttccagtacttctaaattccaagaaacacaaccggcctctccacaatgatcaatcgatcgaccgatcggtgttcccattgacggcagagacagtcagcagacaaatcattattcctgtacctgcgcaattatctgtgcaattatggggaagctcaccgttctgaagaactgatcaccacagacacgctcaacgtgcttcatctcggattggagaagcagatacggatttccgaatgaaaattgctagggtatctagctgcatgcccatggtaaacaaaggggagaagatgccctctgtcctggaataccaacatctgatgccaccacttctttttccccaggaccccaactgtgatgattgacggggagcttttccacagagacaagtgatccagtgacttacctgaaaagcaagagaaataaaggacaatacttaggtctgacacataaaatcttgcaggtgggagaaaatgaggtgcacatgcacgcacgcacgcacagcacaacacagcacagcagctaacaaaattgggacttaattggcaacagaagaaaggtggacatggcctcccagtcccagcactccagcagtagtctgctgctttctttgcccctgcatgaaacactcgtgatgtacaagtagctgcaggaaagaaaataaaaggagaggaaaaaaggatttaaaagagagaaaatttctgatttctagtagaaaatggtgtactggctgggtcgcagtcaatcaacatgggagcaagaacatcagtccttgtcctaataatgtaaaccctgatggactggttttactttcacttgctgactgattctcatcaaacaagtacactggaaatgggaaacgagataaaaggaaaaaaaaaaaggcgaagaaggaagaagatggaacagttttttgtacaaggccgcgacaattaaaatatcggtggagacggacggcaaccccaccagttttggcaccggacatagattcttaggagatgacgagacagaccccccacacgcacagccaggaagcaaccaaggcaaggggttaaacctcccttctcacaaccaccaccaccaccaccaccacctttaaaagaaggtgctaaagggggtgtcctgcaaagaaaaggagaggagtgccccctaacctttccctgctttccactgaaatctcctatccgcaaccatacagttgctcaattctggtctcagccaaagccccaatcattcatcgttatataggtcactataccctcccttgcatttcccaccaccaccccttgaagccatgaatcgctgaagaagtcgtctgcgctactgctaccaccggggaaggattagctgcgcagaattgtgcgagcgaagcctgccagccgtgcgaatttcaagctccgaggtcctgcattgcactgaaatggggaggcattcttgctgctacaagcagaaattgaggaaggggctctggtcccctgaggaggatgagaagctcatgaatcacataaccaagcatggccatggctgctggagttctgttcctaaacttgcagggctccaaagatgcggcaagagctgcaggctgaggtggataaactatctgaggcctgacctcaagagaggtgcattctctcaggaggaagaagacctcatcattgagctccatgctgtccttgggaacaggtggtctcagattgcagctcagctgcctgggaggactgacaacgagatcaagaatctctggaattcttgcatcaagaagaagctccggcagaaaggcattgatcccaacacccacaagcccctcaccgaggctgatcgcaggggagcagcacccacagtcagcaccgagaggacctcagggtccagcgacgtcaacccgtcaagtgctggtgctctagggaacttgagccacctcctcagcgagacagcacaatcatcaatgctgctgccggtgtatgataagaatcaccctgaaactgcaagcttgccacgccctaaggtgccaccaaaggagttgtttcttgaccagcttactgccggtcacgagagcccatcaagttgccgctcatcaggtccaaccctgtattttcctttccagcaaccattaggctacagtaatgaatgtggcactggggatggtgcgagtatgaattcactctggttcaaccagaatgatttcaactgcagcacaatctccaccgtgatgccaccagtttcaccatcagccctctcaacatcaatggggctgaatcttcccccagaaaatcctcgtcacggaggcactggcattggcaacaccccgttctactgggatggttccaatcctagcagcagcggcagtactgggagcagcggaagcaacagtatgggattcgagccacagagcacaacctcaattttggagaacagtgtattcccatggacagatatcggacaagagaaagataccagagttcacttagtggaggaactcaagtggcctgatttgctccatggaacctttgctgaggcgacgacagccatgcagaaccagagccaatcattatacgatgatgtgatcaaggcagagagccaattcaacatggaagggatatgtgcctcttggttccagaatcagcaaccacaacaacagctgcaagcagcatcagacatgtatgataaagacttgcaaagattgcccttgtcttttgaacatatctaggtgcaatgctacgccatgcatggaacagagcagagatcagaagaagcagaaacttgtaactctcgcatattgattggcaggcaaaacactgaagtgtttgatgttttgacacagaatcgacctcaacactttctcctcacttaaagatcctacagtgtcatggaaaagacagctctggccttacgagtagcagaagaagggatagaaaagtacgttctagagtctccctcttttctcttgaaatttgctgttttttgtacacgacaactcaacttttggatacttgagttttggttcactctgtttatcaaataaatatagacacgcatgggcaaaacatgtgtcggtagctctcacaaaccatacaagtagtcccaagcttttcaactgctaccatgcacgtacatgcaaattaattattgcatgttgtatttttatttcttttgagaagttgccgacaaagtgcagttgtatatttgtaaaggaaaaaaattggaacattgaccc

SEQ ID NO: 5729 - DNA, 1760 bp, Oryza sativa
  Predicted polypeptide sequence is orthologous to G670
aaagaaaaggagaagagtgccctctaacctacctatgccttcctccaaaatcctgatatcttgagccacttgttgctgccactctgccataagcttccaccctatcaagcaccaatatatgagccactatagactgtacactcgcagcaatcccactcttgagcactgaatcaccaagaggattacctgtgtaggtgttgtgtgctgtggaaagtttcttgggagggcaagctgtgcagattgcatagcttcagtttctgcattgattcaatggggagacattcctgctgctacaagcagaagctgaggaaggggctctggtcacctgaggaggatgagaagctcatgaaccacataaccaagcatggccatggctgctggagcaccgttccaaaacttgcaggacttcagagatgtggcaaaagctgcaggctgagatggataaactacttgaggcctgacctaaagagaggtgcattctctcaggaggaagaggacctcatcgttgagctccatgctgttctgggaaacaggtggtctcaaattgcaacacggctgcctggaagaactgacaatgagatcaagaatctctggaattcatgcatcaagaagaagctgcggcagaaaggcattgacccaaacacccacaagccccttgccgaggttgatcgaagcaaagcaactcccaccatcagcaatgacaggacctctgaatccagcgatgttgacccatctagtggcgttgctcttcacaacttgagccatcttctgagcgagacggcgcaatcatcagagctgctgccagtgaaggtaactaaacctcgcacacaagctccgggcttggcacgtctgaaggtgccaccgaaggaactatttctagaccagcttacttctggccatgagaacctccctagctgccgttcatctggcccaattcccaatttcccgttccagcagctgttgtgctacaataatgattttaacagcatggacgttggaaacaggaattcactctggtataaccagaatgaatccagtagcagtacaatttccactgtgatgcccccagtttcaccatcaactctctcgacatcaacaggccttaatccatcaccagacaatgcaaactctcgaggcactggcatccacaattcccaattctattgggacaccaacaatcctagcagcagtagcagtacagggagtagtggtaacaacgggttgggattcgagctgcaaagcacaagctcccttctggagaccaacatattcccatggacagatttagcaccagaaaaggatagccaagcacaactagaggaagaactcaagtggcctgacttgctccatggaacgttctcagagatgccagcgcccatgcagaaccttagccagtcactgtatgaagacgttgtcgaagcagagagccaattcaacatggaggggctctgtgcagcttggtctcaaaacctgctgccacagcaacatcttccagtagtatcagatatgtatgacaaggatttgcaaaggatgtccttgtcttttgagaatatctaggaaccatgttccagcatgcagggaacagagcaccagatgaaaattgagagttgaaagcttaggaagcacaatgtttcttcagagatacgtttacagtgtactcagttgtttgtggataaattattgtgagtgttcacatagatgcattcttttggtgagacatgaatgaacatcaaagagcaattcctcaaaaaaaaaaaaaa

SEQ ID NO: 5730 - DNA, 6305 bp, Oryza sativa
  Predicted polypeptide sequence is orthologous to G675
gatatcgttgccgtctcgctatcctctccagcggatccaggtacccagaggagagggacgcaagccgctgccgcgacacttctcccccttcatctccatgccaccaccgcctccctcttcctcgccctccactcctcttggtgaggtgccagatcttgttcgagggtcgttggaatcgatggtatcggtctccccaacggtggatccggtcacccggagcgacggacccaagcggttgccaccgccctcttctcctctcccgctctgccctcttcctcttgccctctgcacctctaagtgccaggactagctcaagggctgccggcgttgggagtgtagggtgggcaaggctgagaaaaagaaggatggatagcggtggttgctggcttcatggatgtgcccggttggttccaatctcctcttcccccctaggtttcttcgtgttgtcgcctatatcttgcttcttcctagagttcaatcgatctggtgtggtggttgctctattgtatatttgtattgtctaactcaacagatttggagggcctcttttgagctcaaaataatgttcatgcggtctaatcaatttgtcaaggggtatatatgtttactctagaagatcatgagaggttgcaaagaccggacaagattatcaagccgacgatggggtatgccatctgcaatgctatggataatttctccgtgctcttatcctgagaagatcctctcatcctgtgtgggacaagaacaacatgttcttcaaatttatgaacatggcattttttaggagacaagttcagatcacataatacacataatggagctatgtttcaggtcagaacttccaatctacatcctttattgttatgttcagcctcaaatttgcatgatgttcaaatgtgcttagaaatcaagaaccataaatggaatacattattaagctagaaacaaattacagccttacagagttatagacttaaagtagttgaccatgtctcaagacccaacacttttatcttagaaatgttaattcaaaactttctcaatgacactattttccatatatcaattactccaactcatctgctactagctactgtatatgcatagtgaacagttagtattgcttaaataatgtctgggactgccacgtgtacgccacgtagactaaaaccaccgcggattgggtcgagaggggtaattcgtccggtattcatagttggggatgaaaaatgtcggttttgtggttcggggggtaattcggacgactgcgatagttcgagggtgtaattcgtactttttcctttcttaaaacaaaggggaaaaaataaatatgcaccagcggggtattgaacctaagacgttaagcattccctcctaaaatgctcaccgtgacctcacctaaccatccgaacatatgctacttaatgatcatggtttgcaaaactacattattattattatcgttgttatctaatgacaacaaaaaccgtatttttagcactatcgttgaaccatcagcccactgggctcaacctgcaagtcccaaagccgtcgataattttggactgaacgaataggccttgtgcttagtgtgaacagttcccattaaattaaaaattaaaaatggaataagttcactggccgtccctcaactttacatctagtctatatgacatccctaatccataatatcaagaaatctttacccctaaactatgcaaaaccgtataatttgggtcctatagcgctgaatctctggttacgctgatgtgacatcctagtcagaaaaaaatagaaaaattatgggacccacatataagtgagtaggaaaaaaattatagtgtccgcatatcttctttcttctcttttcttttttctcttctcttctcttctttagcgagcgcggcaattggcagcaaaaggggtagacgccgggtggggtggcgggcgaagcaggcaggcgatataagctatagcacttcagggaggtcaagctttgtagcgacgacggtgtggcattggcgtttctccgataagatgagcttcgacggctcaacagagccgaggttctgtgcaatgatgatgggggcggcgacgagcccgttcgtgttgtggaggcaatgtatgtcatgctatatggcaacgaggacggagcagcgatgactttcagcaagctaattcctgcaacaatagcatggtgggttggtggcgatggacccattcacgttgcgggagcgtaggttgtccagacgacatgcgaactgtgctgggtgataacaaagatgaatatgcagaaatgattggttaagattgttaattatgaaatgtggaacttcgaataaatctaaaattattttagttttgtattacttaaaaataaattttactactgcatttataaaattgtaaaactagttttaaggcaaattttgctacaggacactgcgactttgcggttttagctataggacaccgcacgaagtgacttttggggaaaaacactctcaaaagttggatatttgctggtggacaccgcacccattaaaataataatttctgtatgagaaggagagagaaatcacgtgaaatgtcaaaagtgcccttaggcccacatgtcagctcggctattcccctctctccagccacaggaacgggcggcggcgggacgaccccgtcgcgctacaccagtccaacgagttcgtcgtcgttgtcacgtcgaagagatcggcgagcagcggcagggagccaccgtggcatgcgaacgcgtcggcgccgacgccgcagccgaggagcctcaagttggcctcgacgtcgtcgcttgtaatcaccggcgcctcggaaaacgcgcacagcgcctgggtctggccaccggaatggtctatggccgtcgccgtgattgggacagagctgcctgcagacgacgatgagcaagtcgccacggcgagagccgcgtcgtcgtcgtacgcggacatggcgccgccgccgcccgacccggccgaggcgatggtggaggcggcggactagaggaggcactgtaggtactgcatcttggcgccctggatggcaatgtcggcgccaccaccaccggcgccctgcatgatctgcgccgccgccgccgcatgccatcccggcgaggtggtcccggagggtggcgagcgcgatgagctgcggcagcgcggcgaagaagtcggtacgtggccggtgcgtcatggggtcgaatcccatctgtatgagacgcttcttgaggtgcgtgttctcgttgtccgtcctttccgaaaggtgcgtcgcgatcgccgccgctgttccctggtgctgctgcctagcagagctgacatgtgggcccaagggcacttttgacatttcacacgatttctctctcctcctcacccgtaaattattattttaatgggtgcggtgtccaccagcaaatatccaacttttgagagtgtctttccccaaaagtcacttcgcgtggtattttacagctaaaaccgcaaagtcacgaggtactatagcaaaatttgcctagttttaactgtttctcacgaaaataaaataattccaacaaaaataaaatgtgtagaaccagacaaatcgacattaaataactgtccctcaattcttcccctcttgttttttaatctcacaatttttctcaataatctttcgctagagaaaatcaagcttaaatatagttgatctaaatttaacatttcgtttttctccaaaaattattttgctctccctccattatttccctctttttttcactcttagcaattcttttcacgtcttttgtgatcgcgccatttattccctccattttaccccctctaagaaaacaaacgatagctaaccgcccatgaaaatctctcccctctctctcatgagcaaatagatcctggatttcctcttttcccattatcatctcttcctctctctcctgccattctgcacttcttctcctcccctcagccggcgtcaatctggaggtaaggttctaggcactctgctgatttgctggccaactgcaccgagcaggcgagctcgatccccacggctgctgaggcccatgcggtgaagccccatgccagtggccgtgtgctgcactgctggtgaggttttgcctccgcggcgccggccgtctactccgtgccgcgcagcccgtgccctgaggccttgctgccatgcccctgcatctccatctcccttcctagttcctgcatattttactgcctcgcagagttgtcaaatcgcactcaagccttattccccttcagcattaaaatatattacggatttgatatattcagtattcaggttctggaagagatgcacccttacttgctggaccctggtctacaaacgattaggcttgaacagcacagtaagcaatccaatacgtaatcttgttttattcctctctcctagatgctgcaatctagccttaaccacttttgctttaaatcgttcactgtccatctatgtttgtttatctccgttgcagccaattaaataatgttctttccatcaattacttattcaaattgttggtctattaaaatggacaaaggaattagtgattggcaaataaatccaaattgaactcaataaatttattgttaagtttttaatgttttcacacctctatttgaaaattattcactagctaacagaagaatttagtaagctccgtagtggtacttttaggatagcatcacagcagtagagtaaaatgcctaaaattgtagtcaattctgaaattattcttctgtaggatcactctgttgttcctctttccatatccaactatacagaagaaggtaagtattcactttactctttggtagtcaaagccaacgtcaagcatcaaagttatttgataccaatgtttgaaaatagctttctgaacatatagaattagcaatgttttgttttttattagcaaaatgacactaacaaatagttaccaaaagaacccacctaataagtacattagctgtagaattctctgtttggtctatctgttctatttcatagttaaattgcagaatcaggatccaaaaactatgtttgcatagaaacaggcagtgcagcgcaatggactttatcactgacaaagtgacaattcgatggaggtaaaacatgttaaagttcttactgtgatgttcttttcgattcttaaattacttgaatgctgatcgatatgtatttatgcactagattggaaatagaatattcttaaaaagctggaaaaccttaaacacaaatgtggctcttcctacagttgtaagctgtgatccaacttgcaaagttggatgttttgagctaggaagtgaattcttgatggtccatgtggatgttccataggtgagatttaaagaattgattaggccatacaaaaactacaaaatcgttggttatgtcataggacttgaattgcgtggccttcaattatggtaagctgttatttctttagttcttactttagagatgtgatcttttttttcctcctgacggtgcatcagtggttctgttttttttttcttttatagtttgatagataagtggggtaagatgatgacttcaaggtagagaatggtggcaactgtagatgttgtatgtatatagtttagatcctattttctttgcgtatgatgttctgaacaacgtttttagtacatgaattatgaggatgattatctatgtaataaaaaaattctttgtacaattggttattatgattgattggtcttttctaatttgtgcatgctttgattttgtgggtccctaacaaaacataatattgggcaaaagccagctggagcatgtcaagaccatcccggccctcggctgccttcatctcagactgactgaaagcacgaattgtttccataagtgaaaggaaagaatttgatctagacacaagctcttgttgctgaatgacaaattgggacctactgacaatccttttgtcaagtacttatgttactcatgtatctggacatggttggttcttcagtttctggaaacttgatcctcacctttccacctctagccctttctttctatctccatcattttcatttgttagatcaactggattaaggtagacagttgaaatagtgaagcagtggtggttcacgaaaactgaaaagttgtgggtgatggaggaagcacagcatgccacacagggatctctatctctctctagagtttaattgattcatctttattctagacttcaattttcttaaagattaaagagtggtgctaccatttatctataaactaggtgttttctg

SEQ ID NO: 5731 - DNA, 1134 bp, Oryza sativa
  Predicted polypeptide sequence is orthologous to G675
atggggaggtctccttgctgcgacgagaacggcctcaagaagggcccctggaccacggaggaagatgagaagctcatggagtacatccagaagaacggccatggcagctggagagcgctgcctaagcttgcagggctgaacaggtgtggcaagagctgcaggctaagatggacgaactacctgaggccagacatcaagagaggaaagttcacctctgccgagaaggataccatcctccagcttcacgccgttcttggcaacaagtggtcagccattgccaagcacctcccaggtaggactgacaacgagatcaagaactactggaacacacacctgaagaaggatctgatccagaagggcatcgacccgacgacgcaccggccgaggaccgacttcttcgccgcgctgccgcagctgatcgcgctcgccaacctccgccagctcgtgggccagctgccgtgggacgaccccgccgccgcggccgccgggctgcagcaagccgaggcggcccaggcagcgaagttcggacagtacctgcacctgcaggcgctgctccagcctccgccgccgtccgccgcgactagccccagatcaggctgcatcggcggcgccgccgccgccatgccgggcggcgacatggagcagatgggcgcgggactgcttagcccgccggcgatgtcgtccgcggccttgtcgccgatgtcgacgtcgtccttgtcgccgctgccttcgccgatgtcgtccacggccttgtccccgttgcctccttcgagcttctttggcaatggtggccaaggctcattcctcgctggacaattgcctaacatccaaatgcatggcagctcgttgttcgaccagtcggccgccatcatcaacgacgccaaccacaaccaagattacgctgcaagcactggcgagagggagatcatcaatggcgccacgaagacgacgacgacgacgctgctgccggaaggctctcttccgccgctcgccgactaccccaccatctccaacctcggtgatgtctacagcaccccaagctgcgatggcaacatcactgaattccctctcttgcctgacgccttattcgacgagttgatgagagactatgtatctccttcttcctctttttag

SEQ ID NO: 5732 - DNA, 826 bp, Oryza sativa
  misc_feature (2)..(2): n is a, c, g, or t
  misc_feature (51)..(51): n is a, c, g, or t
  misc_feature (813)..(813): n is a, c, g, or t
  misc_feature (819)..(819): n is a, c, g, or t
  Predicted polypeptide sequence is orthologous to G715, G1646
tngggccgaggacgagacaagggggctcatcgaccacaccataaattggtnacctgcttcaacatcttgatataagaaaggagtaaagaaatggcgattccaacaaaggaggaggtggagcagaatgaggaggacaatacattttcaaggttgcaattgcttgcacaacaacggcatgccatggaggaattctggaggaggagccaggaacaaattgaggcatctgcaggcaaccatgagcatatactaccaattgactgcgtgaagaatgtcattcgaccaaagaatgatgctatgatgctatctgctgacacaccaacttttgtgacaaaactttgtgagctcttcgtgcaggagctcaccctccgtgcatgggtatgtgccaactctcacaaccgtgacatcatattaggcacagacattgctgaggcaatcaccaccactgaatcctatcactttcttggtaatgtacttcgtagccacaaggcactaggaagtactgctcctgacatagatacttctgctaggaagcatattaagctagaccaaatgacctcactctaccatcctacccaagaaatgcaggcctcacgtttagctgggtatccaccccatgttcctatatatcctcctataggtcaaatgggaactcaacacaagctgtctccattcgctttcatgatgcaagggagaatctcttctcaacatgaaaagagaaaattccctagttaatgaagtgatggtatgcaccaacaaggatgagcataaacaactttgatggagctactagtattggtggtggtagtagtaagnggatgntgctatt

SEQ ID NO: 5733 - DNA, 962 bp, Oryza sativa
  Predicted polypeptide sequence is orthologous to G715, G1646
gctccgcatcggcagcaaccgttgcgaccaattcccccaattccattccattcccctcctcccccggagagaaaccctagcaatggagcccaaatccaccacccctcctccgcctcctccgccccccgtgctgggcgcccccgtcccttacccgccggcgggagcctaccccccacccgtcgggccctacgcccacgcgccgccgctctacgccccgcctccccccgccgccgccgccgcctccgccgccgccaccgccgcctcgcagcaggccgccgccgcgcagctccagaacttctgggcggagcagtaccgcgagatcgagcacaccaccgacttcaagaaccacaacctccccctcgcccgcatcaagaagatcatgaaggccgacgaggacgtccgcatgatcgccgccgaggcccccgtcgtgttcgccagggcgtgcgagatgttcatcctcgagctcacccaccgcggctgggcgcacgccgaggagaacaagcgccgcacgctccagaagtccgacatcgccgccgccatcgcccgcaccgaggtcttcgacttcctcgtcgacatcgtgccccgcgacgaggccaaggacgccgaggccgccgccgccgttgccgccgggatcccccaccccgccgccggtttgcccgccaccgaccccatggcctactactatgtccagccgcagtaacattttcctaccgtatagcttcaagtttatttagcgatttttatttatggaatgcttttctgctgttgtcgtagttgttattatgttttgcttgttgttgccgtgtaataactagaagatgtgattatcattgtgaggagcctcctctcggtgtataaacaatccgatttgaggattgggcgagctttgttgcgattgaggaaggctgtatggtggttttgatgcatgtctaacttatatcacaatgaattatttattaccc

SEQ ID NO: 5734 - DNA, 921 bp, Oryza sativa
  Predicted polypeptide sequence is orthologous to G715, G1646
aagtgaagagaagcagcaaagagagagcttttccatccccaaatcccctcctcctcctcaaaccctagctaagctccgctcgcagcagcagctgcagatgttctgggcggagcagtaccgcgagatcgaggccaccaccgacttcaagaaccacaacctccccctggcccgcatcaagaagatcatgaaggccgacgaggacgtccgcatgatcgccgccgaggcccccgtcgtgttcgcccgcgcctgcgagatgttcatcctcgagctcacccaccgcggctgggcgcacgccgaggagaacaagcgccgtacgctgcagaagtccgacattgccgccgccatcgcgcgcaccgaggtgttcgacttcctcgtcgacatcgtgccccgcgacgacgccaaggacgccgacgccgccgcggccgcggcggcggccggcatcccccgccccgccgccggtgtgccggccaccgatccgctcgcctactactatgtgccccagcagtaatgtatctgattaacccctttcaagccttttctaagcgaaggatgtgttgttgtttgttgttgctgttgctgttcttgttgttgttgttgccgcgtaataagatatgttgataatttatggcttcccctgagcttaaagaatttgagcttttggttctagaatctgggtaaaattgttgtaatggggaagactgtatgactgtatttgtagtgcatgtcttaacttgtcggatagtgtaatccgataattattatgcggttagctggttacctctcatgattactgtgctcatgtgctgtgcaatttatgttctttgttttggatgtacaatgctgtaaccagaatttggttgtgtaaggaaactattaaaggttgtgcgagggcagtgtggctatcgctgcattttagcttac

SEQ ID NO: 5735 - DNA, 1476 bp, Oryza sativa
  Predicted polypeptide sequence is orthologous to G715, G1646
cagagcaacgaagggaaggaatggagcaaactttggacgtacctagatcgttgagactactggcgccaaaagctcaacaacaaatggatgaattttggagggatcgacaaaaggagattgaaacaacaaaggactttagcgagcatgcgatccctatggcccgcttgaagaagatcgtatcttctcaaaagggtaacatgatgatgacctttgacatgccagcattcttatcgaagatgtgtgagctcttcgtacaagaacttgctgtgcgtgcatgggcatctgctcaatcccataatcgttgcatcatactagacacggatattgctaaagccattgcctccacagagtcttatgactttcttgttgatatcctccataatcatcgtgtgaaacacaaatccactccttgttctacacttactacaaagcgttgtaggttagtcgatcaaccttccacatctcacatgccctaccaacatcagctgccacaatttgctcctacatatactccggccatccctattactcctagtttaatgccaccaatttctcactatataccgttccaatatccatccttatcacaagaagtgtccccgatgatggcttctgcacccatagtgaatagatcaatgttgctcattcacaacatagcaaggggtctaggcttacaaggaaacaatatcagcacgttcgccaacaataatatcccagacaatattgttggttgtagtagccccacagttcttgcaagtatgatgagtcctgctttactagaagttgcagggacatcactaaatccaccaaactctcattccatctgcacaatgaacatgatcaactcgagtgatcctagtggatctagtattggtgacattaatgttgcaaatcaagcaagtcttgctccctctggacgttttaaccctgctatccttcgagagtcatcatgtccttcgttcttacatagtaacaatgacacaattgttgctataccggagggtgtagatattagtggcaccatggatgttgctagtgatgttgctgctatagttatcaatggtcaagaagaacatgagagggaaacaaatgttgagcatcatcagcaaaatgagatatatgaaagcattgatataggaataatcaatgcaagtgttgcggatgataataaatatagtattagctgggatgaattgggaatggctgatgattcattgctagacaaatttttggaggagtttcaagtaagaaatgacggtgttttgcgcactgggattgagttgcatgaagacccattccttggtgacgtgatgttagcaaacccaagtacaagcaatgccaataagtaatttagttggcaagttttgtttatatctcttttgtaagaatgaggttggtaactttttcttgttgaatataatgtttgcagcggcggacctatgtggggtgccgggtgtgcaccggcataaaaaaaaa

SEQ ID NO: 5736 - DNA, 1266 bp, Oryza sativa
  Predicted polypeptide sequence is orthologous to G715, G1646
atggagcaaactttggacgtacctagatcgttgaggctaccgacaccaaaggctcaacaacaaatggatgaattttggagggatcgacaaaaagagattgagacaacaaaggactttagcgagcatgcgatccctatggcccgcttgaagaagatcgcatcttctcaaaagggtaacatgatgatgtcctttgacatgccagcattcttatcgaagatgtgtgagctcttcgtacaagaacttgctgtgcgtgcatgggcatctgctcaatcccataaccgttgcatcatactagacacggatattgctgaagccattgcctccacagagtcttatgactttcttgttgatatcctccataatcaccgtgagaagcacaaatccactccttgttctacacttactacaaagcgttgtaggttagtcgatcaaccttccacatctcgcccgccctaccaacatcagctgccactgtttgctcctacatatactccagccatccctattactcctagtttaatgccaccaatttctcactatataccgttccaatatccatccttatcacaagaagtgtccacgatgatggcttccgcacccatagtgaatagatcaatgttgctcattcacaacatagcaaggggtctaggcttacaaggaaacaatatcagcacattcgccaacaataatatcccagacaatattattggttgtagtagccccgcggttcttgcaagtatgatgagtcctgctttactagacgttgcaggggcatcactaaatccgccaaactctcactccatctgcacgatgaacatgatcaactcgagtgatcccagtggatctagcattggtgacattaatgttgcaaatcaagcaagtcttgctccctctgaacattttaaccctgctatccttcaagagtcctcatgtccttcgttcttatataataacaacaatgacacgattgttgttgtaccggagggtgtagatattagtggcaccatggatgttgctggtttagttatcaatggtcaagaagaagaacatgagaggaaaacaaatgttgagcaaaatgagatatatgaaagcattgatataggaataatcaatgcaagtgttgcggatggtaataaatgcagtattaggtgggatgaattaggaacggccgatgattcattgctagataaatttttggaggagtttcaagcaagaaacgacggtgttttgcacagcgggattgtgttgcatgaagaccattcctag

SEQ ID NO: 5737 - DNA, 1283 bp, Oryza sativa
  Predicted polypeptide sequence is orthologous to G715, G1646
atgccgatcccggaaaaggacggggtggaggacaatcaagaggatgatacattttcaaggttgcaattgcttgcacaacaacgacatgccatggagaagttctggaggatgagccaggaacagatcgaagaatccgcaggcaacgaagagcttatactgccgatttcccgtgtcaagaatatcatccatgcaaaggagggtggtatgatgttatctgctgataccccagcttttgtaacaaaactttgtgaacttttcgtccaggagctcatccttcgtgcttgggtgtgcgccaactcacacaatcgtgaaatcatacttggcacagatattgctgaggcaatcaccaccacagaatcctatcactttcttgctaatgtagtccatggccaccaggcgctaggaagcaacataccagagataggggtttctgcttggaagcgccataagctagatgaaatgacctcactctgccatcctccccaagcagtgcaggtcacagatttagctaaccatccacccaatattcctgtttgtcctcctataggtcaatcgggtactcagcacacaacatctacacatgttttgatgatgcaaggagaatctattcacaaggcaagtaaagaaaaatccccactgaaggaagtgatggtgccgaccaacaaggtgggcatgaccaacagctcttatggagttcctaatggtggtggtgctactagtagtaaagttgttattgatagcccgaaaggcgaaacagcacaagttttctcttcccagcatgcatgtccttccctagaagataactatgttattcccattcctgctggacatggtgatagttttcgtactcttgatgaggccaatataccccagctacatcaggagcagaaaaactttatttcacaagatgctattgttggtgaaaacattccgctgaatgagtctttggaaaagagcaagcataaggatgaggacttactttttcctgacaaagatcttcctgagtgatctacaagacagaagatgaatttcatgacaatactaggaatacaaaataagcaacgaactgaagaaggatgcatcctggttaatccatcgaccatgtcttagtagagttttcttctgtgtttctgtgttgaagctttatgatttaccttatactttagtcaagatgaataagaaataagtatgtgtttccgtgtgaggcggtaatatgtagtaccttgtatttccatccatcttcgtatggacaataataataagacctctgtttgcttcatgat

SEQ ID NO: 5738 - DNA, 1095 bp, Oryza sativa
  misc_feature (775)..(775): n is a, c, g, or t
  misc_feature (822)..(823): n is a, c, g, or t
  misc_feature (825)..(826): n is a, c, g, or t
  misc_feature (828)..(828): n is a, c, g, or t
  Predicted polypeptide sequence is orthologous to G715, G1646
tttttttttttaatcggctatatattacaaattgaaattaattagtagattgtacatcccttaattagcttgagcgtccattacgtacatcggttaagttaatacgtaccacattaattaattaccgacacattgagcatttgatttgagcagctatagtagctagctagcacctcagcgatgcatgcatggaaccatatggatcatcactattcggagcttggaggtgcaggagggaagccagctgccgcaccgccatggcctgcaaaaccttgctgcccttcctcgctgaagctgccggcggcgccctggtccacatccggcgctgctccttgctgccacgccgggtcccacgccggaacatgccacgccggcatcatcggcgccggctgccccatcggcgggtagtagtacggcagccccgcggcggggccggccgctccaacggcgccggcgggccctcccgccgcgaacccgagcgcgctgccgggctcctccttggcctcctcccgcggcacgatgtcgacgaggaagtcgaacacgtcggtgcgcgcgatggcggcggcgacgtcgttgcgctgcaggtgcggcgcttggcccctcggcgtgcagcacgagcggatgtgagctccgaagaaaagccgcagcctggcgaacagcaggcgctcgtcgaaaatagccgtccgtcgagtagatatgaagggccggagggggtgttaataacgcgcgcgcccctccgggtggtgcacccaagggcgccgtgagagtgatgccnccccactcccgccgcgctctgtaccgcgcgccagcgcccgcacgccnncnnangagacagagagaggcacacagcagggagcaagagagacaggggaaagaggcaaagagagagaagcgaagcgagagaagcgagaacggagaacagcgaggagaagaagagagcacgaacgcgaaagggcgacaaccagacgagacaaacgcacgaaacgaaagcaagaacgagaaaggagaaacgaaaaacaggaagaaagaagagagaagaagaggacgagagagatagaagcaagacgacagagaaagaacagaagcaaacagaaa

SEQ ID NO: 5739 - DNA, 2507 bp, Oryza sativa
  Predicted polypeptide sequence is orthologous to G718
gatagtcactactcactacactaccagttggtgtttgttctgagcattattggagtgtcagggaagggcatgtgcttttgttggttgctgtaggaggaggcagccatccactgggcctcactctcctcttgttgctgcctcctcctcttgttactgttcagtctcaggctctcaggctcacaggtggggttttgggagatactagttaggagggaaaggttgccatcttgtgtgtgttggatctttaatacaacggggataacgattctctctcagctaaaggaggtgagattcttggtttcacatcaagtattattgttctttcttttacttccttcaaaatagtttctttgctttttatttcatatatggtttggtttatttatgctccccaacaagcaactggttcatgtgcggtaacaaggagcaaataatgcagctctgattgacttggggtagttgttgtggtgatagattggaaagggtttaaatagcgggtggttgtggtgatgaatgggggccagccttgatggggttgatgctgtcgtcttttaggtcggggaaacaagtgggataggatctccctcaagtcgaggtgagtgagaactcagccaagaacaacaatggagtctctgttgctttagttctgccagccaattggtttcaactttcaacgctgctacttgttattcatcacctcctcggatcggtttgatttatgctcaaggttgtgctatgcatggtcatgctgattgagggcaagatttgcagggagaggaaggatccactgtgtttcttttctgggagaaaggaaagttgagatttgcaatatatacaagtgtgagcagcagcagttgagatccttaattcagccatggcttcttttgggatgaactggaatcagaagagccctgtgttttgggactgggaaaatccagcgcctttcggtccgaatacaatggaaaatcccaagagcatacctcaccctgaaccaagaggtgtagttgtcgcggccgcaaatcatggatccaccaattcatccggtggcacgttcacttctagctcggagctagccaatggttcatcgaagagctccttgtcagcgtcgttcgattcctcatccaagctggggaacagcttagagttcaggtttgcttctgtcaaagggcatggcaagaacatgtgcaaggatggcgaggccggtagagttgaagactcgggcacttctccagctgtggcagttagccatggtgagccggtaataggactcaagttagggaagagaacttactttgaaaatgtttgtggagggcagaatgtcaagagctcctctgcagcttcaggtgtgacttgtccatctactgtggtcaagaagatgaaggtgtctcagcagagcacacaaagctcatactgccaagttgaaggctgcaaagtcgatctgtcctccgcaagagaataccatcgcaagcacaaagtttgtgaagctcattctaaggcaccaaaggttattgtttctggtctggagcgccgtttttgccaacagtgtagtcggtttcatggtttagctgaatttgaccagaaaaagaaaagttgccgcaggcgtctatctgatcataatgcacgaagaaggaaaccgcaacaagaggcaatttcatttggttcatcaaggctcgccacgatgttttacgatgcaaggcagcagacagatatttactttggccaatctccttttggccaagtgagaagcaatgcaatttcttcatgtgacaacctgggaggcttcaaatttacagaagcaaaactcccctggatgaagccaatgaaaactataggccttgaggatctgaatttctctaccctgcagatgccaggcaatgttgtgtcgcatacggtgcatcatcatgattttgatgggctcataccattcaagggaaacaccccgaaggtcctcaaccaaggtgtggatccagcctgtgccgtcgtgtcctccaactcgaatggagccccggatcttcggcgtgctctctctcttctgtcaagcgattcctggggcccggccgacgttcaggccggctcccaggtgcatcccggtggagtgatgccgcccctcgccgttgccgccgccaccgtcaccgccccgacgaaccctgtcagtgtgatgcatgctctgcacccgtccaccggaggaggaggattctggcaagacggcgacgacccgcctccgctcgatcatgcctcgcaggctcaggcgttcatgcatcctggcaatggcagcagctccggctatggccatctgcactgattctgctgcatctatttggaacgggttgatgactggttactccgttcatgatcttaccctgtcagtgatggactctgaataatttgggggcgaattgtcctgcaaccccaggatttattatttctatttttgaaaccaaaccaccaggatatttgccattggatgagaagtgttcatgatcatgaaatgatctgttttgttccac

SEQ ID NO: 5740 - DNA, 2903 bp, Oryza sativa
  Predicted polypeptide sequence is orthologous to G718
gattccccaatgacttcttcttcctcctcctctccacagtccacactgttcatctcctcctcccctccctcccaattcgattcccaaatcccaaaattgaccacccaaatccgcgccaatccatggattggatgcctcctccgaagcccacctcgccgcgctcccctcccctcctctgggactgggccgacgccgccgtgccgggctcctcctccggcgaggtatccgccgccgccgccgccgccgcggctcatccgggaaggcggcggaaggagaagcgaggcagggcggaggaaggaggaggtggtggtggggaggtgaggtgccaggtggaagggtgcggggtggagctcgtcggcgtcaaggactaccaccggaagcaccgcgtgtgcgaggcccactccaagttcccccgcgtcgtcgtcgccggccaggagcgccgcttctgccagcagtgcagccggttccatgcgctctcggagtttgatcagaagaagaggagctgcaggagacgcctgtatgaccacaacgctcgtcggcggaagccccagaccgacgtgttctcctatgcatcggcaaggccgccgtcgtcattattatttgatgataaccgacaaataagttttgtctggaacaaagctccactcagccatgtaaggcctttcgcaatttctccatgggaaagctcatctgaagttgggacaactgatggacatatttatttggataaatctcacatatccaaatctctcccagcatttaacaccgacatagatgagctcttaccaatgaaaggtatgattttccaaagatgtaagttttcgtgaaaaatgtcatcaattaagactactttcatggttcagcacattgcatagatctttgaaaaaattcaacctatacactgtaccaaatgccaaattcagatgctgttttgtcattgttgttgtttgttaaaaaaagtatcctggagttgtgcacacccatgaaaaaaaattagacccttgagcacatttgggtttagaaaataagatggtgtgcagtgtgctgctaagcttatgtcactatagttgacgaagtgtttcaaacataaaagacaacagagtttttagtaagattctaattggaaaagaaaaaaaataccgtgttttgtgtgatagtaaacatcctacagtttcaactatataagtagttctcttgtggtcattgggcagagaattacttctccagttagcaatacaagttgttttgatttaacttgcaggtatacaacaaagaatgatgttgggcattcttttggtcctttgctctcttttgcccaaattagttatgttagatgcttttaactacagttaatatgtgcttggaagtggagcatgcaccaaaaaatggatagcaaatgccacaagtttccatatgaggctttggcgctaatatcgcatcaatgatgtgttagtttttgtgtttggtacaagtatctgtacaaggttttggtgccaacattgcatcattaatgcgcagctagttgtttcatttggtgtgagattgtatataacggcagcaattattttcatgtaatagtattccaacagggatttaacaggggcagtattgtaccaaaaaccataacttaatgctatgtgcttattagtctacaacgacttcgaagtgctgactagagggggtaattatatttatgctatgttttgttagataatggaatgctatggattttgataacaagaaaaaaaaatgcaaagtgattccagatagctgtgattcttatctctgacaaaacgagggaattccaatacttagcacaatatgcgaaagtcagctcaggaatgccctaaatttaccttattatgcctgttccctaaactctccgcatgcgggagaactagttaccatgctaaaattctacatactaccaagcatactgcaatttcttggataaccttgctaattttatgctaaattctcaaaatatatttcaaatgaatatgagccattcaatccatttccattgcagacttctctgcagccactatttggatgttcttcggtgtcctttttatccgaactgcgcaggagagctgcatgtcatttcattaaggagaaaacaatgtacatattttgatggaagaatgaccattattccattttgcaggtccggacgcatctttaactgcttcaaaatttgatggagcaccggatcttcagcgtgctctctctcttctgtcatctagttcttgtggattacctgatcctgtacagcaagcatctcgcgtcatccaattcacaggcgccagccaaaacaaccgggaacttcctccacttaatggagggaattctgcttcagcatcatgtgccaatgtacaaactatagcacaaccggctcagctggttcgttttaccatgaatgctagcagcaatgcttgtcagtccaatttcttcggtttaaaccagataaactaaaggcctggactgaaagcccgtcgtcgatttcgaccaatatccaccaaggtggccttgagaagatacaagaattgcttctatcaactatcagagtgcaaacaatgtcacagttaatgttgtcatcataaatatcggtattggtctcccctgaactaaaatcgaacggagtgatggcttgcttgtgttttcgataatcgttatgcagttctaattttttttctattgttttctgccaatgtaccgattttcaaactgtgggtcttgtcatttatacttgtacaacctaatgtcaaaatgtcatgtatctttgaaactgtttttgatggatttgggacatggtttcgcttgtatgattgttgttttggcagcggcatgtggtttcagtggtggtggtatgctttggcgccataacgtgctgttttttcccc

SEQ ID NO: 5741 - DNA, 1164 bp, Oryza sativa
  Predicted polypeptide sequence is orthologous to G718
atggactggaatcagaagagctcggtgttgtgggattgggagaatatgccgccgataggaaatagcgcgaacgagaatcccaagaatgtgatgctggctgaatcaaaacttgcaggtgttggggttgacataggccatgaatcaggccattcttctggtggtactttctcttctagctcagagattgggtatggttcatccaagagttccatatccgcgtcgatcgattctccgtccaaagtggggaacaccatagagctcaattttgcatctgcggaagagcatgataagaacatggacaagggtaagagtaaagttgatgacaccggaacttctcgatcaccggtggtagcagccaatcgtgtagagcccttgattggcctgaagcttggcaagagaacctattttgaagatgtctgtggagggcagaatgtcaagagttctccatctggtgtgagtgtggctaccccatctcctggtctggccaagaaggtgaaggtggctcagcagaacactcagaacccacactgtcaagttgaaggctgcaatgttgatctctcttctgctaaaccttaccatcgaaagcaccgagtctgtgaacctcacagcaagactcttaaagtcatcgttgcgggtcttgagcgacgcttttgccaacagtgtagtcggtttcacggtttagctgagttcgaccagaaaaaacgaagctgtcgcaggcgcctccatgatcacaatgcccgcagacggaagccacaaccagaagcaatttccttaagttcgtcgaggctctctacattactctatggtgatgcaaggcaacaggcaagttttctatttggtcaagctccttatggtcagatgggaagctgtgcaagttcttgggataacccagtaccaggaggcttcaaatttacagcaacaaaagctccttggtcaaggccaacaatagctgccggtgttgatgggacgcatgtatctaatcagcaggcatcgggcaatgtactgccacatggagcacatcatagttttgatggtctcatggcgttcaaagaaaccaacgcgaagctgatcattggtgtttctgtgaagttattagatggtatggaactctatgcacttaggacgtatggtcgtatcatttcattagataagtttttcccatga

SEQ ID NO: 5742 - DNA, 1496 bp, Oryza sativa
  Predicted polypeptide sequence is orthologous to G728
acccaccaccaccaccgcctttctcctcctcctccgctccaatccgcgacccttcctccagttcttgttcttgttcttgttcttgttgcaaagattcgagagagagggagagagagttttgtttgttgttgttgttgtacatggggctggacgtgggggagatcgggatggggctggatttgagcctggacctgaagatgttcgcggcgaggagcgccgtgaggatggcggcggcggcggccaaggaggcgacgggggtggaggcgtgcatcaggagcctcgaggaggagcgccgcaagatcgagatgttcaggcgcgagctcccgctctgcgcccgcctcctcgccgacgtgatcgagctgatgaaggaggaggccgggaagaggaggaaggacggcgacgacgcggaggcgaaggcggaggacggcgacaagacgaaatggatgagcaccgcgcagctctgggtggacagccgcggcagcgacgccgattccgagaatgaccgacggagcgggagcacctcgccggcgtcgaggttgctcggcggcgcggaggagtcgtcgtcgagggccgtcgcgccgccgccgtactttaggagggaggaaagggtggttctacgacccgctatgccgttgctgcctccggcttcccacaggtcgcctcctccggcggcggcggcggctgccaccgccgccggcgatgaccaccggcacgttgtcgcgtcaagctttgccaccgccgtgccgtcacccgtcccggcggcgcttagcttgcaggctcaggcgcagcagcagcagcagcaggcgaggaagtcgaggcggtgctggtcgccggagcttcaccggcagttcgtcgccgccttgcagcagctcggtggcccccaagttgctactccaaagcaaatcagggaggtgatgaaggttgatgggctcaccaacgacgaagtgaaaagccatctccagaagtatcggctgcacaaccggaaatcaccaggcacagcttcagcgagccattcgattgtacttgttggtgatctctgggcttctcaggaagtaagctgctctcaatccggatcacctcaaggtccccttcagctctccggctcaggggtggccgtctcggcggccaccgccggcgacagctgctgcgaggatgatgacaagtcggaaggctatgtccgaaaatgatcgaaagatcgtgctcgtggaatcttgctagacagagaggtagattgatggattttcggcttgcgcatcgatgcaaaattgccaataatggattcagaaactctgaggaggatggtagtgttggccatgtatacagggaagattgagctgttgagagctcaagtgatgaactgatcatgagctgggttgttgtggatgtgtagatgaagagctgctaccacccatgaggcttgcaaagtgtcgggcagaccccaaattttcgccctgagatttacatacatattatacataaatatatacaagattcgc

SEQ ID NO: 5743 - DNA, 633 bp, Oryza sativa
  Predicted polypeptide sequence is orthologous to G729, G730, G1040
ttttttttttttttttttgtgccttcacacttcacagtcttattggcttcttatctagccaagctagtcatttcgggcaaatgacactatatactactaactgggtcaagctagctatagcacaccgaaatcaatcaacttagttatgcatgcttggacttcgcggttctgatgtatcattgtgaagccttcccaatcccaagtgtgaactcaaggttcggccgacctggtaacctcaacatagatgtctctaagtccacgctcagttttgtattcttgagatatcttctgtaaatttcattagctggttctctgatgggtaagcctaccttgcctgacgagttattgctccataaaccactgtaaatattggtgtcgttctgttcagatgctagcatacttttgttttgcctcagaggaccgtcagtaaaactgtcgtcggagatatctccagccgatgcattgtcaaacccatcgttattttgtcctgcatttgagaccggtctgtcggtatttttaattgtgcgatacatctgcaggtgagacttgacatgagccagcgttagatccttgacatccatcagctccagcactgacttgggcgttgctcccccttgtctcgtcgctcaccta

SEQ ID NO: 5744 - DNA, 1526 bp, Oryza sativa
  Predicted polypeptide sequence is orthologous to G729, G730, G1040
tcacaccagaaccaccactgctataactctcctcttcctcttccaccaccaccaacaccacaatatatggtcctctactatcataattctagaagtgtatgatcagtttgatccaagaagtggtagagagtagttggtgttgtattctcttccattgatcattgagctaagctatagctgtagcagcagcagcagcgacaacctcccatagctttgatcttgcaatgctgcaaaggaacctgccgaatctctccctccggataagccctccggccgtctcgtcggcggcggcgccggtatcctccggaacaccgacgacggcggcgaggacgactctgccgaccggagtgattacagacgcagaaggaggaggcgaagtagcagcgttctttggaaaccctagctccggcagcgagccccccggtctgagcctggggctcgggccgacgacgccggcgcacgcggacgccggcggcggccgccatggcgaccaccacctgcagccgcaggggtgcgcgccgttcaagcgcgcggcggccagggcgtcccagctgccggcgggctcgaagcggagcgtccgcgcgccgcggatgcgatggaccaccgcgctccacgcccgcttcgtgcacgccgtcgagctcctcggcggccacgagagagcgacgccgaagtcggtgctggagctgatgaacgtgaaggatctgacactggcgcatgtcaagagtcacctccagatgtataggacagtgaagagcacagacagatcatcccacattgcctcaggagaggcgcagctgcagcagcaggcaggaatggaggtggccatggaggcggcagctggaggaggaggaaatggtggtggtggtggtggtggggtggtgctaccgatgatgccggcatgtgacgacatggttgggatctgtagctcccctgcgccgcctgccgcagcgactagttccgctgctgcctacttcctctgcgcgacgacgacgtcaacagcaactgctccactggcagtagtgccatcgcctcctgctccaaccattcccacaaggaggactgaccaaacgccagcgctggaaaagggtgtcgcgattgttgactcgttgcaccggtgtcagaagcataactactcaccagtgcttcaagatgctcttcatcagggagctgaagaagatcatcttattaccgggaacctaccaatgggaggagcatcagcacaagcgagcattgaggccatggcgactaccaactcttcaagccctgcaagctcatctccatcacttgcaagcctggagcagctgctacctgaagactcgtttgcgcccaacctggagatctccctcgggagacataactggaacatggaccatcctgaagaactcagcctgaaatacctgtgaaaaaagccaaaaaaaaaaagaggtttttctctcctctgggtttcactccactaaccattgatgattgctcgatcagatcgttgtgatgatgactgaaaaatatattcagtaaccgcatccatc

SEQ ID NO: 5745 - DNA, 478 bp, Oryza sativa
  Predicted polypeptide sequence is orthologous to G729
tttttttttttttttggcattgacgtggcgcttacatgacaattcgatttgaaaaataatagtcatggacccacacgttagttacaaaaagatagtaatttaaaatggtggggccacatgtcattcttactcccctcctcatcttcctcagctcttccaatctcccctctcttcatcttgtcttgttcctgctcttcttgatgatggttgttatgcaggaattcagagacgaagaattagtgccctgcagctgctgattatgatgatgatgatgagcagttgtggatttaaggctggatatttgtagcaggagatatgcataggccgagagtgttcttaggataattgtatcatctcgatgtaattgactgagttaaataaaaacttccattatctaaaaaggatactctgctgctgctactaccgttgacggtaaaagagtaggcggctcgcagatgctgccgattggtggttgaat

SEQ ID NO: 5746 - DNA, 969 bp, Oryza sativa
  Predicted polypeptide sequence is orthologous to G729, G730, G1040
atggagctcttcccttcgcagccggatctttccctccagatcggcctccccaccggcgcagccgcggcggcgcatggccacggcctcaacgcgaggttctttgccgccgccgcgggagcgggtggccacaacccggcaatggcgtcgtcgccgccgtcgtcgctgcagcttccgcttcccatgccgctgcccatggctccagccggcgccggcggcctgcagttctaccccgacgccgccgccgccgccgccgccgccatgctgaggcccatacgcggcgtgccgctgtaccaccaccaccagcagcagcacgccgcggcggcgccgttcgtgggcgcggcgccgctgccgcaccacccgagctcaggcggcgcgtgctactgcgagccgtgccacgtcgccggcgcgtggcgcaggggtggctgcggcggcggcggcgcccgcggcgtgctcccggcgaagcgcgccccgcgcgcgccgcgcatgcgctggacgtccaccctccacgcccgcttcgtccacgccgtcgagctcctcggcggccatgacagggcaacgccaaagtcggttcttgagctgatggatgtgaaggacctcaccctggctcatgtcaagtctcacttgcagatgtacaggacagtgaagaataccgaaaggccggcagcttcgtcagatcaagctgatgggtttgagaatgggtcggccggcgagatctgcgacgagaactcgctcgacctgcacggcggatgcaggccggaggcgatgtcggcggcggcgcgacatggaagggaggactggtctggcttccatgagtccaacactggaaccatgcaaactctgaaggatatgcaatccaagagcctagagatcatatcagacatgaactcctgcgtttcggagacgacatcgagcaccagcgagctgaacctcgagttcacgctagggcgaccacaaaaccgaccaaactaa

SEQ ID NO: 5747 - DNA, 573 bp, Oryza sativa
  misc_feature (51)..(51): n is a, c, g, or t
  Predicted polypeptide sequence is orthologous to G729
tttttttttttttattttttttgcaaaaaatgtctcaaaatagtacttcangtatataaccatttacctgcatcaatagcacagtgctcacaaatagtacttatagtatataacctttacataattccacagccagtgcatatacttctatagtgtgaccagtagaagtttatatggtatgccaaccatagaggtttatatctcagttactcttaggacattgtctcataatagtactccagtccattcttatcggaatagtgctcgacgtccttgtcttaaggggtatcccctagagcatgtacatcatcctagcagatgggcactggcagggatttcccactgggcatgtccctacatactaagcataactgtccaaaaatactgcacaatctcgggttctaactaatatcccagtcattcgagggttatccctcgtaaagttggtttaaattgactttgaaatcttgatttcaccgaattttgtgaacaaaaagcccatactgttactggaacaacaatgaagtatttttggcactaatgtttggttcacatcatttgttgaggctaaac

SEQ ID NO: 5748 - DNA, 1278 bp, Oryza sativa
  Predicted polypeptide sequence is orthologous to G729, G730, G1040
atggcgtcggcgacgtcgacgacgcccgacctgtcgctgcacatcagcctgccgagcggtggcgcggcggtggggacgacggcgccgccggggctggggaacggcggtgcggttggtggtgccggcggcggcaaggcggcgggtggtggtgacccgtggcggaggctggatggctccacagcgtcgacggagctgtcgctgtcgacgccgcagcagcagcaggagggcagtacatcggcggccgatgtgctgccgtggcggctgcggcagccgacggcggcggcggcgtccgtgccggtgacactgccgacgataccgatggatggttcggcggcggcggcgcgcgcgccgatccgtggggtgcctgtgtatagcggcggcggcggcggtggccacccgttcctcggaggcggcggcggcgaccaccggcacaaccggctctacaacccctaccactccacggcatggccctcgtcgtcgctgtgctcgacgtcgccggcgccggctcctcctcccccaccagcagctctcgacccgacgacgtcgtcgctgctgtcgccgtccgcgtaccaccggatgctctccagcacggggcgcctccacggcgtgctcgccgacaccctccgcggctacgccggcgccgctgcggtggcgggctccatcggctacggctccgcggccgccgccgccgccgccatgggcggctacggcggcgccggcgccggcggcgggttcgcctcctcccgcttcatgccgcgcctcctcccggcgtcccgccgcagcatgcgcgccccgcggatgcggtggacgagctccctccacgcccgcttcgtccacgccgtcgagcttctcggcggccacgagcgagcgacgcccaaatcggtgctagagctgatggacgtcaaggatctgaccctagctcatgtgaagagccatctgcagatgtataggaccgtgaagagcactgacaagccagcagcagcctcagggccgatggacggcagcggctccggctccggctccggcgacgacgagctcctggccggcgatggaaggcaggcgacgtcatcgggcgccgatgcggaccggcggatgtcgttcaccgagcaccggtcctcctccgagggcgcggcgagccatgccggcggtggcggcgacggcgactgctcctcctctgccgtcaactccgacaccatcagagcgcgcagcaattcgccgagtacatcaatagaaacttgggattgtgtttggtgctgttcgttaaaagaaaagtcttag

SEQ ID NO: 5749 - DNA, 1095 bp, Oryza sativa
  Predicted polypeptide sequence is orthologous to G729, G730, G1040
atggagctgttcccggcacaccctgacctgcagctccagatcagccctcctcctgccaccaagtcaatggacttagggttttggaaacgagctcttgaaacctccacgaccaccaccacggcggcggcggcggcaagtacaggtccttccgtcgctacttcctcctcgccgccggtagcgagtggcggggttggcggcggtgccggcggcttctaccagcaggcggccgtcgcgcctgcagctaacggccacggccatggccatggccatcaccaccaccaccaccaacatcaccagctcggcggcgcactccagttcttgcaccgcacccagcccatcccgccgcaggacgcggccgccggcggcggcctgcaggacctggcgttcgcgcggcccatccggggaatccccgtgtacaacacctcgcggccgctgcccttcctccagagccaccacctccagcaccaccagcattgctacgccgacacgatcggcgtcgcgccgggggccgggccgaggtcccccagcaagcaggcggcggcgctgcggctcgccgcggcgcccgccaagcgtggcgcccgcgcgccgcggatgcggtggacgacgtcgctgcacgcgcggttcgtccatgccgtcgagcttctcggaggccacgagagagctacacccaagtcagttcttgagctaatggacgtgaaggacctgaccttagctcatgtcaagtctcacttgcagatgtaccggaccatcaagaccactgaccacaaacaacctgctccaccatatgggcaaactaagactatcatagagatcccagacgacaatctgtttgacatcaacaacactagtgggtcagagtcttctgttcagcaacaatccaattttgacggcaatgaacaaggatccagcatgtgtgctctacggagcaacaactcctcaagtagaggggcctggttccatgacaaatcaagagatgctacccatggagacatcaaatccttcgaggacgtgcagtcacagagccctgaagacgacgacgcctccgacctgaatcgccgccgttccaaataccggagacgactgtcagcgccatga

SEQ ID NO: 5750 - DNA, 762 bp, Oryza sativa
  Predicted polypeptide sequence is orthologous to G729, G730, G1040
cattttcttagctttggaagaagctgaaaaatcctttcagttttctcccaagaaacagcaatggcgactactgctgccaccgcgccggatctgtcactccacataagcccgccttcgccgccggacatggccgccggcggcgagacgatggagcagttggctgagccaaagctgtgcctagggtttggcacggcggcggcggcggcggcggagcagtacaacaatggcggctgcaacctccagcagcagcagcggctgcaccaacctagccagatccagagattcaagaagagcgccagcggcggcagccctgtgtgctccggcggcgccaccggcaccggcggcgttgcggcggcgagatccgggaatggcggtggaggtgggaagaggagctctagggcgccgaggatgcgatggacgacggctctccatgcgcactttgtgcaagccgtcgagcttcttggaggccatgaaagagcgacaccaaagtcagtattggagttgatgaacgtgaaagatctcacgctggctcatgtgaagagtcacctgcaggcaacttatttgcttgacctggtgcagatgtatagaacagtgaagggaaccacagacagaacatgtgctgaaggccatgggcagatgagagatatgggctttctgaggagaggaggtggtggagtggatggctttgacgtgcttggtaacacctcttcaattgcaatcgccaatattagggccttcaatctcaaggatgcaaatatataa

SEQ ID NO: 5751 - DNA, 847 bp, Oryza sativa
  Predicted polypeptide sequence is orthologous to G732
ggtgttaagaaattgttagtgaagtaattaatcaagtaattaagtctgcttaattaatcaactactacacaaagaaaaagatcgatggcgtctcccggcgttgtgtgtactactgtaacgccgacgtcgtcggccgggtcggaccaggtcgtggccggcggcggcgaggcggcgcggcggccggtggcgccggcggtgatggaggagcggaagcggaagcggaaggagtcgaacaggctgtccgcgcagcggtcgcgggcgcggaagcagcagcagctggacgagctggccgggcaggtggcggcgctgcgcgcccggaacggcgccctgggcctcgccgcgcgcgaggcggcgcgccggtgcgccgccgtgcgcgccgagaacgagctgctccgcgcgcgctccgtcgagctcgccgcgcgcctcgactccctcaccgacctggcgcagtgcctgcacgacgccgccgcggcctcctccttcgccgccgcgcccccgatgatgatggcgggcgccgccaccgccttccccaccggcgccgtcggcgccgccgccggcttcatgatgccccagctgccgccgccgctcctcgacgccaccaccatgggcatgcattgcaactactactactagtctactatagctatagctagcgtgtcaagtcttcattaagttagctctagtaagctctctctctctagtctctctacatgtgtccaaagtgtttgtgcctcttcttttgtgttgttattaggtgacctaatcaaagggcaagaaggacatttcatgtgtgtatgagactttattataaatgtgaaatggacatcaaggacaattttatgtggtt

SEQ ID NO: 5752 - DNA, 1407 bp, Oryza sativa
  Predicted polypeptide sequence is orthologous to G732
cacacaatcttgtgtatccgcaaaaccacaatcaacttcgcaaacctaagcaccactactactcttctgcttccccattcctccctccctttcgatctgttcgtcctcctagctctagctagcctctttggtcaggttatagattacatagcaccatgaattattctcctcccggttggctcgatcgattcagctagctgagcttctcgatcgatcaaccgatcttggttgcttcttcttcgatcctttcactccgtgtagttcttgatttgaaggatcgacgacgaactccctgtggcttcttgttcgccgggttcagccgcatccatgtcgatcacggaggctagcctccacttctgctacctccactcgctctccgtcgtgttcctctacttcttctacgtgatttcctgattcgcctcatccgcttcctctccaaacctgatcaaacaaagcttcgtgcacgatccatcttcgttgaaactaaggaccaaaaactgaagctttgtttgatccaaaaaaaatatatattctactaaatgtgttctagcttgttcctttcctagtatcgccttgttcctgcacgcgattgcccaacttggagcacgaaatatttctgcctagtacgtgttcgatcggtgttccacggtgagtgttagtttctctttgtgctctgtgatacattcaagatgtcagttgcgccggcgacggaagggtccgcacgccgctcggcggcggcggcggcggcggaggaggaggagcggcagcgcaaccggaagaggtcgaaccggctgtcggcgcagaggtcccgcataaagaagcagcagtacgtggacgggctggccgtggaggcggagcagctccggcgggagaacgacgccatgcgcgccggcgccggcgccgtgctgcagcggtgccgcctggtcgagcaggagaaccgggtgctcgccgcgcacgcgcgcgagctgtgcagcgcgctccagctccgcgcctcgcagctccgcctgctcggggaggtggcaggcgtgcccctcgacgtgcccgacgtcgccgaccacctcgtgcagctctacggcggcgacctggggatgacgccgctctcgccaccgccgctgctgccgccgctgccgccacagatcgagatgctgtacttccagccagactcggtcatggatccggtcagtatgctgcagggctacgaaaacatatgaaactctacattgtgtacttgacttatgattgttgccacatgcgtgtcttcggtttgtatggtgtgatctagctactgtacgttaatactgttgttgattttacgatccatattcctgttttgattgtgtagtaaaaagtatagcttgttgcgaggtacaagagtggagaaataaataaagtgtgtgaacattgtat

SEQ ID NO: 5753 - DNA, 2210 bp, Oryza sativa
  Predicted polypeptide sequence is orthologous to G732
ccctttttccccttctcccctccttcctcgctaaggttcccttgcttcagcagaacccctgctgggcatcctcctctttcaaaacatcctttgctctccaaccacttcatcttgatgttcttaatctcctatagtctttccctgtgcgaattttttctttgagaaccaaagtttcttagggaaattctgttgaatttttcctttgagaaccaaggtttctcggggagactctgctaaaatttttatcaactagcaagttgaaaatacatcattgtacatatattttgtctgcacatttatatacagtagcaaaacctgtttgtagagggaattattatagtgtttctggctggttgatccatgatagattaaacaaggggaggttgtgacttggtagatgtcaccaatcctctccgaggtcatcctctccggatttatgatcagctcgacgctccggcgaggctctcatcttgtcctctctttctccgtcgtcttcctttactggttctatgtcttctcagtaacatcctagctactgttctcttttatttgatctatccaataccagagaatagaccaccatattctacaaaatacttctcattggaaattatagcttatagacaaaactgagggtgacaatactgtaaggtattttcctgagtgttgcactaaggagggtactcaggacttttattaggatgaccctgtcaggtgggaccctgtcaagcgggataacctctggctcaagccatgggacccggagctcagggtcagagggtgatatccagctgcaggtccaaatggacctgaagcggaaaagaaggaaggaatcaaaccgagagtcggcaaagaggtctaggttacggaaacaacagcacctcgatgaccttacctcacaggtatgtttgaattccttttttttccctatctatatacatatatatataatatggttgcatttgttatgtagattttaatatgtttgtagttcctagctttaattagtttgctttatggattgaagcttgcactcatgtgcaggtgaatttgatacacaaaagcaaaatcagatgaaaaaggacacttgagctgaaggacttgctcaaggaaactccaataatgcacacggtgcccttttttcaaggggccccaactaattgcttcgtacataatacttgaaaaacattaaactcgctatcacttccaaagaaaaaggtgataggcaactagttaccaacaattgctcccaactgtcaaatctggaaataagagcaagctcatcgaaatttcttgatgccgatcaagaccggatcaagcttatgttttgctccggaaatgtgaaggcaaatttctatgaactgtcagatatcgcaagaaaccttcatccagaatttcattcatttttccagattaatcgtaccaacaatagtaggaaaagatttcagaatgttgcttgaacaaattagcaaaataatacataccagtgtaacataaataaatagcacaattcaccagatgcacatggtagatagtaattacttgcacaatctaaaatctgttctgttcatcacagcttccttcagcaaatccaaaaaaaaaatgtttatgttaaaaaggaatgttatcttgattatataaaataggtgaaccagttgaagatggagaaccagcagctcaccacaacattgaacatggtcacccaaagctgtgccttcgcagagtctcagaactcagtgctgcgcactcagatgatggagctggatagcaggctatcagcgctccgtgagataatcttctacatgaacaatggaaaccaatcaccttctaatcctacaatagcagcgactacatacccatccaccactacaatgactgcagcaactactggccattacgattattatgatgttttcactgcaaatgcatggggctcagggatgcaaatgatgcagcagcccatagatcagtttctgtaccagtgctagctagcttctagccaggaagtcgatagagatagtggaccaaattaagaaacagggcattgagatattgggcgtggtgaatgttgtagctaggtccatattaattatattgtgtcaccagtggttgtttatcttttgctttgatttgtgatcggttgtgggggcaggaaaaaaatggtgttgtacctttctgctgttggtggtaagaggccaaatggctattgg

SEQ ID NO: 5754 - DNA, 1647 bp, Oryza sativa
  Predicted polypeptide sequence is orthologous to G732
gcccttttcccctcttccccagctcctttgttaggttttcttccagtgagctctttttgctcatattcagatcttcacttatttcctagttgttactactgcctttgagtattgacagcttcatcctgccaactcagctcaatcttcctctgaagtttcagtctttgtttctgaatctcttcagtgttcagaggggaagttctgccaaaaaatttctctggccatccattttccaaggggagattctgccaaaattttcatctctgtccatcaatattcctggggaggttctgccaaaattttctctgaaatcggttaatttataaggggaggttctgccgaaattttcgctggtcatcaatcttccctttgttgacataccctgcataagtatatacaacaaacatataactttttgcaaggtaagaaggagtttttatctgttcttgatgatagactcctagagaagttgtcctagttgtgtagatgttgttgctcatcatccctgagcacctcctctctagatttatgactggcccagccataacccagcttgttcagtccttctctgttgtcttcctctactggttctatgtcttctcagtaagctccctgtttgtagccttttgaaattacaagacttatttatacaacataattatcaaggcatccacatataaactacaaggtatatatatatatatatatatatatttacaaaaagaaaaggaataagagggagtaaaattgttgccggtgcgaaaaaaaattgttgagaggtgaccatgtcgagtgggacctcgtccgggtcgagccagggaacccggagctccaggtcggaagatgacctgaacctccaggcccagatggagaagaagaggaagaggaggaaggagtcgaaccgagagtcggctcggaggtctaggatgaggaagcaacagcacctcgacgaactcacctcgcaggtgaaccagctgaagaatcagaaccagcagctgagcatggcactgagcctgaccacacagaaccttgtggcagtgcaggcacagaactcagtgctgcaaacccaggagttggagctgcagagcaggctgtgtgccctaactgacatcctgatgtgcatgaacaacaccagtgctactcctactcctacaattccagccaccactacaagtgcttgtgatatttttggtgccagctcatggaaccagccacccatagacttgtaccagtaccagtgcttctgatctaggaataagaagagggttgttgtggtagtgtgggtaggaccagaagccatcaagtaatgtttcaatcatgtagggccattgttgtcactgttaatgtatgcaattcaatcttaattgcctgctgtaggggacagggatatttgctctttcttgtagctgttggtggtagagggattaccagatggcaaaatggtgctttggcaatgtgttaggtggggctggttttggttgttaagggtagggaggagaaaattggtaggtttttcttgagcatgcaagaggggaggcaaaggattttgtgtaatgatgctcttcaaggaaagtattcataattatgattataatgtaatatgtggatttggtggatcttcataggccaagtgcttctttgtgctcc

SEQ ID NO: 5755 - DNA, 549 bp, Oryza sativa
  Predicted polypeptide sequence is orthologous to G732
atggcgtctcccggcgttgtgtgtactactgtaacgccgacgtcgtcggccgggtcggaccaggtcgtggccggcggcggcgaggcggcgcggcggccggtggcgccggcggtgatggaggagcggaagcggaagcggaaggagtcgaacaggctgtccgcgcagcggtcgcgggcgcggaagcagcagcagctggacgagctggccgggcaggtggcggcgctgcgcgcccggaacggcgccctgggcctcgccgcgcgcgaggcggcgcgccggtgcgccgccgtgcgcgccgagaacgagctgctccgcgcgcgctccgtcgagctcgccgcgcgcctcgactccctcaccgacctggcgcagtgcctgcacgacgccgccgcggcctcctccttcgccgccgcgcccccgatgatgatggcgggcgccgccaccgccttccccaccggcgccgtcggcgccgccgccggcttcatgatgccccagctgccgccgccgctcctcgacgccaccaccatgggcatgcattgcaactactactactag

SEQ ID NO: 5756 - DNA, 838 bp, Oryza sativa
  Predicted polypeptide sequence is orthologous to G735
gctgggtaccgggccccccctcgagtttttttttctttttttttagggccaagacaatttataactttatatgactcaatacaatgatactccctccgtttcacaatgtaagtcattctagacatatatatcacaatgtaagtcattctagcattaccaaaaaccttaatacgccagagcaccagaagctggttttagagcagtatcagtatacctgctgttactacttattatcacaggcagtagcttcaggcaatgacaaggctgatgctgcctcaaaatgtgtcacatctccagcatggattctcttctgcaggttctccaagcttgcgacacgccgcacggacggtgacctcaaggccattgctgcacttggcacaggaattgcttcatctgggaggctacagtttgtccagtcgtcttcgacgagagcagcagcagcagcagcagaagctgcgtctgatacacctgaagaaacgggcatgctgcttgcaggcatttcagatgtagtgaacaattgaagtcctattccagttactctcctcaccgcttcttcagctatattcacctgaacacaaagcacttcgttacaacgtaaacgatatgaaaccataagattattagcaaccacaagctacattaatataaattattttgagaagaacaatagtataaatcagtgtctcagttgtagctccacaacagatctattacagtaaacattttacagaatttaagttaaacccgagctgatgtttttgggaaaacaaattcaactttatatataaagggacagaacaataggttcttatgtatacatgttccttttgatatctct

SEQ ID NO: 5757 - DNA, 528 bp, Oryza sativa
  Predicted polypeptide sequence is orthologous to G736, G2432
atggcgaacctcccctccaccgccgccgccgccgccgcagacgcctccgggttcaagctcttcgggaaggtgatccagcccgacggacagcggggcgtggaagagagcgcggcggcgcaggcgccacctcatccgcatccgcctgcgccgccggtgatggaggcggcggcggcggcggcggggacgtcgcagactctgcaggcggcgggcggtggcggtggcggaggagggggaggagggggagagccgctgccgtgcccgcggtgcgggagcagggagaccaagttctgctacttcaacaactacaacgtgcggcagccgcgccacctctgccgctcctgccgccgctactggacggccggcggcgcgctccgccgcgtcgcctcggcgtccccgggaaggcgcaggccccgccccagcgccgcccgatcggccgccgccgccgccgcctccgcctccgcggcgtctccccccgccgccgtccccgccgcctccgagggggcggagagcgttgactcgcggtcgtag

SEQ ID NO: 5758 - DNA, 1250 bp, Oryza sativa
  Predicted polypeptide sequence is orthologous to G740
gatcgggcacacgcgtagcgagacgaggggaaaaaaaaatcaatcaaaccctaatcagatcagggagaggcgagggctagggtttcgactcctcggcgggcgatccatggcggcggcggcgaggcatcgggggacggtgaagtggttcaacgacaccaaggggttcggcttcatctcccccgacgacggcagcgaggatctcttcgtccaccagtcctccatcaaggccgacggcttccgctccctcgccgagggcgagcaggtcgagttcgccatctccgagagcgaggacggccgcaccaagtccgtcgacgtcaccggccccgacggatccttcgtcaagggcggcgccggcggcggcggcggtggcgggggaggcttcggatcgcgcggtgggggcggatctggcggtggcggccgcagctatggcggtagctggggcggggggaggagatccggcggtggtggacccggtgggggctgcttcaagtgtggggagtctggccacatggccagggactgcttcaacggcggcggtgtcggcgttggtggaggcggtggcggcggcggcggcgctggtggtggctgcttcaagtgcggcgagatgggccacatggctagggactgcttcaacagcggtggtggtggaggtggtggtggtggcggcggcggcggcggcgcctgctacaactgcggcgagaccggccacctcgcgagggactgctacaacggcggcggtggaggcggaggcgggcgattcggcggtggaggcgaccgctcctgctacaactgcggcgaggctggacacatcgcccgcgactgccacaagtgatggattcacaacaccatctcccccccccctcctcttagatctcgcctaaatcttcatcactcctaagtcgaattattgctttagttttgccgccgatctgggtcacatggagagcgcgttgcctgctataaaggaaccgcttgccttttgtttttacctctttttctttttttgctattgggatttcggtttagttttaacttctgctgctgctgctcgtgtgatgatgcttttgctgctatgagttggtctggtcctctggttcaggttaagaagacgtgatgtctggattggttttgtgtgttgggcgaggagattgacaaaatctctctcctttttgtggtttccccgagatgaaaaagatgattattgtcggttactctataatttttaccaccttgtcgattccatcatcagc

SEQ ID NO: 5759 - DNA, 531 bp, Oryza sativa
  Predicted polypeptide sequence is orthologous to G740
atgacaatgacgacaaggagggaggcgggtacggcagcgggttggcgagcatacgcaaagagggagaagggcgggggacggtggccagcccttctcgccgtcacttgtggcggccgcggcgagacctgcaagtgttgggcgggctgcctcgagtaccctgaactgcccgagtcgagcggctggccaacggagcggggcggcgggcggcttctagggttcggcggcgagggcgagatggtgtcggagagggtgaaagggatggtgaaagggttcgatgccactaatgggttcagcttcatcactcccgacgatggcagcgaggatctcttcatccaccagtcctccctcaagttcgatggctatcggagcctcaacgacgacgatgtcatcgagttatctgttggatccagcgacgacggccgcactaaggccgtggacgtcacggcgccaggcagtgacgcgcacaccggcggatcccgtcccagctgcggccatatccctacggctggtcgtcccctagtcgtctcctag

SEQ ID NO: 5760 - DNA, 1056 bp, Oryza sativa
  Predicted polypeptide sequence is orthologous to G740
atggcccagcaaccgcgcgctctgtgtgcggtccgtcggcgaggaggtcgaggacgaacacttccgcaccatatcttccccccgccgacgtgtcacgtgcctcgccagcagcgcccaatcaacttgcgcgaggggaacagcaaagacgtcgggtcgcggcaggctacgggctacggccaccgggaggaacttcggcagagggcccttccagacttcccgtaccgggcggcgtcgagggcaccgaccgcaggaggagctagcgcgagcccgggcgaagacatgcggcaggcaacgagatgttcggcgtcggcgaacgacctgagcccaaacgacgaggagcgcctcgccaccatcttccgcgcggacgtgcctctccttcgcatcaggggaggcacgcccatctggacaaactgcggcggagatccccccatccactcgccgtcgacgtcgagggcaacgacgcgcgcggaccgcggacgcggcttgtggcgactggcgagcgaacagccgcccaccgccgccggagacgatgtgctcgtagaaaggtggcaatggcgcgtgcgctgcgtcctgtgtcgcggggagcacgatgcagctctcgccctcggccggcagcgaacggagttggaggaagaagggtgccgtgcagatccctcgcttgcgggcgagcacgtgaagagagggagaaggatggcggctagcccttctcgccgtcgcttgtggcagctgcggtgggacctacaagcactgggcaggccgcctcaaggagatgtaggaatcgaggtcgccgcaagcaaaggggagcgagaagggcgaatagggcagcgggcagcggaggacctcttcgtcaaccagtactccctcatgtccgacggctaccggagcctcaacgacaacaacatgtcgagttatctgtcggatccggcaacgacggccgcaccaaggccgtggaagtcaccgagccaggcggcggcgcgctcaccggcgaatcccgtcccagcggcaatggggattgcagctaggttgggggtgaccacggctacggaggcagcatag

SEQ ID NO: 5761 - DNA, 606 bp, Oryza sativa
  Predicted polypeptide sequence is orthologous to G740
atggaagctggcctggatgtggatttggcggcggagggaggtcgccggagagaggccgtcgtccccgctcccctgtcgctgaagccagaggaaactggagcgagtcgccggagggagtcgtcgctcgcgcacacggttgacggatgggtagccgataagcgcacacagagagggagaagggcggcgaccagcggggcgaagggcagggggcggcggccagcccttcccgacgtcgcttgtggcggccgtgacaagacctgcaaagcactgggcgggccgcctcgaggagatgtaggagtcgaggtcgccctagttcaacggctactagagctcaactacagcaatgagttatccatcggatccggcaatgacggccacaccaaggtcgtggacgtcaccacgccaggtggcggcacgctcaccggcagatcacatcccagcggcggcggggacggaggttacggcgagggcgaccacggctatggaggcatcagcaagaacaatagcggaggaagcggttgtgcgtgctccaagtgcggtgagaagggccacatggccacgaacatctcccagggcggcggcacacaggaggagtacaacgggtga

SEQ ID NO: 5762 - DNA, 447 bp, Oryza sativa
  Predicted polypeptide sequence is orthologous to G740
gtttgaagtatcctttttcggtgtctcaatacctacctattcatatttttgttctacaaaatccacttattggatcatcgttattttttacttttccgttttcttactctacttacccatcaagctccctccgagtccataaagacctatcttcaaaatgtcttccctctctcgacgtgcttgctacaagtgtggcaatgttggccactacgctgaggtctgctcttctgccgagcgtctctgctacaactgcaagcagcccggccacgagtccaacggatgccctcttccccgaaccactgaggccaagcagtgctaccactgccagggtcttggccacgtccaggctgactgccctaccctccgcctgagcggcactggcaccagcggccgctgctacaactgtggccagcccggccaccttgctcgcgcctgccccaaccctgt

SEQ ID NO: 5763 - DNA, 1891 bp, Oryza sativa
  Predicted polypeptide sequence is orthologous to G744
ttggcgaaacaacagcgaaaagaaaagcaaagcttggagagagcttcacttcacgtcttcaccttcctctgctcccggagagcctctccctctcctctcctctcgcctcggcctcctctctctctctctctctctctctctctctctctctctctctctctctctcatcaccgcctccccacgccaacccgcgcgacgcacgcggcataccaagaaaccgcgcggcgcgcgcttcccgggggggcgcctgccttcgatggaggtcgcggccgcggaggacgcgctggaggagagcggcgtggcggtgtacctccccaggcttctcgccggcgtcatctccggcgctctcaccggcctcttcgctctcgctggggccttgaccggagcggtgaccggcgcgctggccggaagggcttcagacagcggcgtgctccggggagctggattgggggcgttcgccggagctgtgctctccattgaggtcctcgaggcttctcgtgcttattggtgctcggaccggctgggctctcatggcacatcctccatggcagatttcatagagcagctcctccaagcgcggtttgtgcaagagcaaattgtaccttcaggatatgcaacgcatcgttggcaggtcagcatttcagattttggtcatgatgatctgtatgatatttttggagattgttcatccaaagggctttcacgggagtcactgaataaattaccacactatgtggtcactgaccaaacacggaactcgtttggtgaagacctctcttgcactatctgcctgcaggtacatttatcaaaattagctttatgttgtcgacaaacctgcctggctgccttgcacaattttgcacatggtttaggttcaacaacgataataaaagcaaaacaacatccatttcatgattgcagacaatatagtgaatgtttagttagcatatttgagctttctcctttttggcaaagtttgttaagaaaatcaagatcaccagtgatttgaaaattggtgatagcataccactacaagtctccatctggttgttagtgatggctgatcacatatagtagtaactgttctaaacataattgccaagggggtaaatgggaagacatcttcaaattattcatgaaattcttttgaccttcttcatagaacgttttaaacctaactcgtcctgaccattgaatacggtctattacttgatcaatgatttccaaccagaaaccaaagcttttcccgaccttgttgaaccaggaaatgcggcccattttttagattgataaatgaaacattcaagtacatatatatagctggatagtagatatgacatgattgttatggtgtgatatgtagagcagggagatgcaacgacctccgtttttatgttccccttttgtggcaacttgcataccaaattatgcctgctactaaatgcaatgtggttaggatttgctttgcaacttgctcactccctacacacactcaatgtcactgcttaattaccgctttgcaggatattgtaaccggtgaaacggcgaggagattgccgaattgctcccacactttccaccagccttgcgtggacaaatggctcgttggccatgggtcttgccctgtatgtaggcaatgtgtgtaacaacagaaggtaaaaaaaaccctgcattctgcaggctctccatcttattagaagagactagttgtgcaaatgtttgctcttgatagcacccaccacagagttaattatacacagtagctttgtaatttactgtactactagataggcgtatcttttaccagcgtaaacagaggctgtaaatcagaggatttgacactgtttcttacgctgagtttcaatgtaaaatggaataaaggtttctctgt

SEQ ID NO: 5764 - DNA, 1174 bp, Oryza sativa
  Predicted polypeptide sequence is orthologous to G748, G1900
tttttttttttttttttttttttttataaatgtctcctttatttattattgatattaccatccagtatgcatgtatacactccccaatttatccatgcaagttctataacaaaacacacactgacacacatgtaaggtgtatagatagtctacagcttgcaagaacatgagttatatgtgttccgatgtatctatgtcctttttcttccatcggtcggccggcttgctaggcgagttcggcaaggtcatcatgcagtgcggcgtttccgaggggacacaggacaaggcgcagggcttcgtcgtggcccgggagaaggttgaaccggaggaggaggaggaggaggagcagcgtgtcccggctgctgctacgtcggggcagcgcgcgtcgatcaagcgggaggccgcggaccgcgacgaggagcaacggcaagggggcggggacgcggcggggcagccgacgcagcggcggttgcaggactcggccgaggcgcgtgcggccgccgcggcgccgctgccgtgcccgcggtgccggagccgtgacaccaagttctgctacttcaacaactacaacgtcaaccagccgcgccacttctgcaaggcctgccaccgctactggacggccggcggcgcgtccgcaacgtccccgtcggcgccggccgccgcaagaaccgtcccctgggccccctcgcggtcgcccaccataaccaccaccaccgcgcggccgccggcttcgtcctcggcttccccaacccgtcctccccaacctccccgtcgccggtctacaccgaccggtggccggtcaccccggaccgcccgttttgatcccgccatgcatccagtcgaaccaaccggcttggatatagcttccctttgacttgctgcagctgggttgcggaggctagcttggcttgcttgtacgtgaggcttacacaaacacatggtagatggagatatcgaatgggcttttctttcttttttttcttttctcctcttgctagtaccaccatcatagcatgcagcttctctctccttactactactatcctgctagtagtttgtttcttcctctttctccttttgttgttttctaaggttgcgggtgtaatgtaagaatggaagtgatgaggttgcggaggcaagttgcgaactccgtgcaaaaaaaaaaaaaaaaaaa

SEQ ID NO: 5765 - DNA, 1170 bp, Oryza sativa
  Predicted polypeptide sequence is orthologous to G748
atggagaacggcgactccagatttgttagggatttggtgtcgccgatgcctggaccgccgctactgccgacgcaacaagcgctgagggcactgtcatctttgcagattatccaggggcttagagtggcatcgccagagcggttgccacaaccatcaagcggccagcgtcgtatcttgccgatggccccacaggcacgacggtggcgtgctgatggcagcacaactatgtctgtggcatcgttgccgctaaaccaggtccgtgctattgggttgtttctcaataccttcttggtggccacaatgaggcgccaggaggggcccctttaccacaatgctattgtaatccctacgatagcaccggcaccggcgccggcaccgccgaccacccagatgctcgccatggagaacactatgccagctaccgtggaaccggttaccaaccacaggatcatcaaccatgatatcatgcatttcatgagggaaactccagatatccagaggctccacggcgttgtttcacctgtggcggtccatggtaacgggaatcccctttcatgcatctattgtgggctggtgtttgccctcaggtcatcggaaatcccggggttcctccctcctcctggatttagctacccagaacccatgggaccaccaccattactgtcattgtttccaccagcaagagatgcttctcggatagcagcggtgtgctcagacccacatcattttgctgtcaccatgcaatatatgcccaagcaggaaatggctgatctcatttggtcatccgagataccaagcatccacattccgtcagctgcaggtggccagcatgttggaacggtgccgtctctgaccggtatcactagtgccaccacatcaatggtgaacctcatgcagatgccggctatccacatggagcagcacatgctacatccaaccatgttaaactcatctgcttctccggaatgtatcactagcactgccgtaccatcaacgctgaacatgatgccaatgcgggatatcctcatagatcagctttcactgcctcctgccatatctagctcatctgcttctggtgttctctgtgagtacgtgatgcctgagcacgaggacatggtccgcctcaccttgggtcagtcatccaccatggacctagatcttagcttctag

SEQ ID NO: 5766 - DNA, 2525 bp, Oryza sativa
  Predicted polypeptide sequence is orthologous to G760
gctattattattttctttctcatcacgcggctgcgtccgtatcgcgacttttatcctctcctccccaactaactcggcgttcgccatctcgtgtcgacttcctcctcaaaaccctaattccatccaccgctcgatccaatctaccctctctctcgattctcaattctcaattctccctgcaaaattcccaatcctccgtgcagaattagaattatgcgggattgatcccctcccacgggatctccaatatcatatccatccagaaattgaaattcccctcgccgccgatgagccaatcgccgccggactcctcctccgcggcggcggtgcccctggcgccggggtttcgcttccaccccaccgacgaggagctcgtctcctactacctccgccgccgcatcctcggccgccgcctccggatcgacgccatcgccgaggtcgacctctaccgcctcgagccgtgggacctcccctccctctcccgcatccggagccgcgacgcgcagtggtacttcttcgcccgcctcgaccgcaaggtcaccggcgccggggccggcggccgcggcggccccgggaacaggaccaaccgcgccacgccgcgcggctactggaagaccaccgggaaggaccgcgatgtccaccaccgcggcaagctcgtcgggatgaagaagacgctcgtcttccactccggtagggcgcccaagggccagaggaccaactgggtcatgcacgagtaccgcctcctcgacgccgacggcacccaggatctgcatgtggtgtgtagaatcttccagaaaaatggatctgggccacaaaatggtgcacagtacggtgcgccatacttggaggaagattgggaagaggaggatgatgcaattgagaacatgcctgccagtggcgctttcgctgaaatggctgcagtcacagatactgcagatgagtcgactgaggaagatgggaatttctcccttaaaactaatgatgagcctttacaaacccaagaataccagccagagataactcctgtgaaagctcaaggttcaaatgaggagaccaatggcggtggttacagttgtgatgttttttctctggatgagattttgcaggaacctgaaaatgtctgcaaaaatgaagagcagaatgccattgatgacaagttcactatcgcagagttatctggatacccaaggcaagatgatggctatgtaggcgagaatggtcctgtgaattggattgacccttcaaatggtgataatacaaactggcctttgagagcatatagtactcagaaccatgtcaatggaacacttagcgctgatggtttctttgacacggtgaatggtaccaactcatattcaggtccttcagataaccagaacctgtatttgcaagatgatggcttgacttcttctcatcaagtgggcgataacatgccattttatgacgcatcatctaatcacaaatgggtagatggaaaggatgattatttgaatttgaatgacctcctctacccgccagcagaaaatcaacccctgtttgatgctggggatgacctgatggcttacttcgatgccacggaggatgatttcaaatttgatattatgggcacagaagattctaattctcaacttccagacatgtcgaactttgtccaaaaggatgataacaacaataagtttacattagatgggatctctaataccgctttgtatggtgcttcttcatctggatcccatggcaatatgtatccagacactgcagtaccagatatgccgatggatgacactgttgacaaaagtttcggaaagcgccttgccagcatgctgggttcaattccagctccacccgcaatggcttcagagttcccgccgagcacaggaaaatctgttgtcccacttagtgctgtcaacccgagtagctctatccgtgtcactgcaggcattatccaactcggtggtatcacttttactggtagcaccgagcacctgcagaagaatggagatttcaatttgctcctctctttcactgtcgagggcgacgtctcaaccaaatccattggttttgaaccggatacgcagatgagcaccacgccaatggtgttgcgcagcggcatgtatcttttcttcgtatcggcgatgattctcatgttgagctacaaagttgggctgtgtatctacagcaggtaagttatagtagtttttgttgccccaggctgtttattaaattgaaggagtcatacagagtccactcgacgtagagggaactgcctgcgatttggacagtttggttctttacattgttatagttggtataccgttctgacagttgaaagatacatagcaataaactctggaattggagaaactagagttacacgaatttggtgctgaaacttttgttggtggcatgtactgtataatttactctatttatttatttcacccaattctgggaggctgtaagcgttccccgatcgatgtaagctgatctgaaacctgaatacgcgctcttcatttttcataccc

SEQ ID NO: 5767 - DNA, 1857 bp, Oryza sativa
  Predicted polypeptide sequence is orthologous to G760
gacccgctcgcgcaattcgcacgctctcctcgcctcgcctcgccttctcttctctcctcacctcgcccgcgtcgtcgtcgtcgtcgtctccgcggcggcgggggaagcagcgggaggcggaggcggagcagcagcagcaccaccaccccggggcggggccgcggcgcggtgctcgcgcgcgtcgactccgtgtggacaatcatgtcttctaaagttcctgggttagcattacttaacaccagcataagcaaattttggagcgatgaggagcttgtccgattcttagcagagaggaaagaagcacactctctgccagagaatgtatttgtgggaatgaacatttctctcattgatccacgtaactcagaggacatatggtacatgaatttttcagatgatccacaatcccctaagaatggagaaaatgctattataaagtcaaaaaccggatactggaaagttgttggcactgttagaataccgacaagtactgttattgtgggtatgaaagtttctctggaccattatgaaggcgaagcaccatctggtaagagaactgggtgggtgatggatgaatatctgattgaacagaatgacgaagctaatctaccacaggactacaagaatttgtgtacaatattctttcagggagacgacatattaaatgctggagataagcagatatgtctgaatgcaaatgttcctaatgaacgcaaggaattttaccttcaatatcttgctgaactagaagagcaaaatgctgcatggagcaaccaggctgtatctgtaaacgagcaagatgtctcttccagcaaaggactggacgggcaaaaaactagtgctgctgatgaccaatctgttaatcatgccccttctagggagggctacatagaattgaatgacttcttaaactcagattcgtccgcatcaacttcggaatactcaagtcaacgcactatgatttctgaagagtacttcgattctgatgcatttctgagggagattaggaatgaccataacgcagctgatgaagaacatacagacagcaagttcagcgtagctgcagctagtaaatcagattgcgtggttatcagtccacctgaacaagggtttgttaacaatctcgataaccatgccaccatagctggagattcaccgcaaaagtcagtgaaaaatgataaagtagacgaacactcaagtgaggagcatccacagcacagtcctacaacttcctgtttcccaagtcatgtgaaacgaagcctttctagtagttccagtagctctcagggtaccagcaacagcaagtctccccagagacagagagagcgatctaccaaaaaaattggaaaattaggaaagtactggtgttgtggatcattatagtccattgcatagcatttctatactctgtacaggaagcatgacattacgccatgctattttgatacggactggtcgcctcaacagatttatgccagatcttctgatagaacatagtcaaagaagactgcaagttttgaagcaacaatgaccaacaatactacaaactgtggaaagttacatttttgttttgttcatagtgtgaagatatcatgaccttgatgattctgtcaaactgaagtgagctaccttgattccattcttgattgatagggtcagatattcactgatacctgtgttagttcagtgaaatgaggatggcagtagtttctgattatcaccaggtgctctcatttgtaaacatctacagtacagtttcatatgatagaatttcacattttagtaagtactaatactgattgctcaatacttagttatcctgcttgcatttgaaggagtataagcttttgatttacg

SEQ ID NO: 5768 - DNA, 298 bp, Oryza sativa
  Predicted polypeptide sequence is orthologous to G760
ttttttttttttttttttttttttttttttttttttagaaacaatttaacaacccaagggtgcaaccctcccccttaattttaaaaacaaaactcaacgggcccaaccaaaaaatttttacagtaatcagcaagcccttaacaggaaccctttacccaaaaaaaaaaaattcgaaatcgacgggggaacttcccccggtgccatggactcccttcaacaaaaaccaaaaaaaaattccccaaccccttctacccttaagcccctaaaaactggggaacttggggacggccttggggcc

SEQ ID NO: 5769 - DNA, 2626 bp, Oryza sativa
  Predicted polypeptide sequence is orthologous to G760
ggctgcgtttcgtttcttccccaaaaaccaagggggaaggcaaactttccccaaatctcaaccccaatcccaatctagggcacatgagccacccctcgtcgtcgtcctcctccgctcccccggcggcggccgaggccacctccctcgcaccgggattccggttccacccgacggatgaggagctggtgtcctactacctgaagcggaaggtccatgggcggccgctcaaggtggacgccatcgcggaggtggacctgtacaaggtggagccatgggacctccccgcccgctcccgcctccgcagccgcgactcccagtggtacttcttcagccgcctcgaccgcaagcacgccaaccgcgcccgcaccaaccgcgccaccgccggcggctactggaagaccaccggcaaggacagggaggtccgcaacggccccaccaccgtcggcatgaagaagaccctcgtcttccacgccggccgcgcccccaagggcgagcgcaccaactgggtcatgcacgagtaccgcctcgacggccaaaccaccatcccaccacaggattcattcgtcgtgtgccgtatcttccagaaagccggcccaggtccacagaacggggctcagtacggagctccttttgttgaggaggagtgggaggaggatgacgaggatgttggtttgctaccggtggaggagaaggacaactctgatgaccaggaaaaggaaatttctggtgctatggagaagggctatctccagatgagtgacctcgttcagaacttggttgatcaaaatgagaatggtaccattgccttgccagtttctgacaattcaaacaacagcaaccattctgaagacgtggatggaaattcaggggacattttaagtgaccaaaaccttgggtctaactttcttcaccatgttgagcctgtggagcaaaatggcctagtgcttaatgaaaatatgttttctagtgccaatgctggagacctttttaatatatctagccccaatgatggattcctagaactgaaggattttgcagatattgcagatttggagaatcctttagccaatgaatccaccatctggccttctgatggttggccctggaaatcaactgattccatggaggctgtgaatggggctagcaatgaattttctcccttagctggtgaacagatattccagccagaagaattggaacagttgttacagtcactgcaagaagactctcatatgggttcaactatctctgatcccccacattcatctataacaaatttagctaagccagaggaagattgtctaatgttctatgatgcaccctttgattcttcaatgtgtgatgatggttttagacagctcaatggatttcttggctccccatcgaccaatctatctggtattgacatggtggacgatggtatgccgtactatgatgcgatggatgataacttgtttaatgatcttctgagctcagtacagccatcagctggtagcagttcccatgcttttagtgggccagtccttactcaagaggtcaacaattcaacctatacatatagtccaactcaaaaggttttagaacctaattttgtagttggtgccccatcatctgctaggttacctgaagcgggtagtcagttaaattatgttgttttaccagattcccagaccaagagtagtctgatcgggaagcgttttgtaaagatactggattcaatctctgctccccctgcttttgcagcagcagagttcccagctagccttcgcaaatccttggctcctatttctggagctcatcacaacactatccgtgtctctgctgaagtaatcagcataggaagtttaactcctgattctcaagataagtggtcccttgagaaggatgaaggcatggagctgctcttctcggcaggttttgagcctgatacccgtgtacactttggctgcaacacaataaccgcagtactgcgtggtggcttctgcctcttcttcttttcagcaataatgctcttggtgagctacgaggtgggcatgtgcatctatggcaagtaggcctgctggtattggagacgttaagaacatgacgttaggtaatcctatctgtatttgaggcaaactagggacctcctgctgctggcttaatgtattgcactgcatgacattacatgacctccatgtgttgaacaagggctgaggctgtttaactatagcactagcagtaccgttttgcagctcgagagagctagtagtgtatgtatgaattcctcaggtgctattcgtagtagtaagcgcgaattgattattatcagttcatgatggtgctactattcatattcatgtttctggttggcatgggcggtgctagtgcaaactgcagagtgctgtaaatattccccaaatctgcaatgaattgaacgagggtgcatttgcccttatgactgttgcggtgttgcaggtttttgaatgagaaggaaagattactatgtagaaaacgctgtgttgtatttgtcggtcgcaggcatctggtggtaaattctgttactgaagaaagtccttgtcgctatatatttgtgtgtttacttatgctcttgcctggaataaaactcgaggatcttttcctttgc

SEQ ID NO: 5770 - DNA, 765 bp, Oryza sativa
  Predicted polypeptide sequence is orthologous to G773, G1412
cattccaaaactttcgaaagcttccattagcgactaatccagccttcgttaagggtgattagaatttgattaatttcaaggcctcagatcggagattgaatggagtgcggtggtgcgctgcagctgccgccggggttcaggttccacccgacggacgacgagctggtgatgtactacctgtgccgcaagtgcggcggcctccccctcgccgccccggtgatcgccgaggtggacctctacaagttcaacccatgggatctccccggtaagcaagagtaaaagcagatcgaatcgaatcgaggaaattgaagtcgaattcaaattcaattaattggggatttggaattgttgcagagagggcgatgggaggggagaaggagtggtacttcttctcgccgcgggaccggaagtacccgaacgggcagcggccgaacagggcggcggggacggggtactggaaggcgacgggggcggacaagccggtgggtcgccgcgggcggtggcgatcaagaaggcgctcgtcttctacgccgggaagccgcccaagggcgtcaagaccaactggatcatgcacgagtaccgcctcgccgacgtcgaccgctccgccgccgcccgcaagctctccaagtcctcccacaacgccctcagggttagtatttacttcttttaattacttacttctcctaatctaatcatctcttgctttcaatcatttctcctcaccaacgaatttacccccattttattttttaaaattctacaagg

SEQ ID NO: 5771 - DNA, 951 bp, Oryza sativa
  Predicted polypeptide sequence is orthologous to G773, G1412
atggccgacgacgacgagatcgctcttgagccaggctacgtcttccacccttccgacgacggcctcatcaccctcttcctccgccccagcatcgccaagatccccttcgaggaccgcctcatcaaccacgccgacgtctactccgccaatccggccgagctcgtcggcgagcacagaccggcgccgggcacccatgggagcagcagcgtctggtacttcttctgctccccgcgcttcaccagcaagcgcaagacctccgggaggcggcagcgcgcggtcggcggcggcggcggcggcgagagcgtgtggaagtcggagggcggcaagaaggccgtgatcggcgccgatggccgccgcgtcgggtacctccagaagttctcctatggcgtctacgagtcgtcgtcgtcggggtcggcgcgcacgttcacgaggctagggtggtgcatgacggagtacggcctcgacgacgacgccatcgacggagcagacaagcaggtgctctgcaaggtctaccgctcgccgcgcgcggtctgcgcggaggcgcgcacggcggcggcggcgaagtcggccgattcgccatgctccggctcgaagaggaaggcggacgacggcgcggatcacccggaggcgccgcccagcgcgcggccgcggcaagaggaggccgggagcgagcagccggcgatcctgccggagttggacctggatgcgttgctgtcggcgccgatggacgacagtttgggagtggaattcgacacggccacgacggagcagtacatgaggtatctgatgaacgacgagccattgccgtgggctccgacgatggaggttgccggcggcggagacgaattcatcgagacgacgaacggaccttgcatgggcgaagaggagatcatccagcggctggcttccggagaaaccctcgacgacattcttggctcgaaccctaattaa

SEQ ID NO: 5772 - DNA, 951 bp, Oryza sativa; identical to SEQ ID NO: 5771
  Predicted polypeptide sequence is orthologous to G773, G1412

SEQ ID NO: 5773 - DNA, 1548 bp, Oryza sativa
  Predicted polypeptide sequence is orthologous to G773, G1412
atggcttacgccgttgtccgcaacccgatgcccgatggcggcgagttcattcctcgtcacaccacgcgcgagcagccggcggatggggacggcggcggcagcggtggaagcaacaacaacaatgggaagttgaaggggaaggagaaggtggtgccggagtacggcaagaaccggcacggcatgcctgtcggtttctacttcgtccccatggacctagagcttttcgccatcctcatgtgcaagctcgtccgaggtgaggtccccggcgccctcaataacgtctttgagcatatcaggatacttgaattccaccccgccctcctccgtgagacgtatatcgagaacatggaggacagatgcatctacttctttagcaggaggctattcgcagcgaaggctaggaacaagaggcagccgatgagggtggcaaacggtgggacgtggaaggcatctggtgggagcaagacggtgaggagcaagaaggttggcggcatcgatgttggtcagaagctcaccatggtgttctacgagcgtaggttcgagggcgaccaaaaccctgtcaagaccaactgggccatgcacgagtacaccaagatcattcctagctccaaaaaccagaaggaaggaggacacagagccggtgaacgctgccgccgcggcgtcgagcacggacaagccctccacgccggaggcactgccaccgcctacgccaccgccacggccattgctgaacatggccggatcatcgtcggcaacgtcgctactgccaccgcaattgccaggcctggctgggtcgtcgtcgacgatgccgctggcactgccactgcagctgcctggcctgcccgggtcgtcggcggcgatgtcgctctgccgggcttggctggagagatgacgtccatggcggaccaggcgaacatggcctcgacgtcacaggcgtcagcaccgtcgtcggagctcccgcaggactggtacgacgagtacgaggtcgcgtacggtgccgcggcgccgccgtctcctagcacgatcagctgcgcggcgctgccgagctcgccgacggcgtggtggccgtcatcgatcggcgggccggtgcagcacgacggctacctcgggatggcggatcctgcgtcgtgtaatacgttggaacacctgttgcccagcgcggcgatcccaccagagccaatggcgccgccgaagaactcgccggcggcgccaccaccggccgacgccggcggcaactacgaccacccggagctcgccgactacggcggcggcgtccaggcgcagcacgagcatcatcagccgcaggagctgacggatggcgcggacggcgacgcacagctagagctaggcgccgcggagtttgattccgaacgagtagccgaaatgatatcccaaataatggatggtgaattcgtgtttaaatttgaggacgacaccattgttagcttcaacgaggtggcggcggcgccgatgttgatcgacggcggtggggacggcgacggcgatggtgcagatggaggtgtcggagatgatccattcgataattag

SEQ ID NO: 5774 - DNA, 866 bp, Oryza sativa
  misc_feature (636)..(636): n is a, c, g, or t
  Predicted polypeptide sequence is orthologous to G778
ccttttttgagacgaaagtcagacaagatgatgaattgacccccacctggtccatcagaccaaagtgcaattgcttgcctctacaaaaacacagctgtacatgaccatctgccggtttatacaggtcaagacaatataaatatactgtgcacctctaaagaaaagagggtagaaaaatatacaccatgccacggttgttgtgacgccgtactatttcatatctaaccacaagattaggaatttactccctccgtctcaaaatataagcatttttagccgttgtccagattcatagccaaaagttgttatattttgggacggaggtagtaggcaaaataatattcagtgcaaatacaacaactagcattttacatgtactacttgtagtaagtaccatgtcacgatcattgtctggagttgcttggctggtcctgctgctgctgctgctggtggtttagcttctggtacattgccatcatccggttgtacgcctccatgccgttcggttgctgtgcgttttgctgcgccgcttgggaggcgaggaaggcggagaaggcgtcggaggtggcggcgccggtgggctgcggcggtcggtcggcggcggcggcggaggaggaggatgcggcggcgtcccangagacggggaggaaagggggcgtgtgcatatgcatgggcgcgtatccgccggcctggcccatgttcatcatgctgaggccgatctgagccatctgggccatctgggccatgacggacatctgcagctgtggcatggccatgcccatgggcatcatcatgctgcccatccggctcatcacctgcacctgcgcctgcagctgcttcaggtagtcgatcacctcgtcaagcat

SEQ ID NO: 5775 - DNA, 433 bp, Oryza sativa
  Predicted polypeptide sequence is orthologous to G779
tgctaacatatagcaatttttgaagaaaggaaagctagaaatacccaatatcttgctgaagcaagatattgggtatttctaaaacacggcatcagtcccttccacaatacctgatcctcatcatattatgctagtccctccggctacagatttgctccatcaagatcacagccaaagcaatggctaacaggatacagcaggaactccaggcttccacaagatagtgctgaaactcaagctctagcagtagcagcaatccatccactgcgaaagtagaaaaatttcaccccaggtgtactctagtctcgggcttccgttgtccagctccaaactgaattttgctgaactacaaccactgattgcgagaagttaatatctacctggagggatggcaagctcttttcatgaataaaaaaaataaaaaaaaaaaaaa

SEQ ID NO: 5776 - DNA, 1643 bp, Oryza sativa
  Predicted polypeptide sequence is orthologous to G782
gaaacccacctcgcgtgctctgtgcacggcggggacgctaaggggaggcgaggcgaccacgcgccctccgcgtcaccatggatccgcgcagcagccaggcgcaagaggacggcttcttccacccacgcgacggcgcgtgccccgccgactccagcggaaagacagaatgtaaaacccagggttcaattgccacgcgcaaggttcaaaaggctgatcgtgagaaaatgcgaagagatagattgaatgagcagttccaggaacttggaagcacacttgatccagatcgacccaggaatgataaggcaactatccttagtgatgcaattcaaatgctgaaagatttgacgtcccaggtgaacaagcttaaagctgaatatacttcactctcagaagaagcacgtgagttgactcaggaaaagaatgagctcagagatgagaaagtttcactgaagtttgaggttgataatctgaatacccagtatcagcaacgaatgcgtgtgctgtacccttggactggaatggagccttctgttgtcattgggccacccctgccatatcctttttcagtcccagtcccagtcccagtccctataccttcaggtgctgttcctatgcacccacagctccaggcatacccttacttccgaaatcaaacttctggaaccgtctccaatccatgcacaccttacatggcatacactcaacccatccatcctcctactgatcaactatctaaccaattcagtgctccagttcagcattcaagtagtaatcgatctcactctatggcccaagactctagaagcaagtcctctgcactgcagcaagtaagttgtagagggaaacatgatgactttgatgacgttgcaactgatctggaactaaaaactcctggttcctcagcccctctacaatcagagattgccaacaaggattcctcttctgacttgaaaaaaaagcagcagttcatacaggaaactaaaggtagttctcttacagaaggcagtagtagttcaagcagatgctcgtccagtggtcctccagatgtctctaacagtattgaaggtggatcagttgctgatgatcaacgatcgacagtacagacatagactaatatatgacgtatagctatcttttccgacattcctaggcctgcatgtgtggtgtaatctgctggcacatcaacctttgctgcttagctgtgcccacttgatatcggaattgacaaattaggaggcctataggcaaagtagaactggttagtcgaagccaaagccatattccatggctatgattatgaatggtcggtagttacccacactcttctatggcagtttgaaatgctttcggcgactaggtatgcttgcgactaacttctgcggtttgtcatctaagatatgcgtcaagtgccaaccagatctgttgagatagttctatcctggagtagcattttctacgaatatatggtaaattaactagtgattaaccatagaatttatcatggttcaatagttacctggtagatcagctacaagttgtacatcatacactatattaccattaattggaatatgttcttaagtatattatttgacatgattgtcagtatccacattttactatatataggcggcatgttattg

SEQ ID NO: 5777 - DNA, 1216 bp, Oryza sativa
  Predicted polypeptide sequence is orthologous to G783
ggtggcgtccacgcgcccaccccacgcgcgtcaccgtcgctcgcccaaactgcgggcgcgtcgcacgccgccctcccatcgttttctcccattctttccccctcctcctcgtgcaaccacccaaccactgcagccagccacgagccgaggaagccgaggccgaggaggaagacgacgaagacaagtagcgcaaggaaccctcgaaccgggaggccgccgcggctccgatctgggagggggaggtcgagatggtgcccagggacagggtgaatgccgctgccgctggtggcggcggcgaggggaggctggtccagagcggtatagtgaacaagaagtgtgataagaaggctccaaagagaatccataaatcagagagggagaaacttaagcgggacaagcagaatgacctctttaatgagctgggaaacttgctagaacctgacaggcagaacaatgggaaggcatgtgtactgggtgaaactacacgaatactaaaagatttactttcacaagtggaatctctccggaaggagaatagttcactgaagaatgaatctcattatgttgcattggagagaaatgaactgcacgacgataacagcatgcttcgtactgaaatcttggagcttcaaaacgagcttaggacgcggatggaaggcaatcctgtttggagtcatgtaaacaccagaccagctctcagggtaccttatccgacaaccggagtgttcccagtacagcacctgccacatttaccagtcaccacgacggcagcatttcctcagcagctaccggttatcatcgagcagcactatgccgccacgccaagagaacttcagctcttccctgagtctgcgaccagcgaagacagcgaaccgtcacaagaacacgggatttctgaccatgtaacacggcctcagccaaggtacccaacaccaacggccactttgccagtaaacctgtttccagtgtttccaggaagacaagatcaacaatgtagcagtggtacttctggcactaacgaggaagaccgtataggtagatcttaggtacactacataacgagaggtccacacaatgatttgagaattcctttagtttcaacgtttaactttgcaagtttagcaaatgtgaaacagagatctgcgactgtgctcatgggtagcacctaatctgtatatctgaatctcagttttaagtggtcaaataggtgacattc

SEQ ID NO: 5778 - DNA, 1135 bp, Oryza sativa
  Predicted polypeptide sequence is orthologous to G783
gaatcttcgccctcctcctcctcctcgtacgcgcccacgcggttctctttctgccccctcgatcgatttgagcagggaacggaagggggaggtttttggaggaggccatggtgccgtcggagaggggggacgtcgccaccgccatcagacccgccgctgccgacaagctcgtccatgggcctatctctgacaagaagtgccggaagaaggtcccgaggaaggttcacaaatctgagagggagaagcttaaacgcgggcatctcaatgatctgttcggcgagctgggtaatatgctagaagcggataggcagagtaatgggaaggcatgcatactaactgacaccacccggatcttaagagatctgctttctcaagtaaaatctctccggcaagaaaacagcaccctccagaatgaatctaattatgttacgatggaaaggaatgagttgcaggatgaaaatggtgcgctacgcagcgaaatctctgacctccaaaacgagctgaggatgcgtgcgacagggagtccaggttggggccatggcgcgactggatcacctctccccgttcctccctctccaggcacggttttcccatcgcagcagccaatgcagccatctcccatgacaacaagcacagtgttccccttgcagcagccactgccacaaccaacagtcattgagccctctgcaagacagccactggaactgaagctcttcctagaagcaccccccgccgaagaccctgaaccatcagaagaccaggaggctccgaacaatgtggcacgaccgcagccgaggtacccaacagaggcatcttcttggcctattagcctgggacttccaagaatggaagatgagcaaatgtagtggtagcacgatagatgatagcacaggtagagattgagagggtctgtttttaatgcatgcaggaattccacacgaaaacacttctgtccttgcatgaaaactggaaaatttcctgcattccaagtaagacctgagtagatcagctccaaccaatcagaaactcactttgagcctagaggatatactactgaatgatgtgcatgtaaatatttcaatctcccttttgtttctgtaaactctagtgagaatagaacccgttttatcccctt

SEQ ID NO: 5779 - DNA, 1485 bp, Oryza sativa
  Predicted polypeptide sequence is orthologous to G783
ggcctccctcccctctcctccctcctccttccaaatctgcagctcaagctggtgttggtggtgttggtggtggtaggcggcggcgtcgccttctcctcctcttcttgctgaccccgcctgactggcttccttccccttccacacctgccggatcgggtggctgggttggttgagggtccaagaaagaaagattttgggggttcgggggtgaacccccctccccatgccccaagtgaggaaccagaatctgggcatggtggctgacacggagagctcggggtcactgggtggcagctcaaatgctgcttctgacaaggctgttgatgggtctcttgacaaaagatctcaggaaaaggctccaaagaaaactcataaagctgaacgagagaaacttaagcgtgaccagttgaatgacctttttgttgagctcagcagtatgcttgatcctgaacgacaaaatagtggaaaggctactgtgttaggtgatgctgcacgagttctgcgggatcttgtttctcaagtagaatctctcagaaaggaacagtccgctcttctaactgagcgtcaatacgttggttcagagaataatgagctgcaagaagagaatatcatgctcagagcccaaatattagaactgcataatgagatttgtgcaaggatgggaaacaaccgcctcaatcaaagcaatcttgcgatgtcacaaccagtagccaacaatggcagtaactcagcaactcaacccgttccacatcacatatggggcaatggtccgaatttagctatggtgcacccaacaaacacattatctccgttgcacaatcagcaccatcagtctgctggtgccagccaggtttatgcgtcacggcctcaggagctgcagctctttccagggacctcagtatcaacagagcgagaacgatcccgagctggaagtggaagcaccccggctacttcttcaggcctgacggattctttgccagggcagcttcgcctcagcctcccgcaatcttctcaagaagaaaacagcagcggcagcaagaaaggtcgaaaaaagggctagccggccagttgacacttgacagttgctaaaaaagaatcgataaatcgatacttggtgaatggtgatagttacacactcctgtaaatactgcgaagcgcttactgatacctactgtgatagttgccctctgttgtaatttgtatttgtagtgcttgctctgaaacttagatcacgtttgactatagttttccacttccagtccttttacggatatatgttgccatattacagagttgtttaccaggaagagagaaaaatgatgcaattcgatagcagtgttaactgatgataattatatgatccctgtcaccaagtcatgaaaatctgatcttgtatgttcatgggcagcttgtttcagcattacaagttgaagaaatatttgtaatctgttgcaaactgcatgtttatggctatgagaaatgatc

SEQ ID NO: 5780 - DNA, 1216 bp, Oryza sativa; identical to SEQ ID NO: 5777
  Predicted polypeptide sequence is orthologous to G783

SEQ ID NO: 5781 - DNA, 2008 bp, Oryza sativa
  Predicted polypeptide sequence is orthologous to G789, G1494
gacgcagcccacgggccttgttcccttctcaccacctccaagtacgctttgcgggacactcgcggcagcaagagttcgtatactcgcctctgctgctgctgcactgccgcgcctaaagctgagcaagaagaggagactttgcagcaagagttgctactgtttggtttggttcaggtgagagaggtcaacaatagctgttggcgtggctagttgcttgtgcagaaaaggattctcttttggttttgccctttctgagaagctgatgatgatgtggtggtgggctatggttgtgcaggttggggagctactagaagaaggaggaatagctaggttgtgaatttcttggggggacacaagaatcgtgggatggatggcaatgcgagatcggcggcgaatcagacgaagcaaatcgtgtagagatttcatctgaaacccaagaacggattcgtcttgtgttgttgccgaatggtagtgacctgacctgactctgtgtgcatttgctccaatggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaagaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttaaaaac

SEQ ID NO: 5782 - DNA, 2081 bp, Oryza sativa
  Predicted polypeptide sequence is orthologous to G789, G1494
ggctctccggcgagtcctcttcctgccctgccctgccctgccctgcattctttctttctccaccaggggaatccagttcacccccagtgctgcttctgctgctgcttctgcatcatcttgccctgttaaaaagacacagtgcccttgttctttcgcagttgcaactagcatctcctcctctacttgtactcacttcacacctcagctcagctcagctcatctcctgtcatctcagctcaaagagaaagagctgaaggtgtaagctgatcaccaggaagcagaggctttttttcagattacagttatctgaaacaaccaacttcagaatcaatcagcaaaggtagaaacaagacagagctgctgtgcttctgtgattaattagggttgttaatgccatgaaccagttcgtccctgattggaacaccaccagcatgggcgacggctttgcgccattaggcgaagacgacgggctcgtcgagctgctatggtgcaatggccacgtcgtcatgcagagccaggcgccgcggaagccgccgaggccggagaagacgacggcggcggcggcggcggcgatggcggaggatgagtcggcgtcgtggtttcagtacccggtcgacgacgtgcttgagaaggacctgttcaccgagctgttcggcgaaatgacggcggccggcggcggcggcggcgacgtccgcagggcggcgtgcaaggaggagcgcggcgcggtcgccgcgttccagagcaggatgatgccgccgccgtggccggcgagggggaaggcggagttcggtgacgtcgacgacgtgtgcggcgtctcggaggtcgtcatggcgaagatggacggggcggcggcggcggagacggtcggcgagtcatcgatgctgacaatcgggtcgagcatctgcgggagcaaccacgtccagacgccgccggtggggaacgggaaggccggcgccggcaccgccggcgccgccagaagggcgcacgacacggcgacggtggcgtcgtcgtcgatgaggtcgaggtcctgcaccgccaaggccgagccgcgcgacgtcgcagccgccggcgtcggcggcaagcggaagcagcgcggcggcgccgccatggagtccgggagccccagcgaggacgtggagttcgagtccgccgccgcaacgtgctcgccggcgcagaagacgacgacggcgaagcggcggcgcgccgccgaggtgcacaacctctccgagaggaggagaagagataggatcaatgagaagatgaaagcattacaggagctcatacctcactgcaacaaaacggacaaagcatcgatgctggatgaagcgatcgagtatctcaagtcactgcagctccagctacagatgatgtggatgggcggcggaatggcgccgccggcggtgatgttcccggcggccggcgtgcaccagtacatgcagcggatgggcgccgtcgggatgggcccaccacacatggcgtccctgccgaggatgccgccgttcatggcgccgccgcccgccgccgtgcagagctcgccggtggtcagcatggccgacccctacgcccgctgcctcgccgtcgaccacctccagccaccgcctccgatgcattacctgcaggggatgagcttctaccagctcgccgcggccaagaaccttcagcagcagcagaacacggcggaggcgccgccaccgccaccggccggaggcaaccgcgcagccgctgactcctgacgacattctgcacaaaaaatacgacaactgtagtaagtctgagagcaagggtggcaccagttgattgccgtcaatctgaagatatgtatataaggctctgatgcaattgagttgagaggctggatcatgatggctacctaatcattaaggggaatttaagatcatcccttttactgacgtctaaattcggtaggcagtgtagatcgatcagcggttaagagttaacaagtcgtgaattcttttttgctatgtatgtagtactattttttcccctttggggagacattggttatgtatcagttgttgatgtacctgttcaaatttatgccaaccagagcaaattgtatt

SEQ ID NO: 5783 - DNA, 2134 bp, Oryza sativa
  Predicted polypeptide sequence is orthologous to G789, G1494
aagcccggtcccccttgctctgcctctgcctcttcttcctcctccttgctctgcttctgctctctagctagccttcttcctattggaagcttcttctcaagtgaaaattaagaagctagtattggctgagctgagctgagcacccagccaaagtcttgggcctacttaattagtgaggtgaaggggagatcgtcgtgtcgtcatccatggttgctgccatctgatgagcgatgaaccagttcgtccctgattggagcaacatgggtgacgcatccaggacactcggcgaagatgacaacctcattgagctgctctggtgcaacggccatgtcgtcatgcagagccagaatcaccaccggaagctgccgccgaggccgccggagaaggcggcggcggcggcggtgcaagaagacgaggccggcctgtggttcccgttcgcgctcgccgactcgctggagaaggacatcttctcggacctcttctacgaggcgcccgtcgcggcgacggcggaggcggcgcctgctggcccgggcgcgggcgccgacggcgaaggaaagacttgcaagggcgacgcggcaatggcggaggaggagcgtggcgggccgggcgcggcgtccgaggcgccgcgcgagctgatgccgccgcccaagtcgacgaacgcgtcctgctcgaggcagcagacgatgagcctggcggacggcggcgacaacgccggggacctgtcggagctcgtccgggcgaggaggtcgtccggcggcgcggctcggcggaaggcggaggccggcggcggcggcggcggcgcgtcgtcgtcgatgctgagcgcgatcgggtcgagcatctgcgggagcaaccaggtgcaggtgcagcagcgcacggcgagcgagcccgggcgccgcggcgcgccgccctcggcggtggggagcgcgaacgccatcccctgcggcgggcgcgaccacggccacggccacgaggcgaccaccgtggcgtcgtcgtcggggcggtccaactgctgcttcggcaccaccaccaccacggagccgacgagcaccagcaaccggagcagcaagcgcaagcggctcgacaccaccgaggactccgagagccccagcgaggtaggcgtcctcccgtcgaacaccaacagagacgcacactgacactgacaccggcggcgcgtgggatgcaatgcaggacgcggagtcggagtcggcggcgctggcgcgcaagccgccggcgaagatgacgacggcgcggaggagccgcgccgccgaggtgcacaacctctccgagaggaggagacgggacaggatcaacgagaagatgagagccctgcaggagctcataccacactgcaacaagactgacaaggcgtcgatgctggacgaggcgatcgagtacctcaagtctctgcagctgcagctgcagatgatgtggatggggagcgggatggcgccgccggtgatgttcccgggggtgcaccagtatctgccgaggatgggcgtcgggatgggggcggcggcggcggcgatgccgaggatgccgttcatggcggcgccgcagccggtggtgcccacaccgccggtgaaccaccttgacctgggcgtcaaccacctgcagccgccgccgacccagctttatttgcagggagtggggtattatccgttgggggccaaggccgtgcagcagcagcaaaatccaccacttcacgtgccaaatggaagcattatgcctcctcctgaaaatgcacccaacacaggatcaggataattaacaaaaaagagtgagagcaaagaggaagaaaacattcatggttgcattgatcctgaatgagtatatatggcaataaaggtaactgagctgcacagcaggacggagcagaggaatttgacagggggacgatttctttagctttttcccctctttgggaagccaggaactagctgtgatgtgcagaagatgttagcaaaatctcttgaagatctctaactgattgtaattaggggtatgatggcatgttcaaagcataaggctggtctggtcttttgtaccattggaattaacattagagacagaaattgtgccatacatttggaacaagagtagttagtataaattgacacacttcttttcaaaaagt

SEQ ID NO: 5784 - DNA, 1254 bp, Oryza sativa
  Predicted polypeptide sequence is orthologous to G789, G1494
atggatgcgggtgcaactgcaaggtcgtcgtcgtcgtcggcgatgatgatgaaccagaagaagcccttgtcggatggcgagctggtggagctcctgtggcaggacgggggcgtcgtcgcgcacgcgcagacgcgccaccgatcgtccgacgtcctcgcccggagcggcgtcaccggcgaggaggagacggcgtccgcgtggttcgcggatggcggtggcggcggcggcggcgacgacgacgcgctgggcctgggcatgggcagggacatctactcgcagctctggcacagcttcgccaatgtcgacgggcacgcggcgggcgcgctcgcgctcgcgacgccgacgccgacgccgcgggcggcggcgaggagcgacgacgtgtcgagccgtctcgacgaggccgacctgagcatctgcggcagcaacgcggtcgtggcgccggcgctgcccgcggacgacgacgacgacatcgacgccgccgcgccgcgcgaggaggaggaggaggaggaggaggggccgggcgccgcgcgcgccgccggcgcgtcgtcgtcgggcgggtcggggagcgggagcgggagctacccgctgttcaagcgggggagggaggagctggttgacagccttagcgaggtcgccgacgagacccggccgtcgaagcggccggcggcgaagcgccggactcgcgccgccgaggtccacaacctgtcagagcgtagaagaagggataggatcaatgagaagttgagagcattgcaagaactggtacctcattgcaacaagactgacaaagcatccatactagatgaagcaattgagtacttgaagtccctgcaaatgcaagttcagatcatgtggatgactaccgggattgtgccgatgatgttccccggtacccaccagctcatgccaccgatgggcatgggattgaacacggcatgcatgcctggggctcaagctcaaggcctgaatcagatgcaaagaacaacatattacatgaacaattctctgccaaaccagatgcctcagatcccttctccagctatgaatgcacccagtgttccagacgatatgcagaatgataatcgcatccgcgggccaagaaatccttttcttcattgcaatgatacactgacagcaacagctcaggtgccaggtttgtttacctatggatctcaaattgcagaacaaaatgagattcaggagttactctctggcgctgtcattccatcctcatctgatgggaccataaaataa

SEQ ID NO: 5785 - DNA, 1578 bp, Oryza sativa
  Predicted polypeptide sequence is orthologous to G789, G1494
atggcgatttgcagcacggacaacgagctggtggagctgctatggcacaacggcggcgtcgtggcgcagccgcaggcggcgcaggcgagggtcgtctcctcctccggccgcggccagagcgccagcgtgctcaccggcgacgacacggagaccgccgcgtggttcccggacaccctcgacgacgcgctggagaaggacctctacacgcagctctggcgcagcgtcaccggcgacgcgttcccggcggccgcggcggcggggccgagctctcaccacgctccgccgccggacttgccgcccccggcggcgaggccgccgatgaggagcggcatcgggtcgagctggaccggcgacatctgttcggccttctgcggcagcaaccacatcccggagacggcggcgcagcgctgccgggacgccggcgcggcattgccgccggagcggccgcgccggtcgagcacccacgacggcgccggcacgtcgtcgtcgggcggctccggcagcaacttcggcgcttccggcttgcccagcgagagcgccagtgcccacaagaggaaaggcagagaagattcagacagtcgcagtgaggatgctgaatgcgaggcaaccgaagagaccaaatcgtcgtcgcggcgatatggatcaaagaggagaactcgtgcagctgaagttcataacctgtcagagaggagaagaagggatcggatcaacgagaagatgcgcgcattgcaagaactcatacctcattgcaacaaggtaagaaacattattatatatgcatcttttttctgatcaggtgcaagtccatggactgatacagctatgttgaccgacaaggcatctatattagatgaagcaatcgagtatctgaagtcactccaaatgcaagttcagatcatgtggatgactactgggatggcaccaatgatgttccctggtgctcaccagttcatgccaccaatggccgtgggcatgaattctgcgtgcatgcctgcggcacaaggcctaagtcacatgtcaagattgccatacatgaaccattctatgccaaatcacatccctctaaattcatctccagctatgaacccaatgaatgttgcaaaccagatgcagaacattcaactgagagaggcaagcaatcccttccttcacccagatggctggcaaacagtgccaccacaggtatcaggaccatatgcttctgggcctcaagtagcacagcaaaaccagataccgaaagcgtcagctagcactgttctgccaaattctggggctgaacaaccaccaacctctgatggaatttagaatgaccagaaacatgataaggaattcaatgtaggctttgcacaaagggtcgtctttctggagatagctgaaaatattgacatgatgaacagattgcatccatattgctgttatgtatctcaatcagtatctgtctgacataaatgctacaagtgtctgtaaatgcacatagcatttccccccttccctaagatgctaattcccagtgtatgtactaataatccttataatatgaagtgccagtggcaatctttgcccttctttatcatcctc

SEQ ID NO: 5786 - DNA, 406 bp, Oryza sativa
  Predicted polypeptide sequence is orthologous to G789
ccaacgccaaggccaaggttaccaccgaggtctaaatctgtggtacatgagactgagctttggagagatggggacggaccagttcttccaccagcaatttttacggcatctgtcactattcgataaacgaagccagcaagaggcacgattgggatcagacagcccaggatgcggtggatgtgaactcggttggaaggaaaagaaaaatatttcctggcggaagttgtggtgtttcccggccggttattactcattgggaagggcagcatggactttgctgtttctggttgcagatcgcaaagggcgaaaagggacctgcggctggctttgcatggatttgcggatcagacgttctctggcaatgtatgtttggttgctagaggaagaatatgacgcacctgaaatg

SEQ ID NO: 5787 - DNA, 1325 bp, Oryza sativa
  Predicted polypeptide sequence is orthologous to G791
gccagcatcttcctcagccaccaacctattctcacttttacacccaacccctccaaaaaagtataaaatcacaacatcacccctctccaccacagctaaaaactactaagcgaggactcgttagacattacagttatatccagggtgcaatctgcaaaagtctcatccccaaatccccaattcttccccgacctctcgctcgcggaggaggagcgagaatccccgaaccctaggcccgatctcccgcacccgccgcgggcgatggacggaggcggagaccccgttgacgagttcctcatcggcggcggcggcgaggacggcgacctcggcgtcttctgcgacggtgtgccgacgctgccctgcgatggaggacttgggattgatgatgtcagtggagatacttgttgccttgaccaatctgttttagggaaaagaggtagagatgaatcatcatcatctggtccaaagtccaaagcttgccgtgagaaaattcggagggatagactgaatgacaggttccttgagttatcttccgttatcaatcctgacaagcaagctaagttggataaagcaaatatcttgagtgatgcagctcgtctgttggcagaactcagaggcgaggcagaaaagcttaaagaatctaatgagaagctacgagaaacaatcaaggaccttaaggtggagaagaatgaactccgtgatgagaaagttactctgaaggcagagaaggagaggctggaacagcaagttaaagcattgagtgttgctcctacaggatttgttcctcatctccctcatccagctgcattccatcccgctgcattccctccatttataccaccttatcaagctctgggcaacaaaaatgctcctacgcccgcagcattccaagggatggcaatgtggcagtggttgcctccaactgctgtggacacaactcaagatccaaagctttggccaccaaatgcttaattaggtgcagactagctatgctgctattcatccattggcagatcaaaatgtgttcggtcttcctggagagtaaaatagtccgcgatgctgtccattacgtggtaaactgttcttttattggagttctgtttttaactcgtcctattgaggggcgatgcctgtaattaatctggatcgtaaccctcttgcctggtgaatgctccacaaactctcatgtccctcgcatgagtttgttcaagtgtggaagttgtgactgtgctattattttagcattggcttggcagtacttgttctgtttctagcaagagtttcgcatgtgagcacatgcatagcaatatagtatgttctaaatt

SEQ ID NO: 5788 - DNA, 1082 bp, Oryza sativa
  Predicted polypeptide sequence is orthologous to G791
ggaggcgaggcgaagctcctcgtcgtcagaatccgcgaaaacatcgccaccaccacgagaggaggaggaggagagcgcggcggcgatgtccggtaccccggcggacggcggcggcggaggcggcggaggcggcggagggagcggggacgactggttcctcgactgcggcatcctcgaggacctcccggcggccgcgtgcggggccttcccgtgggacgcatccccgtcctgctccaacccgagtgtggaagtaagcagctatgtgaacaccacctcttatgtcctcaaggaacctggcagtaataaacgtgtaaggtcagggtcttgtggtaggccaacatcaaaagcttccagggaaaagatcagaagagataagatgaatgataggtttcttgaattggggactactttggagcctgggaagccagtaaaatctgacaaagctgctatcctaagtgatgccactcgcatggtaattcaacttcgtgctgaagcgaagcagctaaaggatactaacgagagtcttgaagataagattaaagaactgaaggcagagaaggacgagcttcgtgatgagaagcagaagctgaaagtagagaaggagacattagagcagcaggtgaagattctgactgcaactccagcctacatgcctcaccccacattgatgccagcaccgtacccacaagcaccacttgcccccttccaccatgcccaggggcaagccgcggggcagaagctgatgatgccttttgttggatacccggggtacccgatgtggcagttcatgccgccttccgaagtcgacacctccaaggacagcgaagcgtgcccgcctgtcgcgtaatgcttcatcggttgcgttatgtgaattaatcgtaacctgaaaccgcttagttgctcaatccattggttgggcatcgtcgtccctgattcacattcactattgttcttgtgttagtagttcgtttttgtatggaagtaagctgacatttgtggcgctctatagaggctactgcccccttttaatgtacaatacaatttttccggagaaaggaagaatgctcattcttgttctctgc

SEQ ID NO: 5789 - DNA, 2597 bp, Oryza sativa
  Predicted polypeptide sequence is orthologous to G791
gaccgccccgaatccgcccccaaatctcctcgcgacctcgaaaccctagcctcctccggccaccgtcgccggccacggtgagcggccccacccccccgcagccatggcctccccggagggctccacgtgggtcttcgactgccctctgatggacgacctcgccgccgccgccggcttcgacgccgcccccgccggaggcttctactggacgacgcccgctcctccgcaggcggcgctacagccgccgccgccgcagcagcagcccgtcgcccctgccaccgcggctccgaacgcctggtaattgcggggtttacggcctccgatcgcgctccagccagccctggctgggcccggtgccgtggtctggggtgctacatttttttttcgtcctgatttgtcgcggcagcgtgttagtgcgtaagttgagactgggtatatcgtgatcgttgctattgattgttcgattggaggtcgatagaagcgtatcatatcagactatcagtgggattcggattaggggattagccattgagtgtgtctgaacatgtagaactagttacgtactccctccgttttctaaaatatgacaccactgacttttcaaaatacacttgaacattcatcttattcaaaaaatttatgtaattattatttgttttattgtgacttgatttatcgtcaaatattctttaagcatgacttaaattttttatatttgcacaaaaattttgaagacgacgaatagtcaaacgtttatcaaaaagtcaacgacgtcatacattaacaaacggaggtagtataacttagtaggagccgtcagcctgttttactgaacagagggctcaattcctggttatattgaattgtcagcttcattttcaaatctatttatttgtgtgcatacgtaatgtatttaaacctaatttagggcctcttcatgatttataattctcattttaattgtgatgcaaatgctgcatagcatagcatatatagtttgctaagcatgcattgtgtcatgtttatctggtgtcatgtcatgggatagttgaactgaagaaaacatacaccataattgatgatgtttatgatgccactattgtacaagattcagtttgccgtgtaatattacaatataagaactgataacaagtaaaccaaatggtgtcaaattggcgtggtggtgggagggtggatggttgtgatttgctgtaggtccaactgtctgagataccagattttaaaattttttgtatctatatgcaagtaaattgcattgacatgatattttgagccaggtattgagatttgtcctgagctttccagtggatttttcaatgaatgatctatgaaggatcagaaacggggtgagagaagtggttaatctgtatcacttgggttccagcacgaagcttactgtggaatggaaatttattgaagaacgtgttcatgttaggatattgtttactgcaactctttgatttaagagtattcttttatttatgataccttgtagtcttgtggtgctagtacattttctttatgcaccaggaagtcatctcatgtgtttttaaatctgtcctggtttttgacttgtgcttccaccttctggtgccataggttgtggtgttatgaaccacacagtgcatcttaactgatgtattgttctgttgtgttaaatttgcttgattcttttgttgtcattgtatagttttttatgtacttattgctgtatattatcgtgacatatggcatactgaagtacaagtttatttttttcaccagtgctgaaatcaatggctctgtggactgtgaacatggcaaagaacagccaacaaataaacgtccgagatcagaaagtggcactcgaccaagctccaaagcatgcagggaaaaagtaagaagggacaagttgaacgagaggttcttggaactgggtgctgtcctggaaccagggaagacacccaaaatggacaaatcgtctatattgaacgatgctattcgtgtaatggctgagctgcgtagtgaggcacagaagttgaaggaatcaaatgagagtctccaagagaaaatcaaagagttgaaggctgagaaaaacgagctgcgtgatgagaagcaaaagctgaaggcagagaaagagagcctggagcagcagataaagttcctgaatgctcggccaagcttcgtaccacaccctccggttatcccagccagtgcattcactgctcctcaagggcaagctgccgggcagaagctgatgatgcctgtgattggctacccaggatttccgatgtggcagttcatgccgccttctgatgttgataccacagatgacaccaagtcatgccctcctgttgcataagtcaaagcaaagatcaatttgcctcgccttgtaggaaagaggtgaaactgccttccattcaagcccagtttggtcgtcagtgtttaaactacctagctaatcccaggattaaaccgaagcttcgctgtatcgaagtatcaaccggtgacatgtgaactgacgaaagatgacaccgttgtatattacatattagtaaataaattccatctgtccaattaaatgagaattagatgcc

SEQ ID NO: 5790 - DNA, 1325 bp, Oryza sativa
  Predicted polypeptide sequence is orthologous to G791
cccagcatcttcctcagccaccaacctattctcacttttacacccaacccctccaaaaaagtataaaatcacaacatcacccctctccaccacagctaaaaactactaagcgaggactcgttagacattacagttatatccagggtgcaatctgcaaaagtctcatccccaaatccccaattcttccccgacctctcgctcgcggaggaggagcgagaatccccgaaccctaggcccgatctcccgcacccgccgcgggcgatggacggaggcggagaccccgttgacgagttcctcatcggcggcggcggcgaggacggcgacctcggcgtcttctgcgacggtgtgccgacgctgccctgcgatggaggacttgggattgatgatgtcagtggagatacttgttgccttgaccaatctgttttagggaaaagaggtagagatgaatcatcatcatctggtccaaagtccaaagcttgccgtgagaaaattcggagggatagactgaatgacaggttccttgagttatcttccgttatcaatcctgacaagcaagctaagttggataaagcaaatatcttgagtgatgcagctcgtctgttggcagaactcagaggcgaggcagaaaagcttaaagaatctaatgagaagctacgagaaacaatcaaggaccttaaggtggagaagaatgaactccgtgatgagaaagttactctgaaggcagagaaggagaggctggaacagcaagttaaagcattgagtgttgctcctacaggatttgttcctcatctccctcatccagctgcattccatcccgctgcattccctccatttataccaccttatcaagctctgggcaacaaaaatgctcctacgcccgcagcattccaagggatggcaatgtggcagtggttgcctccaactgctgtggacacaactcaagatccaaagctttggccaccaaatgcttaattaggtgcagactagctatgctgctattcatccattggcagatcaaaatgtgttcggtcttcctggagagtaaaatagtccgcgatgctgtccattacgtggtaaactgttcttttattggagttctgtttttaactcgtcctattgaggggcgatgcctgtaattaatctggatcgtaaccctcttgcctggtgaatgctccacaaactctcatgtccctcgcatgagtttgttcaagtgtggaagttgtgactgtgctattattttagcattggcttggcagtacttgttctgtttctagcaagagtttcgcatgtgagcacatgcatagcaatatagtatgttctaaatt

SEQ ID NO: 5791 - DNA, 1278 bp, Oryza sativa
  misc_feature (971)..(971): n is a, c, g, or t
  misc_feature (1056)..(1056): n is a, c, g, or t
  misc_feature (1173)..(1180): n is a, c, g, or t
  Predicted polypeptide sequence is orthologous to G791
cgggtcgaccacgcgtccgcggacgcgtgggcggacgcgtgggcggacgcgtggggccgcgcgcgcgagagccagccaagccaaagccaaagcgaagaaagagcgcgtccgcgtcgtcgtcgtcgtccgcctgcctgcctgcctgcctacccacgtcgcgctcgcgtgcgcgctgccgcttagtcgcgccaaaaaggcggggggaggggaggcgcgtgcctgcccccgatcgcatatcgcattctccactcgcttgcgtttgccgttgcgtttgcgttttgcgtagcaagggaagggagagagctcgtgcttttggattggccgcgatgagctgcgggggcgccgggcagagcgggtggctgctcgagtacgggctggtggaggaggagatccagggctccgacttcatctacatggtcgacgaccccgcggccgtctccagcgtgctactgggcttcgacgttcccaggaaggaggacggcagcggcggccaggacaactctgcctccaagaaaagatctcgtccagaatcgagcgcaccgccgggcaccaaggcttgccgcgaaaagctccggcgagacaggctcaatgaaaggttcaacgagctcagcgcgatcttggagcccggcaagccgccgagggccgacaaggtctccatcctgagcgacgccgcccgtctcctgagccagctgcgcgccgaggcccagaagctcaagagctcgaacgagtcgctccaggactccatcaagagccctcaaggccgagaagtcggagctgcgtgacgagaagaacgaggctcaaggccgaaaaggagaggctggagcaaattgctcaagggcgtcggcgccgccacaccggcggctccagcgccgttcgtcccgcaccacgccgcggcggtggcgtgcgcaccggcgtaccatccggcggcgttcgcgcaggccggcgggcagtacgtgcgtgaagccaccatnacgcgccgcgggcgtttctggcatggtaacggcgaggtctcgaaagtccaggaccgtgaatggcgccgtggtgtacttgtggtgnccgacaccggaaatagagaaagcgtgaacccgtgcgtttatgtgggaacagcgctggcgcgaacttgttgcgcgttccttctcgttttaacatgcggtccttgcgcatactgtgacnnnnnnnnaaacaacatagaaatagacacaaacaacacagaaacaggagataacaacagacagaagagaatagaacagagaggagcacacaagagacacacagaac

SEQ ID NO: 5792 - DNA, 1096 bp, Oryza sativa
  Predicted polypeptide sequence is orthologous to G798, G1897
ctcccgagagagacgatcgagatcacgcgcccacagaaactgcagattaagcggcagagattgtagatagcgcgaggttattaaggccagcagtctgaccgcgcgcggcatgcccttctgctgctgcaaccgaccaaatggctcctgcggttgcctcctccccgtcactcgtgctctccgccgccgccgccaccgcctacaacaagcgcccggccgattccgacgcctcgccgccgcaccagggagatcgcacggggcagcaggagaagaagcagcagcagctggagtgcccgcgctgccgatccaccaacaccaagttctgctactacaacaactacagcacgtcgcagccgcgccacttctgccgcgcctgccgccgctactggacgcacgggggcacgctccgcgacgtgccggtgggcggcgcctctcgccgcggcggcggcggcaagcgccgcagggtctccgccgacgccgacccttcctcggcgtcgccgccgccacccacgacttccaccacggacgcgtacgccgacctcccagccggcttcccgttcctcagtgacggcgccttcctgccgcagttcggcctcgccggcgttgcgccggccgcgttctcttgggcatcggctgtccctgacttgtacaactgcgggatcgcgccgtgggacgatggaacggcggtcaccggcgcggcgtgggacaacttcgccgacatcgccggccttgatctcagctggccgccgccgggtaactgacgaacagtacacagctggtcgctcgtgttttggggggctccggttttagcaaagcagcctcaagtagtgcgttcttcgatcggtatgcaggtagtgtgttcttcgatcggtatgaagtatattttgctgagctagggattatgatataattattgggaatgtaattaagcagctcaattatccaacgtggtgtttgcagttttcttctctcaccaatttcatacgcttgcacaatgatgtggtgattatcattgggatcagtgaatcgtgatctgtagctggaagatgtgtttacgtatgtgcagtgttaatgacaataataagagtttgttgccatc

SEQ ID NO: 5793 - DNA, 941 bp, Oryza sativa
  Predicted polypeptide sequence is orthologous to G801
agagaacaagaccctagctacctgttcagtgttcaattcgcacggaaagccatggcctcccgcgacgccgccaccttccaggtctaccggcccatggcaatgccaacgccggcggcgctgccaccgtcgtcccagcagatcacaatgccgttcacggcggcgctcgtggacgccgtgctcccagctccccgaaaggcggcggcgacgcagggcggcaaggaccggcacagcaaggtgaacgggcgcggccggcgcgtgcgcatgccgatcgtctgcgcggcgcgcgtgttccagctcacccgcgagctggggctcaagtccgacggccagaccatcgagtggctgctccggcaggccgagccgtccatcctcgccgccaccggctccggcaccaccccggccgtcttctcctgctcgtccgccccctccaccgcctcctcctccttcctcctcggcaagcgcccgcgccaggaggaccacgaggcgccgacgttctgggaggcgctgcagcaacagccgcggcccgccgtgtcgtcgtggggtgccctcgcctcgccgtcgcaggaggcgcaggcgtacgcgtcgtcggtggcgcaggtccaccacctcaacctactctccgcgctctccggcgccgccacgagacggccagcacaggaggagtcccggtgatcgcgcgccgcagctatgcagctcaatttgcgacgtgattgcatgcgcgcgcggggttgatttgtacttggagctagtcttgctttgtcttgtgtgtatggcttgccgtacttaatttcccatttccgctggtgtttccatgggtgaattttgtgtgaatttgcttgattttaggccggagaatactagtaagtagctggtgaagaatcaagaatgtgatcagatagatcatcagaggcagcaattgtagataccaagtcttttggatt

SEQ ID NO: 5794 - DNA, 1105 bp, Oryza sativa
  Predicted polypeptide sequence is orthologous to G801
atcacctcaaaacctctcaaaccccacaggcaccggaccaccaccaccattggcaccacctcgcatcacactctctcgctcgccatgagctcccgcgacgccgccgccacgttccatgtctaccagcccgtgcagatcccgacggccacggtggcgcccgctgcggcagtgtcggcggcgccggcagaggccgtcgcccagctggtcccggcgccgagcaagaaggcggccggcgcggcgggtgggaaggaccggcacagcaaggtgaacgggcgcgggcggcgcgtgcggatgccgatcgtgtgcgcggcgcgggtgttccagctcacgcgggagctggggctcaagtccgacggccagaccatcgagtggctgctccgccaggccgagccgtccatcctcgccgccacggggaccggcaccaccccggccgccttcgtctcctcctccgcgccgtccacctcctcctcgcaccagcacaccctcctcggcaagcgccagcgccaggagtccgccgccgccgacgccgtctccgtcgccggcgccgcgtccgcgttctgggcggcgctgcccgcaccaggccggcccgacgcctggggcttctccccgctggacgcgcagccgacgtacgtgccgatggcgcaggcgcaccaccaccacctcaacctcctcgccgcgctctccggcgccgccaggcgcgccgaggaggagtcccggtgaatcacgcacagcagcatgcatcttccgagctctgacacgtctttcgctcaattcaccgacgcgtactgcactggcgtccgtacgccttgttcttgggacagttcttgattggagtgtgcttcttctctctaccccgtggatcgatcgttttgccttcttcctgtgcggttcatcaattgctcaagatgaaattaattgttgctgtggtgtttaagctcaaaactgtaaatacgagtccttagatctcatcttactcctacaaattccagcgccgcatgtgtttgtgtgtttgccacttgtttccagctcttgtgctatgattccatggaacttgtttcagtttagcttcatctacatcgttgtcagaccaaatcatttgacagtt

SEQ ID NO: 5795 - DNA, 756 bp, Oryza sativa
  Predicted polypeptide sequence is orthologous to G801
atggagtcgagactggggaagtggggatcgcatcggccgcgggaggaagacccgggagcggcagaaaggggagaggcggccggcgagcctggccaagctctgcaagcctcgagcgccacgcaacgagaggagggaatgggggagaggggaagtggccagcgggagatgggggaagggagaggcgcggtagggcggcatggcgggcgcggctgctgcggcggccatcatctccaacacaaccacgaagctatagagctggccgaagtcggcccgtgcgggaagcgcccagaagccctgggtgggggcgtcggtagcgggagcgagcgtgggggaggtggtttgtggttgtcggtggcatggaggtgcttgccgaggatgaagggggcggagcaggggaagaggaggtcattagagtggagggagaaaggtgaggaggtggataaggaggccggggtggtgatggtgctggtggcggggatgatggatggctcggccagacggaggagccagtcgatggtctggccgtcaaacttgtggctgagatcgcagatgatggggcatgcggatgcgacggccatggtcgatgaccttgctgtggctatccttggagggaggcttgcggacggtgaggacggtaccatcggtgttggaggtggcggggacgagcgcttcgcccacacccgtctcctggacttcgcagagctagccgccaccaacacccacccgcataccccctccttcaatgaccgccagtag

SEQ ID NO: 5796 - DNA, 711 bp, Oryza sativa
  Predicted polypeptide sequence is orthologous to G801
atgacgaccaggccagacggcggcggtggcggtggcggcgctccggacaagcagctcgtcccggcctccaacgccaatggcaccgccctcgccgttcgcaagcctccctccaaggaccgccacagcaaggtcgacggccgcggccgccgcatccgcatgcccatcatctgcgccgcccgcgtcttccagctcacccgcgagctcggccacaagtccgacggccagaccatcgagtggctcctccgccaggccgagccctccatcatcgccgccaccggcaccggcaccaccccggcctccttctccacctcctccccttcctccctccgctccaactccacctccaactccaacgacctcctcctcccccgcgccgcccccttcatcctcggcaagcgcctccgtgccgccgacgaccacaccacttcgcccgcgcccgctcccgacgccaccgcccccacccaggccttctgggcgctcccggccagggctgacttcggccagctctggagcttcgccgccgcgccggagatgatggtcgccgccgccgccgcacccgccatgcctggggaggcgtccgccgccagggtcggcaactacctccccatggcgcagggcaacctcaaccttctcgcctccttctccggcggcccaggaggcgccggggccacggcggcgaccggccgacccgaggaggagagcgcccgctga

SEQ ID NO: 5797 - DNA, 1649 bp, Oryza sativa
  Predicted polypeptide sequence is orthologous to G802
ggcacgagtggtgggttgagggcggcggcggcggcggcggagggtgggatggagcagcaggcggcgccgtcgagcagcacgagcacgagcaccaacagcagccggagcacgtccgaccaccacgccgccgccgccgccgccgccgcggcggcggcggcgcaggtggcgcatcagcaccacccgttctactacgccgccgctcagggtggcgcgaataccatgccggcgccggcgtcgttcatggggtcgctggccatagtgcccgctgctgctgctccgggtggtggtggtgggcaggtgcaggcggcggcggctccggtggcgtcgtcggagaagaaagcggtggtggcggcgggggcgggggcgaagcggccgaccaaggaccggcacaccaaggtggaggggcgcgggcggcggatacggatgccggcgctgtgcgcggcgcgggtgttccagctcacgcgggagctcggccacaagacggacggcgagaccatcgagtggctgctgcagcaggcggagccggccatcgtcgccgccaccggcacgggcaccatcccggccaacttctcctccctcgccgtctccctccgctccgccgcctcccactcctcctccccgcgcgccgcgccgttccaccacctccagcagcagcagcagcacgacgtcgccgccatgctcggcttccaccaccaccaccaccagctgctccctcctccgccaccgcaccagcacccggagccgacgccccaagatcccggcgccggcgagttcatgcgtaagcgctacagggaagccgacgacctgttcaaggacacctcacgccaagaccccgtcgatggcgccaccggcgaggccgagcagaaggcccgtgcggccgcagcagcggcggcgccgccgccaaccgccccgtcagcaatgtgggccgtggggccgaacaccaccggagccaccgccgccttctggatgcagccggcatgggcattcccccacggcgccggcgccggcgccgccggtaacacggtgcaggcgccactccagttcatgtcgcgcagcagctttcccacggcgatgaacgtcaccatggcggacaacaacaacagcagcaacaacaacctcggcatgctcgccgcgctcaacgccggcggcggcggccgctccggcgagcaccagcaccagcatgaggggcagtcgccggcggagatggatcatcagcgccgcgccaacggcggcggcggcgaggctggcggcgcggcgagctcgcagtgagctgagctaagctaagctaagctagctaagctgtgatgatgggttaatgggaggtagctgtgcaaatgcaaatgcaaatggcatatgatgatttgattagagagagtacagattagggtgtttggaactgcttgcagctgctctcgttaattaatcatctcaattcatcaatcaatggattgtttgcttctttagtttaccccccttattttttacctgggattattttagtttgctcttttggattaattaattaatcaatgtaaggtgtttgtgatgatgatgatgattagtagtgggtccaattggatcgatcttgagaagcctagctgagtgattaatttaatatgtttcttgttgtcaaaaaaaaaaaaaaaaaa

SEQ ID NO: 5798 - DNA, 4695 bp, Oryza sativa
  Predicted polypeptide sequence is orthologous to G805
tgatcctctacaacctcgtccccgcccaacccctaaaccctagcgccatccccaaccctaaccccgacctctccatcgccgccgccgagcccccctcctccgacggcgccacccctcgccgcgtcaggcccaggaagtccccctcctcctccgaccgccactccaaggtcgccggccgcggccgccgcgtccgcatcccggccatggtggccgcccgcgtcttccagctcacccgcgagctcggccaccgcaccgacggggagaccatcgagtggctactccgccaggccgagccctccatcatcgccgccaccgggacgggcgtcaccccggaggaggcgccccccgccgccgtcgccatcggctcttcctcggtcgccgccgccgccgccgccggcgggcatgggggcgcgttcgtccatgtgccttactacaccgcgctcctcatgcagccgcctaacgcggacgagccccccatggcatccgctgcctccgcctcgggcaccaccgccgccgacgagaacaataattaatttagaactgccgctgttaggtttaggagcttggagcgtgttagggttagggttccccggcttatttaggagaggtctccccctcctcaataatttaacctcattgtccttgtggcggttgcggcggcggcatggatttaggttatttagatgccttattcaggcaagcaaatgagggggtgattcagatggtttcttagagaggagggcagaaaaatggagagctctctgtaagtggtgggtgaggactggagtgagtggtactgatgttctgatgaaacaatgcctgagttattgtgaatgtttagatctgctgatttattctccgtgtgcgctttttatgtgctatagtagatgattccatttggtgtttaccttgactaggaagtaggaacatggtttggttgtgccgcagaaggaacagtcttgggttgtatcatgagaggagcttggaagttggaaacataaccaaattgacttggctgttactgtcagctggttatttttgaatctaaccagaattcagatgcagattaacaaaaaaggttttatttggaaattgcttggaagggttttagtgctcaggacatgtgttctgcggttgcatcttgtcgtattctgaagacgacggttctggattgccaaatacatgcttttattcctactatgcttgttttggacgtcaaataaaatgcatgtgctcttccacaagtggatacacatctcatttggaggattaggtttccttttgttgtaactgtttgctctatttcttgtttattacttttgtttattcttaaatcatgtagaagaactatagttgtagtggttaatgttttttgtctgtttggtttcccttgtcataaaaaattataccttttgtctttgagttgggaaacgactttatatgatgcttaatttatttcattgctttctggacatatttatatcaatagcaatgtgttggtgcattcaacttgctactgaagacctacagtttgttgacctcaatgcttggcatggctgcaaagattcaggtatggtgcttttgctatgctatagtattttctctaaaaattagcttcttcacatgatcttccgaagcattagtcttctgcagaaattaaaataatacagctagccttgtggatgtggaatttagtgatagatttaaaattttcattattctcatatgccatcattttccattttatttagatgtaaatttgcatggattttccccaagaatgcttgatcgtttcacgatttacaggtaacaggctatgtacctttttggaattttataattgttgggcatttaaatgttattgagtaatgttatatgtatactaacaagcaaacatcagatcaaaactgagtcgtgtaaggaaatttttgggttggatgttccagaacatcttgataatccatcaattcttttaaaagcggtacgcggtttcatgtggtcaccacacctcgtagcgcttatgcggcataattggccgcttatgcggtggattggccgcttatgtggcttaagcggtacaaggttggggcacctgttccttgtatgcggccttgtaaatgtttttttagaacactgtaatccactattttgatcagggggctgatatggtaactggatccttgttctaaattagtaccctgtacaatcaatttttgtttattaacgtggaatttttatatccaaagaaggcctcacgcagggctggtgcaccaattttgatgggtagctgaatacccatttattttgtgtctatgttatatcgtgataaaatggagttttgctctattggttcatatattttctgtatctatgtatatagtgaagaaggtgaattttgctctattggttaggccttggatgcatcattctggctgtgggtttgattcccatgctctccagccccatgtcacctttttttcccagtatctcttgttcgcctcaatatctttgtattgtttctctcttccacccggtaagatttgagaaacctgccatattttctcagaaattcatcagttcttttcaaaaacaacctatcattgcataaaaaaacttgcatcttttctactgacgacattaaatcttttatttaaataccaccacataagcttcatatctcctgtgtttgccgctgtgccaccgcttgtcctagcgccatatgctccacgctcctccccttgtgtctttatctttgccccatctactattgtgcacttgggtcttggtcaaacagctcaacatggaatcaatcgactcaagcctagcctatcatgcaacttgtacctctcccctacaatcaggttgttaccacactgccataggcagattgccacctagctgccacacatttccttgccttgcagcctccaacatggctctaatccctgttgagcggtgcagatatgctaattaggtgcatcacaaactgtcatacttgccagttgcttgacaaaatgattgacttcttaaactttgaaccatttgtgcatgtactctgtccttctgttggataaactgtagtgcttgtgagagtgacgtggtaattccatttaacgtcaaaggtggagtctaggggttgtgggatttcatgtcaaaggggagtccagttatcctgccatttcagtatttagcagttcattatttccttttgaccatgctccatgccgatagattatgcaactggggcattaattgaaccatgttacgatttctctatattcagtcgagtgattgcttatattgcacctggtctgatcatgaatgaggttatgaacctgactactgctttccaattgctctttgggatgatatatgaatctatgttctctgaactgcatgctttagattattgcaaacatgttgaccattaagtataaataatgtagagttctcaatttgcagttcattttgatatattttcatttttctatgttctttgcagctgatacttgaaggaaatgcttctgattgttgtgtgtgcaactgtgcatgtcactcatttttcaatttggttaagtctaatcatggattccaggtgtagttccctcttcgcacattcatacctacgcaacatcctgtttctgcatatgtattgccgttaattgttgaaactgcatcataaacaaattttgcactgagaatatttgacttcttacctttgtggagaatgcgtggccagagcatagctcataacaaaatggtaagagtgactaaagtcaattgtcactggttagagcatggactgtttctaagtaagatttctttcttctgtaacatttactggttaacatatctgagttctgtgggtgctcacaagtgagcgtattgtttatgtatattgacatattgtttcacttctagacgataaagaaatcacgaatttgtagataatgtgggccattcctatgggcttctccttttgcatctgcatattacatctttaagtcttcaatatgaacaagaaatgatctttcttgattgggaaaaagtcagttatgtcaggtcactggttatttcttgattgttgaaatggactttgatcatggatcagaacatggtattttctccattgaattctacaggtacagtttcttttccttgttactgaccaatgcacttttgtcatcatctgattagtgttatcatctgaaaaccaatctgtatttcaatgtgttttaatcttcatctgaaacccattgtaccagctctgttccttgaccacaaatccaacttgcagagaagtacactgacctaggatggctcccaagcaaggaccaggaagtatacatctaaaaaataaagcattttttgtgcccaaacatttatggtcttgaacatcttgggtgtgttttgggagtcgttttttagcagcggtagcagctggagcagttcaaagtggctgcagtttgcagcaattttgaactgccgcagcctcagcagctgtggcaggtatggctgctgaacagagcccttattgttcaattatcaccctgtgacaggactttctgaaggcaagcttctgcatctagaatttctattttggtacttatagttcttgcgtgacatttgttctggcacaatgtaccaacaattttgatagtgaataactgagtacaatttaaaagatgaactttc

SEQ ID NO: 5799 - DNA, 1392 bp, Oryza sativa
  Predicted polypeptide sequence is orthologous to G811
atcccgcatttcctccattgcataccaacaccaaccactgaactagcactactagtatagcaagaagggtgatgacgacgacgacggcggagggcggtggcggggtggcgccgttcgtggcgaagacgtaccggatggtggacgacccggccaccgacggcgtcatcgcctggggcagggacagcaacagcttcgtcgtcgccgaccccttcgccttctcccagaccctcctccccgcccacttcaagcactccaacttctccagcttcgtccgccagctcaacacctacgggtttcgcaaggttgatccggacaggtgggagttcgcgcacgtgtcgttcctgcgcggccagacgcacctgctgcgccggatcgtgcgacggagcagcggcggagggggagcgaagaggaaggaggaggccggcggttgcggcggcggaggggaggcggccgccggggacgtcgacgaggagagcgccgtggtggccttggaggtggcgcggctgaggcgggagcagcgggagatcgagggccgcgtcgccgcgatgtggcgccgcgtgcaggagacggagcgccgccccaagcagatgctcgccttcctcgtcaaggtcgtcggcgacccgcaggtgctgcgccgcctcgtcgacagggacaacaccaacgccgccgcctccaacgccgacgactccgccgtgcatcatcaggtcaagaggccgcgcctcctcctcgactcatcctccaccaccaccacccacggcgaccgccacctcgtcaccgccgccgcagacgggttctacgccggcggctgcggcccggaggccgcagctgccgccgcgttcgtgccggacgacgcggtcgacttcaccggcctctacaccggcggcgacgggttcggcaacgccgtcgtcgacgccggcgtcgactacccgccggcgtacgcgttcccggtggtggacagcggctactaaagctgtaaccgctttgagattcgtgctcttgttgccgatccaacgatttgtgtacgcagtagtattttccgtttcagtttgccctccccaaagtgtttggacgaagtggctgtgaacggcgaaagaaggaagctaggtagctctcctagtagccatgttgggttttttcccccttgttgggggtttttggtctcggtgtgtgcctgacttgtgggccagccgggtgtatatgcgcaagcaaaaaaaaataatagtactggtagtatctaagttcaacaaaatttgctccgtttgaacaaaagatttcaaaaactacagaaacaggaaaagcacagtattaggaatcgaatgttggaatcgaatgttgagtgtgccttgtttggatggttatgaaaggaaaaatattttttaaatgtttggtacc

SEQ ID NO: 5800 - DNA, 1573 bp, Oryza sativa
  Predicted polypeptide sequence is orthologous to G811
gtccgtgcgtggctttgccttttgagggatttgacgtgtaggcaaaagctatagctcggagcagtggagtggcttggcttggcttggcttgctgctcggtcgatcgatcgagagatggacgggctgcacacggagctcgcgctggggctgatcgggtgctgcggcggtgacgggcagcagcagacggcgccgttcgtggcgaagacgtaccagatggtgtgcgacccgcggacggacgcgctcgtccggtgggggagggacaacaacagcttcgtcgtcgtcgaccccgccgccttctcgcagctcctcctcccctgcttcttcaagcacggcaacttctccagcttcgttcgccaactcaacacctacggattccggaaggttcaccctgaccggtgggagttcgcgcacgagtcgttcctgcgcggccagacgcacctgctgccgcgcatcgtgcgccgcaagaagcgtggcgagggcggcggtggcggtggcggcgcgtcctgctctttcggtggcggcgccggcgagcaccaggtggctgctgctgcggccagcgtgggaatgtcgggagaggaggaggatgcggcggaggacgtgctggccaaggaggccgcgctgttcgaggaggtgcagaggctgcggcacgagcagacggccatcggggaggagctggcgcggatgagccagcggctgcaggcgacggagcggcggcccgaccagctcatgtccttcctcgccaagctcgccgacgaccccaacgccgtcacgggcctcctcctcgagcaggccgccgagaggaagcgccggcgccagcacctcccttcccacgagcccaccgtctgtcccctcccgccggcgccgccgccacaacctccgcagccgctcctggctctcgccggcgccgcggccatggacggcacctactggtggacgacggagcatcatcatcatcatcatcatcagatgaagcccatgacggtgttgccatccttggagccgcccaccgctagctgcggcgtgcaccaagtgccggagctcgggggtggcggcgtgatgggcttaacgacggacggtgaggccaaggtggagccgccattcccattctgtctacttggtcaagctttcttttaattaacctgccgaatcatgcccatgcacgtagtaattcttccattccacttactgattcagtcactcgatcctacgtacacactgccaagaaaaaaaaaaacagatgttagttctggtgcaatgcatgcagtaacaccagcatcgatcagtacgtgttgatctgattattcttacagggtacagattagattacagacgatggtgtaaaaccttaattactactgtgtacttatgtacaacgcatcaaacaatagtggtacggtgttgattactagtacttttttgattgctagctgatagttaattagtactactattattagtaagtagtgttttcattaggtggatgcatggacatttcttcttgccctccaagtttgtagggttcatgatttcatcaaagtgcttatattaatctctgctgcataacttttgctgg

SEQ ID NO: 5801 - DNA, 1102 bp, Oryza sativa
  Predicted polypeptide sequence is orthologous to G811
ggcgcgctcactccctcccttgcccccaccgacgaacggaacaaatcttagcgaggaaaaagcgagcgcttttttcttatcctgttccgcgggcgcgctgccacgaccgaaccgggaggatacttgcgaattacacgatcggttgtggcactatgatgggcggcgagtgcaaggtccaccagctccaggccgccggcgacgggggcccaggcgccgtcgcgccgttcgtggcgaagacgttccacatggtgagcgacccgtcgacgaacgccgtcgtgcgctggggaggcgccggcaacacgttcctcgtgctcgaccccgccgccttctccgacttcctcctcccctcctacttcaagcaccgcaacttcgccagcttcgtccggcagctcaacacctacggattccgcaaggtggatccggacaggtgggagttcgcgcacgagtcgttcctgcgggggcaggcgcagctgctgccgcggatcgtgcgcaagaagaagaagggcggggcggcgccggggtgcagggagctgtgcgaggaaggggaggaggtgcggggcaccatcgaggcggtgcagcggctgcgggaggagcagaggggcatggaggaggagctccaggccatggaccagaggctgcgcgccgccgagagccgcccgggccagatgatggcgttcctcgccaagctcgccgacgaaccgggcgtcgtgctgcgcgccatgctcgccaagaaggaggagctggccgcggccggcaacaacgggtccgatccctgcaagaggcggcggatcggggccgacacggggcgcggcggcgtggcgaccggcggcgacgcggccgagatggcgcagagcagaggcaccgtgccgttcccgttctctgttcttggccaagtgttctactagccgcaacagggccagataggtgtacacgtacgcagtcccccgttgtatatataacaacagtgtaacttcgcctcggtttagttgcctactgttaagttagtgtacttaagcataataggagagtttggctaagtagctatcgttggatttgtgtgtatatatcgactatcgaggggctaataacgcctattttgttc

SEQ ID NO: 5802 - DNA, 412 bp, Oryza sativa
  misc_feature (405)..(405): n is a, c, g, or t
  Predicted polypeptide sequence is orthologous to G811
gatcgcttttgctgtactttgccttccgcttttcttcccctctcccttaccacatttaggagcccgcccccccccccccccatcacatatctccatctcgatccgcaacaaagatagtttgtagcggagatggcggcggcggcgggaggaggggcggcgccgttcgtgtggaagacgtacaggatggtggaggaccccgggacggacggggtgatcgggtgggggaaagggaacaacagcttcgtcgtcgccgaccccttcgtcttctcccagaccctgctccccgcccacttcaagcacaacaacttctccagcttcgtccgccagctcaacacctatgtcagtctcgtcactcccagttctatttcatcgtctcatcatactccccccctctctgcacttcanatcatgc

SEQ ID NO: 5803 - DNA, 3215 bp, Oryza sativa
  Predicted polypeptide sequence is orthologous to G812, G2467
attccattcgacaaactcgacatcgcgctgcgacgctccggccgacgcaacgcaccgctacaaacgcattctcgagtccacctgtgctcacctcggtcgttcctacaccgactcggtcgactcgtcaatgtgcgcggctttggccagcattcgctcttttcacctctcgtgagcttcggcattggccgagcatcatatcgctccttctttgcaacgcaaccaaatccttccatcggccacggccggtcaacgtctcagctgcaattcagccttcgcctcgtccggtcctcggcaagtccgaaccaagaatcggctcgattccgcacaggtgcttccgcctacatcgcttcgccttgctccatccttacgcctcgtaagcttctcttcgccctcttccgtgcgtgtcgaagacgagtgtcgattgctcgctcgaactcgtctgcacccatccttttccaacgtgacaatcgcccggtaaggccgaacgacaatctcacgcacaacgccgaaaagatcgctgtcgacagctcctgcacccgcacttgccctctgcgcagcatcttctggcctgttgccggagcaggaacgtagcgctcaagcaggccgtcacgcccatcattgatacccttggtgcgccaccgacgctcgccactcgcagctccaggacgccgttcggttgcctctgtggtccgcctttgctcaacatgaacggcatggaacacggtcaaagctttgaccccgcctttgatgccttctttcaggctccgtcctcatcctctccacatcaccaacttcagcattccgccgccggctcgcctgcgtccatccagcagatcggcaacatgagcgcagccgactcttcgctcagtctgtacgctcaagacacctcggcgatgcgcccgagctcctcgtcgggcggcaatctccatctcaacatctccaacctctcggtcacgggcggtgaagccgacgcctcacacgcacaggcacaccagcagcagggcgtcgccagctcgctcagtttcgcgcctaacaacacggcctcacctcagtccaccctcgcgtcaccggccgatgccactgcttcattcaacatgcccagcaccacatcaacctcgccgctcttgcatcctgatgcaccggtgggcacagccacagaagcccacctcggcgttcctaccgcatcgtctcctctcaagaccgagtacaacctcggaaacgagtcggctggcctgacgtcgacgatgcgctcctacagctctacttcgatcaaaagcgccgcgggatcgcagaatgccgacagcccaagctccggcttcggtgccggcggcgcggcaaatcagagcatgggtgacgtctcgatcgatgatgccaatgtcgctagccagtcggaagccgagctggcggccgagaaacgccaaagcagcaaatttgtctacaagctcttccgcatggtcagcgaccccgactaccagcatctcatcagctggaaccgcaacggcaccagcgtcatggtgtgcaactttgacgagttcgccaaggaggtgctgggcaagcactttaagcacagcaacttttccagctttatccgacagctgaacatgtacggcttctacaaggtgaacaagacgcctcgcggccatcgacagtcggtggacgcgcagatctgggagttctcgcatcccaagttcctgcgcggccgttcggatttgctcgatgacatccgtaggaaggccctggactctgaacacgcgcgggtcgaagctcgcgatctgcagtacagcgtcagtgtggggcagatgcagctgcgtcagcaggtcgacgagatgcaattccggctcgaggagctcacagagcagaacatggcgctgcgaacctttacaacccaactccgagacgtgcttggcctggtgctcgagcacgtcaaaaagacgagcggcggcaacattggtttcgacgtgcgcatccccacgctggacctgccctcgcccatgccgccgcaaggcctgtggacgccgcagggtcacgatggcccgcctatctttgtcaccgagcccgagttcggcgctggtgtcggaccgggtgggctgaggatgggcccgacgcctggcatggtgcctgggccgggccacgctccgccaccgatgcatgcaccccaacaccactttggcggtgcgccggatgggttcgccatgacgggcacgcccatctcgcgtcgcgtgtcggcgagctcggcgcatagcgagagcatgcttgccatgaacggctcgcccatgcacggatcgatgcagggtgagatgggcatgctgcctgctggtctgccgcagcgctcggcttctttcggcgagggacagatgcctgcaccccacttcaatatcggccgcggcggcgtcaaccgaccgggcctggcggggctcgcaattgacacttcggctgcatctggcatgtttggcggcatgcatccgagcgtgagcccgacatcagcagggctatcggcaagcaatgcagggctgggcgtgatgagcatgccgccgtcgccgctgacgccacagcatcaagcgatgatggcagcgatcaacactccgctgcctccgtcgccggcgccggggtcattggcgggtggccagttcaagccgttcgatggctcgccgttcgtgaccaataacggattcccctcgtacggccatggtctttctcttgccgaccagagcttctttgggccggaggccgatggtcccaatgccaaggcgatgcgcacgcccatgaagcacacggcgtccaattctgggcctagcgcgcagggcacgccagtgctcatgcagtcaacgtcgcccgggcttgccaagcgcaagtcgccaatctgaacgcgatgtcttctttgatacccgggtggctggcgcacgtcgtcgccatcccagtgattctccccttcgtttgtctccacaatcctttcccctcaaggacatcccctgaacccaacttctcttcttccctctccacgattgtgcctacgctggcatttcccaccatcttggccgactgtggctttcccctcagcactgctggcacagtgtgcagcggggctagtgtcgggagagtctgaccacgctcgttttttcgatttgatcccccctctgtctctccgccttgcggcctgtacaagttcggactctcgtcgtcgtttaatgcccgaagtcaccttctgtacctttttt

SEQ ID NO: 5804 - DNA, 1701 bp, Oryza sativa
  Predicted polypeptide sequence is orthologous to G831, G1202
atgccgaacgccggcgccgccaggaggtgcggcagggccacgcacgtcgacctgctcaccgtcgtcctcgccgcgatgctctgctgggcgtcctacaccctgtcgatctggcacaacagccgcggcgccgcggacagcagcgtgctcggcctcgtcgtcggcgccacggtctgcggcgacgccgacgaggagctcgacttcgaggcgcgccacgccgccgacgacgccggcctgtccgtgtcctcgggcccggcgaactcgagagtgcggcgggcgttgagctcgtcggggccagcgcccgccgcggcggggacgacggtgagccggtaccgcgccccgttcccgtggccggcgagccgcggcgtggtttgggcggggaactcggcccgcggcgccaaggccgccgccgacgccgccgccgccgccaacaagtgggcgcgcgtcgacggcgacatgctccggttcaccgacgccgccgccgtccgcgcgtacgcctacgtcgtgctccggctagtcgccgcgcccgtgcgcgccgccgtcgacgtcggggccatgcatggagggagctgggcggcggagctgatgtcccgcggcgtggtcaccgtgtccgtggcggcgccatggggcgcgtccgatggcgcggcgctcgtcgagctcgcgctggagagaggcgtcccggccgtgctcgccgccgcggggggcgcgcccagccgccggctcccgttcccggccggcgcgttcgacatggcgcactgcggtcgctgcctcgtgccgtggcatctccatggtaaacattttccatcctcgcgcacacggcgggcggttcttgatggagatcgaccgcgtgctccggccaggcggctactgggtccactcggcgcgccggcgaacggcacgcatgagcgcgccgccatcgaggccgccgcggcgagcatgtgctggaggagcgtcgcggaccagaacggcttcaccgtgtggcagaagccggtgggccacgtcggctgcgacgccggcgaaaactctccccggttctgcgccggccaaaacaagaagttcaaatgggacagcgacgtcgagccgtgcatcacgccgatccaagaaggcgcggcgccgccacgggaagcctcggcggcggaggcgctccgtcgcgacagcgagacgtggacgcggagggtggcgcggtacaaggcggtggccacccagctggggcagaagggcaggctccgcaacctgctcgacatgaacgcccgccgcggcgggttcgccgcggcgctggccgacgaccccgtctgggtcatgagcgtcgtcccggcgaccggcggcggcgacacggacacggacacgctcccggcgatctacgaccgcggcctcatcggcgcctaccatgactggtgtgagccattgccgactcccgccttgagctacgacctcctacacgccgactccctcttcaccatgtacagagacaggtgcgacatggaggatatcctgctggagatggacaggatcctgcggcccgggcgcgccgtgatcatccgcgacgacatcgccattttagcaaggatcaagaacttcttaactgatcggatgaggtgggattgccagattttcgacggcgaggatggctcggacgatcgtgagaagatcctgtttgcagcgaagacgtgctgtaacgatgaggatcgagatcaggagcaatga

SEQ ID NO: 5805 - DNA, 2679 bp, Oryza sativa
  Predicted polypeptide sequence is orthologous to G839, G1196
ccccccttcgtcctcgtcgtcttcctcccatttttttttcctcctcctcctcctctcatccctcgccgcgagccaaagcccctggtttcctcgcaactgcctccccgcgattccgtttgacccccactgttcttctcccctaccaccaccaggtcgcagtcgcttccaatttccaaataattccctccactccggccgctcgcgaggaaagaaaaggatttctttttctctctctctctctctccctctctccgagatccgtttcccaaacaggcggggggtcgaaagtgtttggtactttggtttggggaggcttgtttgccgacgcggatctgcgtggagacgagcagaggggggagcgccggaattgggtggtttggcccgggaggcgccggaaagtgggggagcctttggattccccgaacccgccatggtgatccggcacgagtagtagtggtggtggtggtattagtagcagtgagatgccggcgcgtagcgcggtggtggtaatagccatggagccctcgtcgtccatcaccatcgcgtcgtcgtcctcgtacctctcgaacgggtctagcccgtgctcggtctctcttgcgccgccgggggcaggggcggtggcggcgcaggcggcgccggttgccgccggggagggcggcggcggcggaggaggaggaggaggaggagggagtagtagcgtggaggtggtgagcctgaatcggcttagcgctaacctcgagcggctcctcctcgattccgacctcgactgcagcgacgccgacgtcgacgtggccgacggtggcccgcccgtgccagtccaccgctgcatcctcgccgcccgcagcaccttcttctacaacctcttcgcggcgcgcggccgcggcggcgatggggctgccggcggcggcggcggcggcggtggtgggggaggggagaggactggggggaggccgcggtacaagatggaggagctcgtgccgggaggccgcgtggggcgcgatgccttcctgtcgctgctgggttacctgtacacgggcaagctccggccggcgccggatgacgtggtgtcctgcgccgaccccatgtgcccgcacgactcgtgcccgccggcgatcaggttcaacgtcgagcaaatgtacgcggcgtgggcgttcaagatcaccgagctcatctcgctgttccagcgacggcttcttaacttcgtcgataagactctagtagaagatgttcttccaattctgcaagttgcttttcattcagagctgactccagtgcttgaaaaatgtattcggagaattgcaagatcaaatcttgataatgtatcgttggataaggaacttcctccagaagttgctgttcagataaaagagattcgccaaaaatctcagccaaatgagggtgacaccgtcatttcagaccctgtacatgagaaaagggtcagaagaatccacagggcactggattctgatgatgttgagcttgtgaagttgcttcttaacgaatctgagatcaccttggatgatgccaatgcattgcactatgctgctgcttactgtgattcgaaagttgtttcggagttgttagacttgagacttgccaacttgaatttgaagaattcgcgtggatacacggcactccatctggctgctatgaggagagagccagctattatcatgtgtctcctaaacaaaggagcagctgtatcacaattgactgctgatggccagagtgcaatgagtatctgccggaggttaacaaggatgaaagactacaatacaaagatggagcaaggccaagagtcaaacaaagacagattatgtattgatatattagatagggagatgataaggaaacctatggcagtggaagattctgtcacctcgcctttgttggctgacgatcttcacatgaagcttctctaccttgaaaacagagttgcatttgcaagattattttttcctgcagaagcaaaggttgcaatgcaaattgcacaagcagacaccacaccagaatttggcattgttcctgcagctagcacttctggaaaattgaaggaagtcgatctgaacgagacaccagtaacacaaaacaaaaggctccgttcaagggtggatgcactcatgaaaacagttgagctgggacgtcgctacttccctaactgctcgcaggtgctcgacaaatttctggaggatgatttgcccgatagtcctgatgcactcgacctccaaaatggcacttctgatgagcaaaatgttaaaaggatgcggttctgtgagttaaaggaggatgtgcgcaaggcattcagcaaagacagagctgataatagcatgttttctatcttgtcatcttcatcgtcatcttcgccacctcccaaggttgcaaagaaatgacagaagttttgtaacaaatttccgctcgtgatgttactgggacaagagatatcgatcaatagacctgtatagtcttacagtggtataacaattagatatcgaagcttcttcgaatattagaaagtgctgttctgggctgcactcagctggtttatgggacccatgcggtgaaactggcaaaagaaaaccagctgattagaggctccaaagcagtgtctctcgtgaatatgtttgtagcattctgttttgttcaggatggctataatgataaaatcttttcaatagatat

SEQ ID NO: 5806 - DNA, 3746 bp, Oryza sativa
  Predicted polypeptide sequence is orthologous to G839, G1196
gagcgagagaaaaatacacgcgcgaaatttccggataagagcagcgccggcggcggatgtaggcagcgtttgctgttgctgtttttttccctttttttccgtctcgttttgctcccacttcgctgctcccggatccgcgtagggttcttgtgtcgtgtggtggggttatgacccgcggcgctgctctgctttgctcgatttgctgtgcttgccttggaggtcgcctgcttggctgcttttgagagtgagtgtgtgtgtgtgtgtgttttttttttatacctcttttctttttctgggagaatttcccgttcttgggtttggtcttttttgcgaacctttgaaccctttcttgttggattctggggggaagtttatttatgcttaatttggcggttcttgttttgtttcggggagtttagaaaattttcgaggctttgattcgttttgattttgggtggggggaatctcgtcgtgcgaaaggattcgatcgggagagcctaccggagtttggattctcgcgtgcaccaccgcgtgaattatgaggggagaagtgagcttctagctagcatctagaaccttctagactctcctcgccatggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttctgataatcctacctatggcccagttttattcaggcgcaggaatagaatgagcaggcctctgtttcttcgcataatgaatgcagtagaggatcacgatgactattttgtgcagaagagaaatgcagctggtttaattgggttcagttgtcatcaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatagacacgattatatgatgggatattatcttgctgatggcatatatccttcttgggccacatttgtgaagaccataccagaaccacatggcaacaagaggaaatattttgccaaagcacaggaagcagtaaggaaggacgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgatgattttatccaaatgcacaaaaaaataagggacgacgaaactcactatcagctacgtgaagacctagtggagcacttgtggcaacattatccggataaatattgaggttttatttatatgtttgaattccatgtaataaataatatacatatgtgaggatttgccaaatcatcttaatttgtttttcatgaattgaataaatggtgtactgttcggtttaagaatagtacaggagaatt

SEQ ID NO: 5807 - DNA, 3746 bp, Oryza sativa
  Predicted polypeptide sequence is orthologous to G839, G1196
tagcgagagaaaaatacacgcgcgaaatttccggataagagcagcgccggcggcggatgtaggcagcgtttgctgttgctgtttttttccctttttttccgtctcgttttgctcccacttcgctgctcccggatccgcgtagggttcttgtgtcgtgtggtggggttatgacccgcggcgctgctctgctttgctcgatttgctgtgcttgccttggaggtcgcctgcttggctgcttttgagagtgagtgtgtgtgtgtgtgtgttttttttttatacctcttttctttttctgggagaatttcccgttcttgggtttggtcttttttgcgaacctttgaaccctttcttgttggattctggggggaagtttatttatgcttaatttggcggttcttgttttgtttcggggagtttagaaaattttcgaggctttgattcgttttgattttgggtggggggaatctcgtcgtgcgaaaggattcgatcgggagagcctaccggagtttggattctcgcgtgcaccaccgcgagaattatgaggggagaagtgagcttctagctagcatctagaaccttctagactctcctcgccatggagacgtccaccataagcttctcctcctcgtcgccgccgtcccctccgccgccgcagccggctccgggcgacatcgacgccgtcagcctcggccgcctcagcaggaacctcgagaacctcctcgaccccgcctttctcaactgcgccgacgccgagatcgtcctcgcctccggaggcggcgaccccggcggcggcgccgtcgtgggcgtccaccgctgcatcctcgccgccaggagccgcttcttctacgaccacttctcctccgcccccgcccccgcccccgccaccgccggcgacaagccgcagctggacctcgacgggctggtccccggcgggcgccacatcggccgagacgccctcgtcgccgttctcagctacctgtacaccggccgcctcaggtcggcgccccccgaggccgccgcctgcctggacgacggctgcagccacgacgcgtgccgcccggcgatcgacttcgtcgtcgagtccacgtacgccgcctccggcttccagatctccgagctcgtctccctcttccagcgccgattatctgattttgtgaacaaagctttggctgaggacatactgccaattcttgtggttgcctccacctgccatcttccagagctgctaaatcaatgtatccagagggttgccaactcgaacctggacaatcgttacctcgagaagcggcttccggatgatctgtacgccaagctgaaggagtttcgcgtgcctgatgaaccacacagtggcattcttgaccctgagcatgagaagagggtcagaaacatccacaaggccttggattccgatgatgtcgatcttgttggcatgcttctgaaggagtccccggtcaccttggatgatgcattcgccatacactacgctgcggcctactgtgagccaaaagtgttagcagaattgctgaaactggaatctgcaaatgtgaacctgaagaactcaagtggatacacgccgctccacatggcttgcatgaggcgagaaccggatatcattgtttcgcttatagaaaagggggcctctgttctggaaaggacacaggatggacgtgatgctcttaccatctgcaagagattaacaagggagaaagaccgcaacgagaaatcagaaaaatgcaaggagagaagcaaggcttacttgtgcattggcgtcttacagcaagaaataaagaggagaccacaaattttggaggaccagatgtctgcagaggagtcaattgctacacctctgctggttgataattttcacatgaggctactaaacttggagaatagagttgcctttgcaagaatatttttcccttcggaagccaaacttgtgatgcgcatagcacaagctgactcaactcaagagtttgctggtctcacatctgctaatttcagtaaacttaaggaggttgacctaaatgagacccccacaatgcaaaacaggaggttgcgagaacgccttgatgctttgacaaaaacagttgaactcggacgacgatacttcccacattgttcagaagttctcgacaagttcctgaatgaagaatccaccgatttgatcttgcttgaaagtggcacagcagaggaccagcaaaccaagaggatgcgcttttctgaactcagagaggatgtacggaaggcctttaccaaagataaggcagccggcgctgcaatatcttcctcaacatctgcgtcttcatcaccaagttgatttgatccaagatgagtcgacctcgctcctcgtttcaacagctcgtggatgaatcatcgtctgacgatgacgatgattttttttttgccacggcacaaatcgtccatagctattggcactctgtcaatgcaccaagacatggtgggtcagtcatgggacatgaagtgattgatcgcaacagagaagcacggcacttgagattataccaagactacttttctgataatcctacctatggcccagttttattcaggcgcaggaatagaatgagcaggcctctgtttcttcgcataatgaatgcagtagaggatcacgatgactattttgtgcagaagagaaatgcagctggtttaattgggttcagttgtcatcaaaaggtcactgcagcaatgcgtcagttggcttatggtatagcagcagatgctttggatgaatatctcggtattgcagaaagtaccgctatagagagcctgagaaggtttgtgaaagcagttgtacaagtttttgaacatgaatacttaagatcacccaatgagaacgatacaactcgattacttgaacttggggaggacagaggtttccccggtatgttaggctccatagattgcatgcattggaagtggaagaactgccctacagaattgcacggtatgtaccaagggcacgtgcacgagcctacaataattttagaagccgttgcttcaaaggatctctggatttggcacgctttttttggtatgcctgggtctcataacgatatcaatgtacttcatcgatccccgctatttgcaaagctagctgaaggcaaggctcctgaagtgaactatagtataaatagacacgattatatgatgggatattatcttgctgatggcatatatccttcttgggccacatttgtgaagaccataccagaaccacatggcaacaagaggaaatattttgccaaagcacaggaagcagtaaggaaggacgtcgaacgagcttttggggttctgcaagctcgatttgccattgttcgagggccagctcgacattgggatgaaaagactctgggatacatcatgaaagcttgtgttatcatgcataacatgattattgaagatgagggagaagttgattgggaagaacggttcccagagggaggagaaaatgtcagagtgtcccacgatgaaatacctgatcttgatgattttatccaaatgcacaaaaaaataagggacgacgaaactcactatcagctacgtgaagacctagtggagcacttgtggcaacattatccggataaatattgaggttttatttatatgtttgaattccatgtaataaataatatacatatgtgaggatttgccaaatcatcttaatttgtttttcatgaattgaataaatggtgtactgttcggtttaagaatagtacaggagaatt

SEQ ID NO: 5808 - DNA, 845 bp, Oryza sativa
  Predicted polypeptide sequence is orthologous to G846
cgacttgctctgtgctttgggtggttgttttctcttattaccagcagaagattcttcaccattcttctgatcagtgtcatcatcggcgttctgtttaggcacttcattggccacaattgtgtatgtagtgataacaacatcatattttgccaactcatttggatctttggtccttgagccaccatgatagaccaaaacagacaatttagcactttcaccaaccttgtcagtcaattcgttcgcccattgcttaagaacactagctgggcacaccactagagtacctgcagcaggccttgtcatggattgcatagtaaatgatgtgcttgccttactcttcttcttacgttcaacatttctttcaaccgtcttatctggagcagtattcattaggctagcacatgtttcaacgtcaccagtaccagctgctgttgatgacgaaccagctcctagatccttcctgggttcatcattcttagtctgctcccccttattatccgcaacaggcgctgcctcatcgtcatcatcaaggtttagcgcttcagcttttaaacgatctgaatcaacagacataaacttagactgctggatcctctgtttctgtataagggcaattgtagacactgttttgccaagaccctgatcatctgcaagaattccacctgcacaatgagagctattctccttcgaaaccatccaagccaatgccattttctggtgcctaagcagaggtactgacagaacaccctcaggcagatcatcttcccttttatcctggataatattctgtagtgcttcctggtacaccgctctctcgtcagaatctataatcctattttccaggt

SEQ ID NO: 5809 - DNA, 4155 bp, Oryza sativa
  Predicted polypeptide sequence is orthologous to G846
ggtgggagttttttttttcctcgcgtgtaatttttggcggtgttggatcgggttatgggggatagctgggaggttagcgaggtttggggtgtgtggttgggatgggagattggttgatcccgtcgattaggggtgtcccgcggcgagatttggtcccgttgcgcatttctgtttttctttttttgaaatgacctgattaattcaatccagttcgtagggtgtagctctctgtctggatcagattaggctttagtttatccatgtgtgattgcttcctagatttgaactggtcgggagtgtaccatgtgaatactgctttcgtatgaactgtgcggttactaacttccattcctaattaatatgactaatttttagggaagaaatgacttggtacctatgctagtatttttttcccctcatggataatgcttgataacgactttgagaagggcaaataaattcctaaaaaatgtttagcgttgctgttttttttttctttagtgttttctcacagttcaatatttactcatctacaccattatttgatccaccttgcaggttaagtcagcatagctaataactccgtctactgttgtgacctctgtggtttgctttgtgtgtttggcttcccaatcatctgcataaaccaggaagtgggtttgctttggaaatatttggggtcaaactagtagttggcacattgtgatctgatcatgtttatgcacagtttgtactgctaagcacaattggagttctgactatacagatgctgtgcgcatgcttgctggcaatatgaacaacgataactatattgacttgagttcagacagtgatatagattttgacttcgactcagatgattcagttggtggtttggaccaggagctagcttcatcttcttctaggcctactgaaaatataaatggtcaatataggactctgccaccttcttttacaaatggtagacatgttgataacgctcgtcatgcgttaggttcaggtgacagagcttatccgcattcaagttcttatagggggtcaccaaatgattctgcaagggcaactcctgcttccaacagaactgatattgtagtcaagaagcacaatggttttgcatcggaagaaaatgataatggcaagaggattcttccctcatccttttcaaatggccgcacaacaaatgctatgcatccagtggttgcaagtgagacacgcaaattcccaccatcttttaccaatggaaattcacaaagattggctgaaaataggatgggaaaaaatgttgccaatggaattggggagccttcatcgtcaaggtttccgagccgaagttcttttggtactgacaacaagagggtcatcacagacagtgacaatgaggatgtctatgtatatggaagctccagttcacatagggttcttcctccatcttttggtcgcaatagttctgctaatcacagcgaatttgctaatggcattgatatgcaaggtcgtctgaacctggaaaataggattatagattctgacgagagagcggtgtaccaggaagcactacagaatattatccaggataaaagggaagatgatctgcctgagggtgttctgtcagtacctctgcttaggcaccagaaaatggcattggcttggatggtttcgaaggagaatagctctcattgtgcaggtggaattcttgcagatgatcagggtcttggcaaaacagtgtctacaattgcccttatacagaaacagaggatccagcagtctaagtttatgtctgttgattcagatcgtttaaaagctgaagcgctaaaccttgatgatgacgatgaggcagcgcctgttgcggataataagggggagcagactaagaatgatgaacccaggaaggatctaggagctggttcgtcatcaacagcagctggtactggtgacgttgaaacatgtgctagcctaatgaatactgctccagataagacggttgaaagaaatgttgaacgtaagaagaagagtaaggcaagcacatcatctactatgcaatccatgacaaggcctgctgcaggtactctagtggtgtgcccagctagtgttcttaagcaatgggcgaacgaattgactgacaaggttggtgaaagtgctaaattgtctgttttggtctatcatggtggctcaaggaccaaagatccaaatgagttggcaaaatatgatgttgttatcactacatacacaattgtggccaatgaagtgcctaaacagaatgccgatgatgacactgatcagaagaatggtgaagaatcttctgctggtaataagagaaaacaaccacccaaagcacagagcaagtcgaagaaaaagaaaaagaaacttaaggattcagacatttaccttgccagtggcccagttgcaagagtgcgatggtttagggttgtccttgatgaagctcagacaataaagaactttcgaactcaagtggctaaagcctgttgtggattacgtgcaaaaagaagatggtgcttatcaggaacacctatacaaaatgcaattgatgagctctacagctatttccatttcttgaaatacgatccatattctacttataattcattttgtacaatgataaagcacccgattgctagaaatgcagttcatgggtataagaaacttcagactgtgttgaggatagttctcctgcgccgcacaaaagaaactctgattgatggtgagccaatcataaagctacctccaaagacaattaatctggataaagtagattttacaaaagaggagcgagctttctatttgacactggaagaacgctcgcggcaacagttcaaggcatacgctgctgctggtacactcaaacagaactatgccaacattcttctaatgctgttgcgccttaggcaggcctgcgatcatcctcttcttgtgaaggggcatcagtcagagtataaaggcgatggttctatagaaatggcaaagcaacttcctaaagaaatgataataaatttgcttgcaaagctggaagttggagagttttgttctgtatgcagtgatgtacctgaggatgccgtcgtgacgatgtgtggccatgtcttctgctatcaatgtatatacgagcggataactactgatgagaatatgtgtcccttccctaattgtggaaacacattaagtaccgattcagtattttcgtcaggagcgttaaggatttgcatgtctggtgtatccagttctcatgcatcagggagttcatcattagatgacgagtcatcttctattagtcaaactagttacatatcctcaaagatacaggcggcaatcgatatactgaattcgatcattaacacctatgcccttaccgacagtgataccgtcgaatcaaatcctagccgagtggccccagtgaaagccattgtgttctcccagtggactggcatgctggatttgctggagctttcattgaatagcaatctcatacagtacaggagactagatggaacaatgtccctcaattcaagagataaagcagtgaaagattttaacacagacccagaggtcagggttatgatcatgtcactgaaagcaggtaatcttggtctcaatatggttgctgcttgccatgtaattctccttgatctttggtggaatccttatgctgaggaccaggcaattgatagagcacacagaattggtcagactcgtcctgttactgtctcccgtttaaccattaaagatacggtggaagatcgcattttagctctgcaggaggaaaagagagccatggttagctctgcttttggcgaagacaaatcgggtggccacgcgactcggctcaccgtggatgatctgaagtatctatttaggttttgattggaagcacccgtgatctctgcgatacaatgacattgtatagtagcctgtgatctttgcctagatgcaactccaacagctgtgtaccgctgctgagtattttggtgcgaggtactgcggatttgtgtccttccatggctcgcagcagctccagttttgtcatgctctgatttgctagacgaaatgtagtaggcttagtcgctagcctgtgttgaatatttgaccccagcttgtaggagaattctgccattgctccctgttttatcaagagatccatctggtggt

SEQ ID NO: 5810 - DNA, 4156 bp, Oryza sativa
  Predicted polypeptide sequence is orthologous to G846
gtgtgggagttttttttttcctcgcgtgtaatttttggcggtgttggatcgggttatgggggatagctgggaggttagcgaggtttggggtgtgtggttgggatgggagattggttgatcccgtcgattaggggtgtcccgcggcgagatttggtcccgttgcgcatttctgtttttctttttttgaaatgacctgattaattcaatccagttcgtagggtgtagctctctgtctggatcagattaggctttagtttatccatgtgtgattgcttcctagatttgaactggtcgggagtgtaccatgtgaatactgctttcgtatgaactgtgcggttactaacttccattcctaattaatatgactaatttttagggaagaaatgacttggtacctatgctagtatttttttcccctcatggataatgcttgataacgactttgagaagggcaaataaattcctaaaaaatgtttagcgttgctgttttttttttctttagtgttttctcacagttcaatatttactcatctacaccattatttgatccaccttgcaggttaagtcagcatagctaataactccgtctactgttgtgacctctgtggtttgctttgtgtgtttggcttcccaatcatctgcataaaccaggaagtgggtttgctttggaaatatttggggtcaaactagtagttggcacattgtgatctgatcatgtttatgcacagtttgtactgctaagcacaattggagttctgactatacagatgctgtgcgcatgcttgctggcaatatgaacaacgataactatattgacttgagttcagacagtgatatagattttgacttcgactcagatgattcagttggtggtttggaccaggagctagcttcatcttcttctaggcctactgaaaatataaatggtcaatatagaactctgccaccttcttttacaaatggtagacatgttgataacgctcgtcatgcgttaggttcaggtgacagagcttatccgcattcaagttcttatagggggtcaccaaatgattctgcaagggcaactcctgcttccaacagaactgatattgtagtcaagaagcacaatggttttgcatcggaagaaaatgataatggcaagaggattcttccctcatccttttcaaatggccgcacaacaaatgctatgcatccagtggttgcaagtgagacacgcaaattcccaccatcttttaccaatggaaattcacaaagattggctgaaaataggatgggaaaaaatgttgccaatggaattggggagccttcatcgtcaaggtttccgagccgaagttcttttggtactgacaacaagaaggtcatcacagacagtgacaatgaggatgtctatgtatatggaagctccagttcacatagggttcttcctccatcttttggtcgcaatagttctgctaatcacagcgaatttgctaatggcattgatatgcaaggtcgtctgaacctggaaaataggattatagattctgacgagagagcggtgtaccaggaagcactacagaatattatccaggataaaagggaagatgatctgcctgagggtgttctgtcagtacctctgcttaggcaccagaaaatggcattggcttggatggtttcgaaggagaatagctctcattgtgcaggtggaattcttgcagatgatcagggtcttggcaaaacagtgtctacaattgcccttatacagaaacagaggatccagcagtctaagtttatgtctgttgattcagatcgtttaaaagctgaagcgctaaaccttgatgatgacgatgaggcagcgcctgttgcggataataagggggagcagactaagaatgatgaacccaggaaggatctaggagctggttcgtcatcaacagcagctggtactggtgacgttgaaacatgtgctagcctaatgaatactgctccagataagacggttgaaagaaatgttgaacgtaagaagaagagtaaggcaagcacatcatctactatgcaatccatgacaaggcctgctgcaggtactctagtggtgtgcccagctagtgttcttaagcaatgggcgaacgaattgactgacaaggttggtgaaagtgctaaattgtctgttttggtctatcatggtggctcaaggaccaaagatccaaatgagttggcaaaatatgatgttgttatcactacatacacaattgtggccaatgaagtgcctaaacagaatgccgatgatgacactgatcagaagaatggtgaagaatcttctgctggtaataagagaaaacaaccacccaaagcacagagcaagtcgaagaaaaagaaaaagaaacttaaggattcagacatttaccttgccagtggcccagttgcaagagtgcgatggtttagggttgtccttgatgaagctcagacaataaagaactttcgaactcaagtggctaaagcctgttgtggattacgtgcaaaaagaagatggtgcttatcaggaacacctatacaaaatgcaattgatgagctctacagctatttccatttcttgaaatacgatccatattctacttataattcattttgtacaatgataaagcacccgattgctagaaatgcagttcatgggtataagaaacttcagactgtgttgaggatagttctcctgcgccgcacaaaagaaactctgattgatggtgagccaatcataaagctacctccaaagacaattaatctggataaagtagattttacaaaagaggagcgagctttctatttgacgctggaagaacgctcgcggcaacagttcaaggcatacgctgctgctggtacactcaaacagaactatgccaacattcttctaatgctgttgcgccttaggcaggcctgcgatcatcctcttcttgtgaaggggcatcagtcagagtataaaggcgatggttctatagaaatggcaaagcaacttcctaaagaaatgataataaatttgcttgcaaagctggaagttggagagttttgttctgtatgcagtgatgtacctgaggatgccgtcgtgacgatgtgtggccatgtcttctgctatcaatgtatatacgagcggataactactgatgagaatatgtgtccctcccctaattgtggaaacacattaagtaccgattcagtattttcgtcaggagcgttaaggatttgcatgtctggtgtatccagttctcatgcatcagggagttcatcattagatgacgagtcatcttctattagtcaaactagttacatatcctcaaagatacaggcggcaatcgatatactgaattcgatcattaacacctatgcccttaccgacagtgataccgtcgaatcaaatcctagccgagtggccccagtgaaagccattgtgttctcccagtggactggcatgctggatttgctggagctttcattgaatagcaatctcatacagtacaggagactagatggaacaatgtccctcaattcaagagataaagcagtgaaagattttaacacagacccagaggtcagggttatgatcatgtcactgaaagcaggtaatcttggtctcaatatggttgctgcttgccatgtaattctccttgatctttggtggaatccttatgctgaggaccaggcaattgatagagcacacagaattggtcagactcgtcctgttactgtctcccgtttaaccattaaagatacggtggaagatcgcattttagctctgcaggaggaaaagagagccatggttagctctgcttttggcgaagacaaatcgggtggccacgcgactcggctcaccgtggatgatctgaagtatctatttaggttttgattggaagcacccgtgatctctgcgatacaatgacattgtatagtagcctgtgatctttgcctagatgcaactccaacagctgtgtaccgctgctgagtattttggtgcgaggtactgcggatttgtgtccttccatggctcgcagcagctccagttttgtcatgctctgatttgctagacgaaatgtagtaggcttagtcgctagcctgtgttgaatatttgaccccagcttgtaggagaattctgccattgctccctgttttatcaagagatccatctggtggt

SEQ ID NO: 5811 - DNA, 715 bp, Oryza sativa
  Predicted polypeptide sequence is orthologous to G846
gcatccgctcggacgcgacgaccacggtgatcctcatctcgttcaaggcgggcagtacggggctgaacctgacggcgtgcagccgggtgatcctgatggacttgtggtggaatccgcagatcgaagagcaggcgttcgaccgcgcccaccgtctggggcaggtgcgcgacgtgaccatctacaagctcagcatcaaggatacggtcgaggagcgcatcctcaagctgcaggacaagaagcgcgcgctcgctaaggccgcgctcgagggcagcaagctcgtcaagggcaatcggctcgatttcaaggagatctggttcttgttcaacggcaacgactagcgtcgcccacaacgcaacttgcagaaaactattcaacaaaacgagagtgaggcaaggaaacaaaggcagtgtgtgtggggagtgtttagggacggcggagggcgacggcttcggagaagggtttgaagacgtcaaagtggtcgaggggtacgtcgaggggcttggtgattttgaaggcgggtttggtgtggaagtggggataccaaaagtcgtcgtaggtggcatactccgtacccagcatttgctgtaccgtcttctttcccttcctctgaagtctagctaaggcctctgggggagtatgagccagattggcatgcaacttctccgccagactattttcgaacgcaatggtgctttcctttgttaaaaaaaaaaaa

SEQ ID NO: 5812 - DNA, 2582 bp, Oryza sativa
  Predicted polypeptide sequence is orthologous to G852, G2633
ggtttatgcttaatttgcttccattttgtttattactcctacaagaaattgatgagggggttcgcttgccgttgcagcacaccacatccccctcatccacctgtccgtgatgatactcccatagttgagacttgagattgcccttctcctcaatcttgttgatctcttctcccacctcgcgccttcgagctagtcgtgtttaggtttagccccattaatcttggtaagggtggtagtggttgttgctgttgttgttgttgttgccctgaagctttcttcctcaaggaccagaatttgtcttcagctgctaaaggagggcctaccactaaagatttgtgatcaatcccactttgatctattaccattgtggcgctgaatattcagtgataacaacggcaagatcaactccctattaattgttcggaagtgcatcattcctcagcgactccagcatataaataaaatccagaaggttgcaccagagaatatgtcaatgcaggcctctaaccgaccatacagatatccagacaattctcaaataccatactacagccggagttcaatgcatgtggggcaaaatggtacttaccatgtgcaacaaaatcatgaggatctttacgcgtcatctgatgatggttcacagaacggcaattctaaggctcaggggttgcaagcacagtactgcactctagattcatcctcaggcaattttgtgtatccagcacatagctctacatcctcccacataagtgggagccccatttctcagcaagatagccactcagagcacacatctggttcccctgcaagtgcttcatgtgttactgaagttccaggcttgaggtttacaacaattgaggagatagagaatgcaatgtttggacctgaacctgacacagttagctcggactgctccttacttactgattctgctttttaccaagataactggagggagcatctgggaatcaatacaggggacttgaagcaggtaattgcagcatgcggtaaggctgttgatgagaatagttggtatagggacttgctgatatctgagttaaggaacatggtttccatttctggagagccgatgcaacgccttggagcctatatgttggaaggccttgttgccaggctttcttcgactgggcatgccttatataaatccctgaagtgtaaagaacctactagcttcgagctcatgtcttatatgcatctcctctatgagatatgcccgtttttcaagtttggttacatgtctgccaatggagcaattgcagaggctgttaagggcgagaactttgttcacatcatcgacttccaaattgctcaaggtagccagtgggcaactatgatacaggcccttgctgcaaggcctgggggaccaccatacctgaggattactggtatagatgactcgaattctgcccatgcccgaggtggtggactggatatagtcggacggcggttattcaatattgcccagtcatgtggtctgccctttgagttcaatgctgtcccagcagctagtcatgaggttatgcttgaacatcttgatataagatctggggaggttattgttgttaattttgcctaccagctgcatcacactcctgatgagagtgtgggcatagaaaatcaccgggacaggatattgagaatggtcaaggggctctctccaagggtggtaactcttgtagaacaggaagcaaacacaaacactgcacctttcttcaatagatacttggaaactcttgattattacacagctatgtttgaagctatagatgttgcttgcccaagggatgacaagaagcggattagcactgagcaacactgtgttgcaagagatattgttaatttgattgcatgtgaaggtgcagaaagggtggagaggcacgagccttttggaaaatggagggcaaggctttcaatggctggctttaggccgtacccactaagtgcactggtgaacaacactatcaaaaagttgctggatagttaccacagttactacaagctagaggagagagatggtgccctttatcttggatggaagaacagaaagctggttgtatcttctgcatggcggtgacatctccgtgttaatttggaagaagcttctttaggttctttcgtggcttcttggtggacgcatgaatccaaggtggaacctgatcttcatagagcagagagaactccatagtccagaacaatgtggtcgcttgcttgttggcacccatctctaaaccctcgtatgcttaccatccgtcagatttaatcgccataggcagaatactcttcctgacttcccatagtccagtccagtcgcaatataggtgtacactgtactgttttacctgctcatggtagaatgtccgttttatgtcgatcagtcaagtagagtctggtcaccagaatccccgtcttaatagaacgtctgttttaaaagtcagtcaagaagagagtctggtcaccagagtccgtttcttgatcctgctcgttgtacaatacaatgacgtctcaatgtgaattctggatcctatgctactacaatgatgatatgcctcactgaattctgg

SEQ ID NO: 5813 - DNA, 2162 bp, Oryza sativa
  Predicted polypeptide sequence is orthologous to G852, G2633
gatcgcagcacacgaaaagagaaccagagagagagagagagagagagagagagagagaggagtggaagtggatcggggcatcgctgcggcgtcggggctgtgcagatcggaggaggtcatgaacgactaatctccgttcatttattatggacttgcaccagttattaaagtacagattgactggcgctaacgttgtgtacgaaattcctacagagaacaacttgcaaaactctccctggcaagctaacccactgaagtacgagttcagcgattccccatacacccctctctcttcccaatttgagtgtgacaatttgtctgctcttaccaacactccagataaccagagctctgcagaaaccatttcagcccaaccaatctccccattggaagcagacagctcatatagacaggcgggtattcttctccaggagaacattcaagtgggagctgatccgttgtatgctacatcaagacataatatgcaacacgccttacgggagattgagactgttctgatggcacctgatacagatgatgcaacaactagcaccgagcatgagtttgaggaaatcaagcctgctcagcttgtgaggcagcggtcgagaacatggagtcatgaatcacggcagccgttacctggagttggtcggtcacagtttgcatctggtggataccccacagcaagctatgaatttcgtccagagaaacggcaaagggagttaagggaagaccctcagataattgtgaagcagctattaaccaggtgtgctgaggctctgagtgaggacaggacagaggagttccataagcttgttcaggaggctcgtggagtggtctcaatcaacggggaaccaatccaacgtctaggtgcttacctactggagggtttggttgctagacatggaaactctggcacaaacatctaccgtgctctgaagtgccgtgagccagagagcaaggagctcctgtcctacatgagaattctatacaatatctgcccttacttcaagtttggctatatggcagccaatggggcgattgcagaagcattgagaactgagaacaatatccacataattgattttcagattgctcaagggactcaatggatcacactgatacaagcattagctgcaaggcctggtggtcctcctcgtgtgcggatcaccgggatagatgacccagtgtcagagtatgctcgtggtgaaggtcttgacattgtggggaaaatgttgaaaagcatgtctgaagaattcaaaatacctctggagtttacgcctctgtctgtctatgccacacaagtcacgaaagagatgcttgagatcaggccaggtgaagcactgtctgtaaacttcacactccagctacaccacaccccggacgagagcgtggatgtcaacaacccacgcgatggtctgctccggatggtgaaagggctgtccccgaaggtgactactttggtagagcaggagtcacacaccaacacaacgcctttcttgatgaggtttggggagaccatggagtactactccgccatgttcgagtcgatcgacgccaacctgccgcgggacaacaaggagaggatcagcgtggagcagcactgcctcgccaaggacatcgtcaacatcatcgcctgcgaggggaaggacagggtggagaggcatgagctgcttggcaagtggaagtcgaggctgaccatggccggcttcaggccttacccgttgagctcgtacgtcaactcggtgataaggaagcttctcgcctgctactccgataaatacacattggatgagaaggacggcgcgatgcttctcggctggaggagcagaaagctgatatctgcttctgcgtggcactgacagtagtatgttgagaagaagaaatgatagagagcatatatatacataccgattccctggtccaatttacagaatgataccctttgatgtaccctcagtttgattgacagcgggtgttgccttcatttatagaccaggatcaaacattgacattagatttgtagagaagttgtatgataataattttctttgcgattcaatgtatgatgtatccatggctgccatagttaataatattcttgcatagtcatattgatcggctaatcacccgtggattagcgttgtgtctgtcttgacaat

SEQ ID NO: 5814 - DNA, 2171 bp, Oryza sativa
  Predicted polypeptide sequence is orthologous to G852, G2633
gtcttcttccccttttccttccttccctcctgctccctctccttcccatttccgttctccgcttccccacctcgccttctccgctcctcctcctcctcctctcctgccgctctcctgtgtgtgctaccggaagcaagctaccccctcctcctgtatttgttcaatatccataatcagaggaagctgtgccttgagtttgagtatttagcctagtaggtttagaagcactacagaaaagtaatgtcttttatcaggcgagcagacccgtcaaccacttacgcagataatctttacatacataaatttggcactccaaattcaaatttcgctgcacgaagatatgcgtccgacacacagctgttccgttatgggcctgaaccatacaatcctgagaactccttttacaatcaacaggcctcaccaatgccgtacatggtaacagctgatggccattctccatcttctgcagacaattcctgctcagatgtggcaaaagactcaccattggtgtccaatgtatctcagcagaattctcagtctatatcagacaatcagagttctgaacttgaagtagagtttgatgaagatgatatcaggatgaagcttcaggagctggagcatgctttacttgatgatagtgatgacatcttgtatgagatttcccaggcaggtagcattaacgatgaatgggctgatccaatgaagaatgtcatactccctaactcaccaaaagaatcggaatcaagcatcagttgtgctggtagcaacaatggagaaccacggaccccaaagcagttgctctttgactgtgcaatggcattatctgattataatgtagatgaagcacaggcaatcataacggacctccggcagatggtctcaatccaaggggacccttctcagaggattgcagcctatctagtggaaggtcttgcagcaagaatagtagcttcagggaaaggcatatacaaggccttgtcgtgcaaagagcccccgactctttatcagctttcggcaatgcaaatcctctttgaaatctgcccgtgcttccgatttggtttcatggctgctaattatgctatacttgaagcctgcaaaggtgaagatagagtgcacattatagactttgacattaatcagggcagccagtacattacactgatacagtttctgaaaaataatgcaaataagccacgtcatttgagaataactggtgtggatgatcctgaaacggtacagaggaccgttggcggtttgaaggtcattggtcaacgtctagagaaacttgcagaggactgtgggatatcttttgagttcagggcagttggtgctaacattggggatgttacacctgcaatgctagattgttgtcctggggaagcactagttgtcaattttgcattccagctgcaccaccttcctgacgagagcgtttcaattatgaatgaaagggaccaactccttcgaatggtgaagggtctgcaaccaaagctcgtcacactggttgagcaggatgccaataccaatactgctccatttcagacaaggttccgtgaggtttatgattattatgctgcactttttgattcactggacgcgacacttccaagggaaagtccggatagaatgaatgtggagcggcaatgtcttgctcgtgaaattgtcaacatcttggcttgcgaaggtcctgatcgtgtggagagatatgaagttgctggaaaatggagggcaagaatgacaatggctggcttcacaccatgcccatttagtagcaatgtcatcagcgggataagatcgttactgaagtcgtactgtgacagatacaagttcgaggaggaccatgggggacttcacttcggctggggagagaaaactctaatcgtctcctccgcatggcaatagagcttacagaatgagttggcattagtcttgctgttatttaggagcatctgatgcagagactgtaaaaaatgtgaaccactgaacttgtcaactgatcttacctaatcgtagatgtctgcttgtcagaataatcgagttagttgaactatgttgtattagagaattggcacatgatcgtgttgtattctggggtagaattatcttgtcgactctgcttcatgtataaaattatgtgttgctagaatatgccatatttatcatcttgggag

SEQ ID NO: 5815 - DNA, 1575 bp, Oryza sativa
  Predicted polypeptide sequence is orthologous to G852, G2633
atgccgtactataataactcagtgccttcagggggaaatggtaggttctatataacacaaaatcatcaggatgctcactacgcttcttctgatgatgggtcacagaagattggttcgagccctcaagcatttgaagcgccgtactgcactctagaatcatcctcagcaaatggtgctcatcctgcccatagctctgcatcttctcacagcatctctcctattagcgggagccccctgtctcatcatgatagccactcagaccacacgtacaattcccctccaagtgcatcctgtgtcacagagattacagatctccagattaaactgagggagctggagaatgcaattcttgggcctgagctagacatagcttatgacagccctgagagcgccttgcaaccaaacataatggcaacaccagaaaattggagacagcttctgggaattaatacaggagatttgaagcaagtaatcatagcatgtggcaaggctgttgccgagaatgatgttcggctgacagaactactgatatctgagttaggtcagatggtgtctgtctctggtgatccattgcaacgattgggggcttatatgttggaaggccttgttgccagactttcttcctctggcagtaagatatataaatccttgaagtgtaaggagcctacaagctctgagctcatgtcatacatgcatcttctttacgagatatgcccattcttcaaatttggttatatgtcagctaatggcgccatcgctgaagctattaagggagagaactttgttcacataattgacttccaaattgcacaagggagtcaatggatgacattaatacaggcccttgcagcgaggcctggaggaccaccatttctacgaatcactggtatagatgactcgaattctgcttacgccagaggtggtggactggatatagttggtatgagattgtataaagttgctcagtcttttggtctgccctttgagttcaatgctgttccagctgctagccatgaggtttatcttgagcatcttgatataagagttggtgaagttattgttgtgaattttgcctatcagctgcatcacactccagatgaaagtgtaagcacagaaaaccatcgggataggattttaagaatggtcaagagcctctcccctaggttggtgactcttgttgagcaggagtcaaatacaaacacacggccattcttcccaagatacttggagactcttgactactacacagccatgtttgagtcgatagatgtcgctctcccaagggatgataagagacggatgagcgcagagcaacactgtgtggcgcgggacattgtcaatttaatcgcatgtgagggtgctgagagggtagagaggcatgaggtctttggaaaatggaaggcaagattaacgatggcagggtttcggccatacccgctgagttcagtggtgaacagtaccatcaaaacgctgttgcatacttacaatagcttctacaggcttgaggagcgagatggtgttctttaccttggatggaagaacagagtattggttgtatcttctgcatggtgttga

SEQ ID NO: 5816 - DNA, 2272 bp, Oryza sativa
  Predicted polypeptide sequence is orthologous to G852, G2633
ggcacgggccaccgggtagaaatacccgcgcccacccgaaaaattccccagctcacctcctcctcactaccaccaccaccaccaccacctgcttcctccgcggctgcgtgcgccgcctccccaacccttcgtcctccccgccggccgccgctgagatccgacgcgccggagcggagctcgctgagattttgttcctgctggatttctgaaattttactggaggactagagatatcaagacaccaacaacaaactagtacaaagttttccttccagttaatctgttcctggatctccttgccatacgcgaagcagtggatactatgcagtaattggttaggaggtctttactgaaccataatggctgatactccaacttcccgaatgattcatcccttcagcaatataccgagccaaaacctgaagcagttccagtattctgataatccgcagcacccttgccacccttatagggcaccttcagacacccacgttgtgccacatcattatggcctaaagtcacattcaccggatgctggttatgaaagccaggctactcctaacaagtacacattggactcctctgaaggtgctggttgtatgagacatgattctccttccagtcaaagtttcacaaccagaagtggtagccctctatctcaggaagacagccactctgactcgactgatggatctcctgtaggcgcctcctgtgtcactgaggatcctaatgatctgaagcaaaaactgaaggatctcgaggccgttatgcttgggccagactcggaaatagtcaacagccttgagaattcggtggcaaaccaactttccttggagccggagaagtgggtgcgcatgatgggcattcctagaggcaacttgaaagagctactgattgcctgtgctagagctgtggaagagaagaatagctttgctattgatatgatgattccagagctgagaaaaatagtttcggtatctggtgagccacttgagaggttgggagcctacatggtagaagggcttgttgccaggcttgcctcctctggcatttcaatctacaaagctttgaaatgcaaggaaccaaagagctctgaccttctgtcttacatgcacttcctgtatgaggcctgtccctacttcaagtttgggtatatgtcggcaaatggtgctattgcagaggctgtcaagggagaagacaggattcatatcatcgacttccatatctctcaaggggctcagtggatctctctccttcaggcccttgcagccaggcctggtggaccaccaactgtaaggatcactggtattgatgactcagtgtcagcttacgcacgaggcggcgggttagagctggtcggaaggaggctgtcgcacatcgccagcctgtgcaaggtgccctttgaattccacccacttgctatctccggcagcaaggtggaggcagcacatctcggagtcatccccggggaagccctcgccgtgaacttcaccctggagctgcaccacattccagacgagtcggtgagcacggcgaaccaccgtgaccgcctcctaaggatggtgaagagcctgtcgccgaaggtactcaccctggtggagatggagtccaacacgaacacggcgccattcccgcagaggttcgcggagacgctggactactacaccgccatcttcgagtccatcgacctgacgctgccgagggacgacagggagaggatcaacatggagcagcactgcctcgcgagggagatcgtcaacctcatcgcgtgcgagggggaggagagggcggagcggtacgagcccttcggcaagtggaaggcgcgcctcaccatggccgggttcaggccgtcgccgctcagctcgctggtgaacgccaccatcaggacgctgctgcagagctactcggacaactacaagctcgccgagagggatggggcgctctacctcgggtggaagagcaggcccctggtggtctcgtcggcgtggcactagcgttgtgactttgtgaggtgatctgacgacgaacttcccttgtaaccatcttggctgggggctttagaaagctatagtgatcatggactggtaagggtagctgtaacaatggtgttgtaatggtaaggtagcggctagggtcaaactcgaaaatgggcaaaatgctgatgaggtgtagaagtgtagtacatgtttgagagtatatgtttcagtttttcttttaaatgtcttgtagtaatgttgtggcacactaatgtctatgatcagaattatcatcc

SEQ ID NO: 5817 - DNA, 1245 bp, Oryza sativa
  Predicted polypeptide sequence is orthologous to G861, G1140
ggcgccgcgcctcgcctcgcctcgcctcacctcacctcacctcaccctccgcctcgtctccttcccccctttcctctacccacgcacgccctctctcccatcccagccgtagccgcgccgtgacttgtctcgatcggcggcgaggaggagggcttccgttccctggccggtgggggaggatcaggcgggggggcggcggggagggggaggagatcggtctcggtcgatccgcgcgcggcggcgatggcgcgggagaggcgggagataaagaggatagagagcgcggcggcgcggcaggtcaccttctccaagcgccggcgcggcctgttcaagaaggccgaggagctctccgtgctctgcgacgccgacgtcgcgctcatcgtcttctcctccacggggaagctatcccacttcgcaagctccagtatgaatgaaatcatcgacaagtacaacacacattctaataatctggggaaagcagaacagccttcgctcgacttgaatttagaacatagcgagtatgcacatttgaatgagcaacttggggaagctagtctccggcttagacaaatgagaggtgaggagcttgagggattgagcattgatgaactccagcagctagagaggaacctggaagctggtctgcacagggtgatgctgacaaaggatcaacaatttatggagcagatcagtgaactccagcggaagagttcacagctggcagaggagaacatgcaactcagaaaccaggtatcccagatatcaccagctgagaagcaagttgttgatactgaaaattttgttaccgaaggacagtcctctgaatctgtgatgactgcattgcattctggaagttcacagtcgcaggataatgatgatggctcggatgtatccctgaaattagggctgccttgtggtgcatggaagtaactgaaaggaaaaaaaaagcatccttgcagatctggttggagtcgttgcggcatccaggggagaaacgcttgtgttattcccaaacccagactgcaataatataatcttgcgttggaagcgagatcagttaacctgatttatcatccttgtggctgcatgatgcgatgttccgcttgtactgttcgctaggatcttgactaaactttgagatctatgtgccgtttaattatcccatcgctattggcactccttatgcgatacatcatatatgcactttgttgctatcttaattatgatgcgtcttttgcagcgttc

SEQ ID NO: 5818 - DNA, 1218 bp, Oryza sativa
  Predicted polypeptide sequence is orthologous to G861, G1140
gtttctctctctccttgtctctctgtgctgttgttgttgcgggtgaatctgcttggatttcgtcggagttttctgtcgcggaggaggagggggtggtggttgatcggaggggaggggggagggagatggcgagggagaggagggagatacggaggatagagagcgcggcggcgcggcaggtgacgttctcgaagcggcggcgggggctgttcaagaaggcggaggagctggcggtgctgtgcgacgccgacgtcgcgctcgtcgtcttctcctccaccggcaagctctcccagttcgccagctccaatatgaacgagatcattgacaagtatactacacattcaaagaacctggggaaaacagataagcagccttctattgatctgaatttagagcacagcaagtgtagcagtttgaatgaacaactggcagaagcaagtcttcaacttagacagatgagaggtgaggagcttgagggattgagtgtggaagagctgcagcagatggaaaagaacctcgaggcaggactgcagcgggtgctatgtacaaaggaccagcaattcatgcaagaaatcagtgagctccaacgaaagggcattcagctggcagaagagaatatgcgcctcagagaccaaatgcctcaggtgcctactgctggcttggcggttcctgatactgaaaatgttcttactgaagatggacaatcatctgaatctgtgatgactgcattaaattcgggaagctcgcaggataatgatgatggttctgatatatccctgaaactagggttgccttgaaataaaaggaccagctagagagctgagaaatgggatgacgaccaccatgaattatttgtctgtgtgcatgagtggatgaagttggaagttaaatgcatcttaagaagatcaagaagatgtcatgctatgagattaccaacaaggctgcaataatcctatcctatgttaaaaaggagatcgattgacttgtcatcctatgcctgctgatgcaatggtccggttgcttggatctttttttctcaacttgtactagtgtaccatactaccttcgtcgcacttaatttaaatgcgacatgtacgtatgtatcgttcgcttaattcgtgcaagttatgtacgtacctgtatgggaactgtatggaaacttgtgacctcggctgagacttattattggcacaattattaagctagtcattctcatcg

SEQ ID NO: 5819 - DNA, 1045 bp, Oryza sativa
  Predicted polypeptide sequence is orthologous to G861, G1140
atggctggcggcggcggtggcgggggaaggggggagggggaggggagggcggccacggggaagagggagaggatagcaatacggaggatcgacaacctggcggcgaggcaggtgaccttctcgaagcggaggagggggctgttcaagaaggccgaggagctctccatcctctgcgacgccgaggtcgggctcgtcgtcttctccgccaccggcaagctcttccaattcgccagcaccagcatggaacagattattgaccggtacaactcgcattccaagacacttcagagagcagaaccttctcaactcgacttacaaggggaggacagcagtacttgtgccagactaaaggaggagcttgcagaaactagccttaggctgaggcagatgagaggagaggagctgcacaggctgaatgtggaacagctgcaggagctagagaagagcctcgagtccggtctaggctctgttctcaagaccaagagcaagaaaattctggatgagatcgatggactggaacgaaagaggatgcaattgatagaggagaatttaaggctgaaggagcaagtgtccaggatgtcaagaatggaggagatgcagcctgggcctgattcagaaatcgtgtacgaggaagggcagtcgtctgaatctgtcaccaatgcttcttacccgcgacctccacccgacaacgactacagctctgatacatctctcaggctcgggttgtcactcttcagctccaagtgatggctggaaactaaaactgagaggaaacagctggatggcatgcctgcatcgccaaatgatcagtgcatgcactgcaagactgcaacaaataacacagttttagattgccagatgatgatgtgtgtgtgctgagagtcactggctattatcgtacacataataacaatagaacgaacaagttcttctgttcttggatgttacctgaattctactcccatacatgttgtcaatggctctgtaatcgagtgtctgcaattccagctgaaagcaaccgattacagggaaaaaaaaaaaaaaa

SEQ ID NO: 5820 - DNA, 1042 bp, Oryza sativa
  Predicted polypeptide sequence is orthologous to G866, G883
caattttgctttgcttgcttctcgccgcgatcgcgcgccatggcggatccgttcccggcggcggcgcgcggcggcgagcagggtggtggcaccgcggggcagctggtgtcgacgccgtccaggttgaggacggcggtggcgtccatgctcaaccgcaccggccacgcgcgcttccgccgcgccgcccccgtcgtcgtgcaggaggaggaggatgaggcggcggcggcggcgagggatgcggtcgtgcggtgtgacgggctcagcgcgtcggccagctcgtcgttcccgtcgtcggtgacgggggtcaccggcgatgggagcgtgtccaacgcccgcgcggtgctcccggcggcaggcgacggcgacaagccgccaccaatgcagtctgcttcagattatgcttctgatggccgcctcaaacgcagcagcgacgacgacggcgagcgctgccactgctccaagaaaaaacggaaggcgtcgtggagggcgaggcggcgcatccgcgtgccggcgatcagctcacggaacgccgacatcccggcggacgactattcgtggcgcaagtacggccagaagcccatcaaaggctcgccttatccacgcgggtactacaagtgcagcacggtgcgcgggtgcccggcgcggaagcacgtggagcgcgaccccggcgagccggccatgctcatcgtcacctacgacggcgaccaccgccacggggaacccggccatcgacgtcccgatgaggcggcaacgacgacggagcacaggacgactgaccaaactactggaagattgctctagatagtagtgtctatgcatgtagactctataatctatatatagaaacaaactaatctaatcaattgaccgtttgaatattggttaatttcttagtgctctttcatgcacgtagtatttgccaattgccatgtacatcatatctagtttagactattgactgatgtgatatccatgtaattgatctgctacctccctcactctcttgattaagtatatgatggttgatatttccatggttttt

SEQ ID NO: 5821 - DNA, 1248 bp, Oryza sativa
  Predicted polypeptide sequence is orthologous to G866, G883
gacttcttcttcttcttcttccccccatttctcacttactccggcgatcaccgtggttgagcgtcggcggcggaggaggaggcgatgattaccatggatctgatgggtgggtacgggcgggtggacgagcaggtggccatccaggaggcggcggcggcggggctaagggggatggagcatcttattctgcagctgtcccagactgggacgagcgagaggtcgccggcgccggcgcaggagcagcagcaacaggtggactgcagggagatcacggacatgacggtgtccaagttcaagaaggtgatctccatgctgaaccgcaccggccacgcgcggttccggcggggcccggtggtggcgcagtcgtcgggcccggcggcgtccgagccggcgccggtgaggtcgtccccgtcggcggtgtcgaggcccatgacgctcgacttcaccaaggcggcgtccgggtacggcaaggacgccgggttcagcgtctccggcatctccgccgcgagctcgtccttcctctcgtcggtcaccggcgacggcagcgtgtccaacgggcgcggcggcgggtcatcctccctgatgcttcccccgccgccggcgaccagctgcggcaagccaccgctgtcctccgccgccgccgccatgtcagccggcgcaggccacaagcgcaagtgccacgaccacgcgcactccgagaacgtcgccggcggcaagtacggatccaccggcggccgctgccactgctccaagcgccggaagcatcgggtgaagaggacgatccgcgtgccggcgataagctcgaaggtggcggacatccccgccgacgacttctcgtggcggaagtacgggcagaagcccatcaagggctcccccttcccacgaggatactacaagtgtagcacgctgcgcggttgcccggcgaggaagcacgtggagcgcgacccgaccgacccgtccatgctcatcgtcacctacgagggcgagcaccgccactccccctccgccgccggccaggaccacccgccggcgccgcctccgccgctggcgctgccgctcgcctgagatacccccggtgaagaagagtgagaattagcttgtcggtcatcataattaccgttagaaattatttttttcgtttttctctctttttttttcttttttttactgcatcattgtagaactagcgtgtaaaacaattttaggagactttgagactgagcttttactgaagaaaaaataaagcag

SEQ ID NO: 5822 - DNA, 1142 bp, Oryza sativa
  Predicted polypeptide sequence is orthologous to G866, G883
gatcctcccaacccaaaccgagcgcagcgcacggaccgagatctgcgcccggcagcggcggcgaactccggtgaaccaaccatggccgtggacctgatgggctgctacgccccgcgccgcgcagacgaccagctcgccatccaggaggcggccaccgccggcctccgcagcctggagatgctcgtgtcgtccctctcctcctcctctcaggccgccggggctcacaaggcctcgccgcagcagcagccgttcggcgagatcgccgaccaggccgtctccaagttccgcaaggtcatctccatcctcgaccgcaccggccacgcccgcttccgccgcggcccggtcgagtcgtctgctcccgccgcccccgtcgctgctgctccccctcctcctcctccaccaccggcgccggtcgctgccgccctcgcgccgacctcctcgcagccgcagaccctgacgctggacttcacgaagccgaacctgaccatgtcggccgcgacgtccgtgacatccacgtcgttcttctcgtcggtgacggccggcgagggaagcgtttccaagggccggagcctgctctcctccggcaagccgccgctgtctgggcacaagcggaagccctgcgccggcggccactccgaggccaccgccaacggcggccgctgccactgctccaagagaaggaagaaccgggtgaagaggacgatccgagtgccggcaatcagctcgaagatcgccgacatcccgccggacgaatactcgtggaggaagtacggccagaaacccatcaagggctccccttacccacggggctactacaagtgcagcacagtgagaggatgccccgcgcggaagcacgtggagcgcgccaccgacgacccggcgatgctggtcgtgacctacgagggcgagcaccgccacacgccggggcccctcccggcgccacccgccgccgccgccgtcgccgcgatgccggtgtccgtcgccgtgtccaccggcaacggacatgtctaacctaattagctccataatttttttcttcctttttttttagttgcttctcatcaatctaatgatgcgtgtaaagaagaaaagattgtagaaagaggacgagggaaacttgatgctagagaattaccgtctcc

SEQ ID NO: 5823 - DNA, 977 bp, Oryza sativa
  misc_feature (916)..(916): n is a, c, g, or t
  misc_feature (920)..(921): n is a, c, g, or t
  misc_feature (939)..(939): n is a, c, g, or t
  misc_feature (957)..(959): n is a, c, g, or t
  Predicted polypeptide sequence is orthologous to G866, G883
tacggtcggaatcgcgggtcgaccacgcgttcgcgcagccgcagacctgacgctggacttcacgaagccgaacctgaccatgtcggccgcgacgtccgtgacatccacgtcgttcttctcgtcggtgacggccggcgagggaagcgtttccaagggccggagcctgctctcctccggcaagccgccgctgtctgggcacaagcggaagccctgcgccggcggccactccgaggccaccgccaacggcggccgctgccactgctccaagagaaggaagaaccgggtgaagaggacgatccgagtgccggcaatcagctcgaagatcgccgacatcccgccggacgaatactcgtggaggaagtacggccagaaacccatcaagggctccccttacccacggtaaatctcttcctcctgcttgaacacgaaattctcccaagaaattcatcgcggtttgcaacgaacctgacgtgttctgcgattcgatcatcaggggctactacaagtgcagcacagtgagaggatgccccgcgcggaagcacgtggagcgcgccaccgacgacccggcgatgctggtcgtgacctacgagggcgagcaccgccacacgccggggcccctcccggcggtggctacggccagcgccgtgaaggcggctacggcggtggcggtggctacggtggcggccgtggtggcggcggctacggcggcggctacggcagccgcggcggcggcaactccgacgggaactggaggaactgagcggtggggccctcatggccaagttatctatctatctaatcgagctaccatcatcatcatccgatcgttatcatcgttagttttgtgtggaactatctagtttgtgttaactgtgtggttgcccatctgtgtttttgatcgcaagaagaaagctcngtcnntcgtttgctttggatcanaatgaattgaattgaatnnngaatcttagtgtgaaaaa

SEQ ID NO: 5824 - DNA, 1268 bp, Oryza sativa
  Predicted polypeptide sequence is orthologous to G866, G883
caaccaaacgattaagatttgctcggtaaaatggctttctcatttaatattagtacaaccagtagtaggagcagcagtaaaaagtaaaaactcatttacacaaggggctaacgatttttgctaattaattaattaaacaagcggcggcggcggcgagtggcggtggtcgccctcgtaggtgacgacgagggtggcggggtcgtcggcggcgcgctcgacgtgcttccgggcggggcaacccttgacggtgctgcaccggtagtagccgcgcgggtagggggaccccttgatcggcttctgcccgtacttgcgccacgagtactcgtcggcggggatgtccgccacccgcgcgctcgccgccgccacgcgcaccgtgcgccgaacccgctgcttccgcttcttggagcagtggcacccgccgtgcgcgtgcgcgtggcctgcgccgtggccgtggccgtcgccggcggcggcgcagggcgggtgcgggtgcttgcgcttgacgccgccggccagcgggggctccccggaggagaccaggctccgggccctggacacgctgacgactccgccggcgatgaacgacgagacgacgacgtccagtcacaaaacccgcggaactaggcggcatcgcacacccaacgaagccccccagaggccgctaaggatcacctcagtccgtgcggaagaaagcttcacggtcgcatcaccaggcgcctaaaacgagaggcaacgacaaccaacaggacaaccataacgagaaaaagcgaaacactacaaggaaccccacacgtgcgaacacactccccagacgatagctggcgcaggccgacacaacacagccaccaaagacggacgcacacgaaacacacagaaagcacgcaccagccgccgacacgcaccccggccagccagcgcgcaccagagcacgcccagcggcacccgcacagccaccacgccagcaccgacgaccccacacagcgcgagcgcgcggcccacgaaaggaagaccgacaccacagaaaaagcgccgccggacagccaagccgcccaggacaaaagaacggaggagcaaaaagaacagacaataaagaaagcaaagcagaggccgagagcgagagagcgcccgtgaagcgaacgagagcagggaccgagaaaacaacgatcgcagagaaaagcagcacagcgaagaaaagaaaacgacacagcaacaaaaaaggaacaaccgacggaaaagaagcatcagggacgagacggaataaaccaacagag

SEQ ID NO: 5825 - DNA, 1874 bp, Oryza sativa
  Predicted polypeptide sequence is orthologous to G869
ggctcctctcgccgttttggtcggggttttagcgagcgcgtgggaggccggaggcgacgacgacgaccgcgccgccgtcggagaagaaggccgcggaagcaccagtaccagcacccgtatatgtcttctagccccttctccgatctggtggtagtcgtgctcctcgtctgcgccgtcgtcgccgcagccgtcctcctccccctcgtctgcgcccgccgatctatgcaccagaggctccacggctggaacaagtccacgtcgatgctcagggacgggttcggggtcaagtattccgggttcctccacataaggccgtgtggtttctgtcgaggagattgacggattcgatcgattcgtgttcgtctccgtcaaatttttgcacaagagaaaaaaaaagtttcccccttttagagtttttccccttcagttttgtcagttttggtgaggaattttagagttcttttccggcaagagttagaagaagagagaaatggccccttccaagcagcagcagatgctcctcaagaaggtgatggcgaagaagcccaagacgaagaggctatccgggtttggccttaaaccctctgctgctttctccaggccccatgtgccgtcggcggcggcctccctgcagccaagccgtcgcgtccgcgtcgtgttcgaggaccctgacgcgacggactccgactctgacgacgacgaggacgccggcgccgcctcaaagaagcgctactttgagctcttcattggcaagccagcttcgtcgacgaagcaggcctctccggcgtccaccgtcgctgcctacgccaacatcggcaaggttgggagcacctgctaccgtggtgtgcgcctccggaagtggggcaagtgggcggcggagatccgcaaccccttcaccggccatagggagtggcttggcacctttgacactgctgatgcggcctccgccgcctaccagtctgcctcccgcaacttcgccgaagagaagcgccgccgtggtgtggcctcctctgcctcacctgctagttcggcgacccctactccgactgcgtcctcgtcgtcctcgacttctgccgcgccattcgcccacccttcgccgtcgtctgtgctcgaagccaccaagccagctccaaagccagagtcgccgccgctgccggagcaagctgcaactcccctcctggtggaggctgccaacgagaccgccgagctgccggatgacccagagttctacaaggatatactgcgcggtctacagctgccggacattgacccgatggatttccgagctgggctggatgctctggatatctccgatgtgccggcttacatgaatggcgaacaagacgtactcttcactgaggacatgctgcttggagacttcgctgaagaagatgacctcgacctcgacgacatcggtgatgacttctgcgaggatttcccagagatacccagcggctacgacttcggccgtggtgatatgttccggcaggtggatttctgcgtgtgaattaagagcttgctaaagttattcatgttggtgtgatgggcctgtgagtgtgggtgcttgggaggagatttcttgggttttttccccgagcaaaatcaatctgctcgtgcccttgagatttcagttccgcccataagaactccaacgcacatttagcattcggagagtaattttgttaggttaaaagtatggtaagttataggtggtatgttatgtttttctttttcttttctcaatgttatctggtacctaagtttgtcaagaaaatcatagtggacaagtcaagtatttggggctgtcgtctctgttatggaaagaaaaataagttttgattacattacatatcttttgctctcgagatctggcc

SEQ ID NO: 5826 - DNA, 2123 bp, Oryza sativa
  Predicted polypeptide sequence is orthologous to G869
gacacatcacacgtttcgcctccctcctccgctcgtcttcttcattctctctccttcgcttcgcttccaaatcgcccgcaatttctcccccaaaaacctcccctccccccaccaccaccattaataaacccctcctcctcctcctcttcttcctcctccgcctcgccatctcaccgccaccgcctcctcactcactcacttcctgccacgtcattcgcgccatcgatcgcgtcgtcgcctcagctgcctgtaagtgagaggaagaggaggagtagagctcgtcgtctccgccgccgcagctggtgctcgctgttgatttatgtcgcctgctctacccccgtttctccatggttctgagctccagtcgccgccaacggtttcttcctgctcccttctcatcctcctccttcaaaattggtatacgaggggcgcaagaacacagcaaaatcccttcacgatctccagatttggatttggggtgaaatactttggctttcttcgtttagactggtgacaattgaagatagcccccaaattgccttaagatttggtttggcttgagtggatcaagtacagaatccgaacttttgcaacctgacattcttctagttcacaaagtcggccagatttgagatttctctcggacatctctgtacacacaggagctctcttttgctccagttttaaacagaagttggacaaaggctctgtttctggttttttgagtttctgcgataagcttagagagcagacaacaaacttttgtcctgattcatctaaactcttacctgactgcaatcaaggccaattgtaatccaataatctctgatcttgttctggttgcacgttgagatgatggtgccctcttcacggaaagtccgtgttttctgctctgatcctgatgccactgactcctctgatgaagatgaccagaataagaaggaaaggagattttcaagggaaatactaattccaatggaaaactccaaggcatccaaacctgttaagacccttgttcaatgtggcacaaagactgtaaaggattccgagaaggaaccgacgagcaaatacaggggtgtgcgccggcgggcgtggggcaaatgggctgcagaaatacgtgaccctgtgcgaaaatcaaggaaatggattggcacatttaacagtgaggaggaggccgctgcggcatatcttgcacaatcaaaccagttccatgaagagttgatggccttgaaaatccaatcttctgtatcagagcaggaagatttgtcaagctctgttactatatcctgcgtgtcctcatctcagtcatgtgaccagaagattcaggcaaagccacaagaacacaagagagtgtcagtggtggttaaccgtgagaccgttgagcagaagtttaaggcacagccacaagctcagaagattaaggcacagccagaagtgcagaagagagtgtcagtgaagattagccatgagactgaggatgagcacttgctgaacttgccgtccacgcctaaaggcaaagagatttcgatgggcgctgttcttggcaggatagatgagattcctgtgagcaactgtgtgggccatattgatgaatttccacctgatgatttcactaggcttgcagatgcgttcccagttagtgattttatcggcatggcagatgtgccactgggcgatgattacattggccttgcagacatcagccacctgccgctgcctatcacagatctgaagttcgacctcaatgcagaactcaactgggacgggttcgactttgcttcattggaacaagaactcaactgtctttgatggcttgaatcctgttctatgtgaaaacctcttgttgattgaattgagtgcaggaggtagattcaggtatccatctttcacattgctggcaggccgagtgtatgatctggagattttcatctccaattttgccggaaaattgtacagtccccctacggcaaacaaatgagtaccgcagtatttatgtatatgttcaccaatctcaaaaatgttaatgagattgtggtgacagaccgtccttgatctcagtttggttgtgtatttgttggacgccattattatatttgttaattttgatattgttcttgtgatcc

SEQ ID NO: 5827 - DNA, 706 bp, Oryza sativa
  Predicted polypeptide sequence is orthologous to G869
aagcactttcgaagctaaggatacagtacatgcaggtattgagcaattaacatcgtgttccccttacaaggtaaataattttgaggcacatattgttgaagcagactccattgatgaatttaactcattgtttaagtgtcgtatggaggaagtactagtgcaatccatctcaaagtccagtatcagtcaacccttgacagttaaacttgaagatgaattgagtgaaccattatctccagattctgggactgggacacatttcattgacgggagttcagttgaagattcggatccacgatttgcacagctcaatgatgaagcactggtatcttctacttctaacgcaacatgtcgtaatgagtcaattgaagagaaatcaagtgaagcattactggcaggaaacgaagattattcagaactgccaaatgaactgttaaaatcaggagatccacagactgcagatagttctgagattcaagtgcaggttattgatgctacaggtcactgaatgatgagacaagggcctaaaacaaggccaaacagccaatttctcagagagatctgtaaagcatagatagtccagtattagttctctgaaccaggtttcttgcccccctttgttccaacttgctctatggcgtctggatttaacttttcctcttcttaatacaaaatgtgcagcaatcatgctgtttttcttcaaaaa

SEQ ID NO: 5828 - DNA, 693 bp, Oryza sativa
  Predicted polypeptide sequence is orthologous to G872
cgccgcggtcggccggaattccgggtgaccacgcgtcgcacagcacgtacacgtacgtgcaacgtcactgcatgatgtcatcgtcgtcgccggtggcggcgtcaccgccggagatggagaagaagtacaagggtgtgcggcggcggaagtgggggaagtgggtgtcggagatccggctgcccaatagccgcgaccgcatctggctgggctcctacgactcgccggagaaggcggcgcgggcgttcgacgccgccttcgtcacgctccgcggccacggtgccgccggcgccgacctcaacttcccggactcgccaccgtcgtgcgacgcccgcagcagcgacccgcggcaggtgcaggccgccgcgctctcccacgccaaccgcgcccacgtcacgccgcagcaggcggccgcggcgctcatgtcgccgccctcgctgtcgccgccgccggggttcgctaccggcagcgaggtggtggcgcccgccgtgcgcgccgacggcagcatcgactggcgcccggtcatggcgcacccgccgccgctgtactcggcgcccggctggggcggcggacatgcctacgacttcttgcagccgccgccgccgacgccgacgttgccgtcgtggcgacgaccaaatggacgacgtcgtagatgacagcagcgcattgctttgggagtttgacacgcaagatacc

SEQ ID NO: 5829 - DNA, 1015 bp, Oryza sativa
  misc_feature (812)..(812): n is a, c, g, or t
  Predicted polypeptide sequence is orthologous to G878, G884
acacaatcaccaacgtccaccaaacaagcgggcaaaagatggcagctcttcagcagctgatcaaaatgagcaatccaatgataccgtgtctggtctgtcaggtattaagagagatcaggaagctatatatggaatgtctgagcaactatctggtttaagtgaaggagatgatatggatgatggtgaatcaaggccacatgaagcagatgacaaagagagcgacagcaagaaaaggaatatacaaatttcttcacagaggacttcagcggaagctaagattattgtgcaaacaaccagtgaggttgatcttttggatgatggttatagatggcgcaagtatgggcagaaggtggttaaaggaaaccctcatccaaggagttactacaagtgcacctatgctggatgtaatgttaggaaacacattgagagggcttcgtcagaccctaaggctgtcataacaacttatgaaggaaaacataaccatgaaccaccggttggtaggggaaacaaccagaatgcgggaaatgcggccccttcaagcagtgcacaacagaatatgcagaatttgtctagtaatcaagcttcacttacaatggcagacttcaacaacattaaccagaggccaattggtgtcttacagttcaaaagcgaagaataacaccgtcaactgactttcttgtgaccccggttgctgaagtggcacactggtatttggttgatttcttcaggcaaatattggatgccttgcattctaatagtcacactgttccaaacgttcaagaataatacaacaatatcattgtctgcaattnttctaccggtacacagaattactgtaacgacacctaacccttctagcttgtacatgctggtactttgagcataaactcaatataacaacacctatgtggatgtgcaaatagaccgtcgtaaacatatcatgtttactttggaatatggtaataaacaagctccttgctttgtattagaatggatataaaaatgaaatgcccct

SEQ ID NO: 5830 - DNA, 1654 bp, Oryza sativa
  Predicted polypeptide sequence is orthologous to G878, G884
gccgagtccagccccggcgcgctcactctcgccgcctcgctcttccccgacgcgccctccccggccttccaggggtctttcacccagctcctcgtcggcgccatgggctaccccgccgcctccgcccccgctccgccctcaccgttcccggtgccgcacggactcagccccaccgcgttcctcgggggctcccccggcctcttctccccgacggggaactttgaaatgtcccatcaacaagccttggcacaagtaacagcagaagcagtccattctccgtacagtatgattaatcaatcagatttctcactcccgttctcgtcgacaacgacttcagtgttggcatcacaacatgtcaactcttctgccaatgtgtcatcaccacgagaaataccaactctgccatcccacacagataatagcaacattgaatcaactgaggtttcacatggattccaaactactgccctcactgaggataaacctgctgatgatggctacaactggcggaagtatggccacaaggcagttaagggtggggagtatcccaggagctattataaatgttcccatttaagctgtccagttaagaagaaagtggaacgctcatctgacggacagattactccaatactttatagaggccagcataaccaccaacgaccaaccaaaaagagtccaaagatggtggcgctatacttaaatgaagcagatgtttcccgtgagaaggaagatgcatcaattagatcagaacagggctcccaagattattctggaaaattcaaggcatcaaatgatggtggtccttcatcatccaggaggggagataggggtgagcaaatatcgggctcaagtgatagcaagcatcaaggcgaggaagaagtgaaggttgagggtagagctactagtgatggaaatgcgaacaaaagacatgtgccagctccagctcaaagaatcattgtgcaaacaactagtgaggttgatctttcggatgatggctaccgatggcgcaagtatggtcaaaaagtactaaaagggaatcctcacccaaggagttactacaaatgcacgtaccaaggatgtgatgtgaaaaagcatattgagagatcctcacaagacccaaagggtgtgataactacatatgaaggcaagcacagccatgacgtgccagcagccaggaacagtagccattcttccgctaatgccaacgtatcgtcttccagcaatttacctcccaagggacagggggcaacggtcgtcgtgcatagatggttcgcggaatgcatcttcagtttcttccttccagttaaaggagggggggggatggcaggaaatttgggtggggtttagcggggtaaattgttttttttttcagtccatttggggtgtgttgtttcccaagccccgttgggcggggggtctgggctttgtgggtgggttttggcatgggtttagttggggcttgggggttcgttgggtaggggggaatatgttcattttccttttggaattcgacccgtttcatgggaaaataaaatttatgccttccaaacaggcccttggcaaggggaaaccccgcatagcttccttcccaaaaaaaaaaaaaaaaaaaaaaaaaaaaaaaaaaaaaaaaaaaaaaaaaaaaaaaaaaaaa

SEQ ID NO: 5831 - DNA, 1229 bp, Oryza sativa
  Predicted polypeptide sequence is orthologous to G878, G884
ggcagtcaaaaggctccccgctcccccgtccccttccccctctcgccctctcctacccaacttctcgaactctccaaaccctagctttttcctcctccccctcctccgcgaatcttccatgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcgggtcacttttcaatgagccatcaagcagctttggcgagagtgacggctcaggcacaaatacaattgcagtcaccaaccacaccatattcagaagggctgcccagtccatttcctataacacctaaagctgtaatgcccctgcagcgatcaccttcaggaactgaagggagtgttcgcagatcagtgttagagaagtcagcctcatttcagtcaagaccacacaatcatgtgtctgtaaacatggttggtgatggcttcaactggaggaagtatggtcagaagcaagtgaaaagtagtgaaaattccaggagttactatagatgtaccaactctaattgcttggctaaaaagaaggtcgagcattgtcctgatggccgcgtggtggaaatcatttacagaggaacacataatcatgaaccgccacaaaagaccagatttgtgaaagagagagtggctcatattactgcttcctctggagatgatgaaaccttgggacttgtgaacaatgaaattatagaatccccgtcaccgggatgtaaattagagccgggtgctgtctctgaagcttctgaacagcagcttttttgctcaagtgattgtgaaggtgatgctggtaacaaatcagaagatgatcatcctagcacagagcctcagccaaaacgaagcagaataattg

SEQ ID NO: 5832 - DNA, 1498 bp, Oryza sativa
  Predicted polypeptide sequence is orthologous to G878, G884
ctcgatcgcctcgcctcgcgtccccgcgatttctcactcgccatcgccgacgagatcctcgccaccgcgccgcccccacccccctcatggcggccgcgcggcgggtggcgggcggcggcggtggcagcctgtggggcccgcctcagccgccgccgtcgaccggagggggcatcccccagctccccgccgcggccgccgccccagtggagggcctcctcgacgcccccttctcttcctcctccggtggcggtggcggcggctggccgccgccgccgccgccgctctccggcaccgccgtcctcatcgggtacccccagggcaactttgaaactttccctcaacaggacttggtacctttaacagcacaagaggttcattctaagtgcattacattcggtcgagcagagaacctgccttttatccctttggcgacttcagcgctggtctcccaacatactggttcttcttctgtaaatgtgacaccgttgcaagaaattctgacttcgccgtcgcaaataagcaatgtcaacactgaatctattggggtgttacaagggctcccagcttcatccatcgttctggatagacctactgatgatggatacaactggcgaaagtatggtcagaaggcagtgaagggtggggaatatccaaagagctactacaaatgcacccatctgaactgtttggtcaggaaaaatgtggagcactctgcagatggacgaatcgttcagataatttacagaggacaacacactcatgaacggccctcaaaaaggaggtttaaagattgtggtggtatatcagatgatttagacgatttcagtggcaccacgggcacttcagtcagatcacagcctgattacgatgattactgcagaaagcctatcattccaagtggcaccatggttgctcctttagtgaaaaagattgaagatggtgatgaccaattgtctggatcaagtgataaccaggatgagcatgatgatgaggtgaggacttctgatggagcttccggtgatgccagtgcaaatgaaaggaatgtgccagccccaggtcaaaagattatagtgagtacaaccagtgagatcgatcttttggatgatggttataggtggcgaaaatatggacagaaagtggtgaaaggaaatccttacccaaggagttattacaaatgcacctacctaggctgtgatgtaaagaagcaagttgagagatctgttgaggaaccaaatgctgtgataactacatacgaggggaagcatatccatgatgtgcctgctgcaaggaacaaaagccatgtcgtagccaatgcctctctattgcagaacacaaagtcgaatacctactgcacagagcaatcctacacaacgatcacttgctagattctgccatacatccgtctgattgctcatatgtagcatttctgaagctgtgtattttatcggccgtacccactaacgaggcgatttttggcaccattgtgccatgtattttt

SEQ ID NO: 5833 - DNA, 1650 bp, Oryza sativa
  Predicted polypeptide sequence is orthologous to G878, G884
atgcccgacggctatccggcggcgccgcccgggatggagcgccctgccccggaggcggcggctgcggcggcggagccccctggggcgaaggcggaggaggaggaggaggggccgaaggatgtgggggtgaagggtacggggaaggagaaggagacagagaaggttgaggccgagaaggagatggaggggaaggggaaggggaaggagtcgatggaggtggaggaggggaaggagaaggagggtaaggggaaggcgaaggagaaggagaaggagacgaaggtgaaggtgaaggaggagggtggggaagagaaggagaaggggaaggttgaggtggtggaggcaaagcggcggccggctggtgttggcgcggagacacccatcctagcggtgccgatggtggccgtgccatgcttcttggcgtctcctgcatttgcgggtcacttttcaatgagccatcaagcagctttggcgagtgtgacggctcaggcacaaatacaattgcagtcaccaaccacaccatattcagaagggctgcccagtccatttcctataacacctaaagctgtaatgcccctgcagcgatcaccttcaggaactgaagggagtgttcgcagatcagtgttagagaagtcagcctcatttcagtcaagaccacacaatcatgtgtctgtaaacatggttggtgatggcttcaactggaggaagtatggtcagaagcaagtgaaaagtagtgaaaattccaggagttactatagatgtaccaactctaattgcttggctaaaaagaaggtcgagcattgtcctgatggccgcgtggtggaaatcatttacagaggaacacataatcatgaaccgccacaaaagaccagatttgtgaaagagagagtggctcatattactgcttcctctggagatgatgaaaccttgggacttgtgaacaatgaaattatagaatccccgtcaccgggatgtaaattagagccgggtgctgtctctgaagcttctgaacagcagcttttttgctcaagtgattgtgaaggtgatgctggtaacaaatcagaagatgatcatcctagcacagagcctcagccaaaacgaagaataattgaaactagcacacctttgactccagttctcagaactgttagagagcaaaagattattgtacaggctggaaagacgagtgatgggtatagatggcgcaaatatggacagaaaattgttaagggaaatccaaaccctaggagctactaccgttgtactcatgatgggtgccctgtccgtaagcatgttgagaaggcaccagacgatgataacaatattgttgtgacctatgaaggtaagcacaaccatgatcaaccgtttagaaacaacagtgagtcgaaggatgggcctgttcctatgatcattccagcagagacaacatctgagcagcccagcacaatgacctcaacatcagaacagaaacagccgatcagtctgctgaaggatggcggcgatgagcccatgaagggcaagacttcagaaatcggtggtgagaaggcagtggagtctgcgcaaacccttatcagcattaaaactaatcccgatgacatgaagaataccctcttgaaagatacttccgcggtagttcctgtccaaaataattga

SEQ ID NO: 5834 - DNA, 1347 bp, Oryza sativa
  Predicted polypeptide sequence is orthologous to G896
agcagctcatctcaacacgcgcgcacggggcggcatggcggtcgtcagcggcgggaagcgcgcgctcctcgtcggcgtgagctacaagggcgacaccagcagagagctgacgggcgcggccgaagacgtcaagaacatgaacagcctcctcaaaaaattcctcttccccgaggaatccatccacatgctcaccgaggagttgggcgccaaggacccgttgaaggcgccgacgagggagaacattatgaaggagatgcggtggctggtggaggggtgccgcgccggcgactcgctggtgttccacttctccggccacggccggcagaggaaggacgacaacggcgacgaggtggacggccgagacgaggagctctgcccagtggactacaaggtgagcggcaacatcttggacgacgacatcaacgatgccatcgtcaagccgctcacccaaggcgtgaagctgcacgccatcatcgacacctgccacagcggcaccatgctcgacctcccctacctctgccgctttaacagaatgggtctatgttcaagatacaagtgggttggccaaacgcgttggcgactatccccaaagaaagagtgggcgatggtccccgtaggcggccacgccatctccatcagcggctgcaaggactaccagaattctctagagccagacaacaccgccggcggcggcgtcatgacatggagcttcctggaggcagtgggatcgcggaggacgatgacgtatggggagctgctggactcgatgcgggcgaaggtacaccataggttgcagcaaagcagctccggcaagtgcctcgtaacgggctgcctcggctcgctcgccgccaagtgtctcccctgctgcttcctcagcgtgcaggagccgcagctctgttcgtcgaaggagttcaacgtctacgaggagcagtttatcctgtgaccgaccgcattgtcccgggcacaagctccattcagatgaaaacctctgctcctccagctccattctaattgcggatgctggatatcatacacgtaggctcgctttcttaaaataaaatttaaatattattgttcgtagaaaagagtatgatagtgtgatatcaaaatgtggacgaggaaaaaaaccgtgttctaagtatcgtgtattagcgaaggatatatgttgctctgttgctgcggccatggccatgcatgtgtgttcttacaaaaactcaagcgtgtgatcatatttataataaggtagcgcagagcgacggattggaactgaaattgtgtaattgagcgtgtactttgtattgtccaaatctgtttttataatttgtaagtttgttaagcttcggtcac

SEQ ID NO: 5835 - DNA, 1137 bp, Oryza sativa
  Predicted polypeptide sequence is orthologous to G896
atgatgatgctgatcgactgctcgggctgccggacgccgctgcagctgccgcacggggcgccctgcatccgctgcgccatctgcggggccgtcacctacgtcgccgccgccgcgccgccaccggcccacggcgaccccgcccgcggcgccgcggggccgggggcggtggcgccccagcaccaggcgccggggtgggggccgcctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccggtaactacccgatattacctccctattggttgaattctggttcggaagaacaaactgacccttacaagattccaacaaagcacaacataaggatggccatgtattggcttgtacaaggttgccagcctggagactcattggtattccattattctggtcacggagcacaacaaagaaactacagcggagatgaagttgatggaatggatgaaaccctctgcccattggattttgagacacagggaatgattgtggatgatgaaataaatactgctcttgtcagaccacttactcctggagttaaacttcatgcactgatagatgcttgtcacagtgggactgcacttgatttgcctttcctctgcagaatgaacaggagtgggcaatatgtatgggaagatcatcgacctcgatctggtgtctggaagggcactagtggcggcgagtgtatttcatttagtggttgtgacgatgatcagacatctgcagatacttcagctttgtcaaagatcacttcaactggcgctatgacattttgctttatccaagcaattgagcgtgggcagggcaccacctatgggagtatcctgacctccatgcgttcgacaatacgcagtacaggtgattcaatgggcagcggaggtggtgctgtaacatcgctaatcacaatgcttcttacaggaggcagcgttagtagtggcggcttgaagcaggatccacagctaactgcaaacgagccattcgatgtgtatgcgaagcccttttctctatga

SEQ ID NO: 5836 - DNA, 855 bp, Oryza sativa
  misc_feature (231)..(231): n is a, c, g, or t
  Predicted polypeptide sequence is orthologous to G896
tgcgcgttaacgactcaccacgagccgagccgagccaacgaagaaatcgttgccaaccaaatcacccgccgattcgcctccccctcctcgccggcggcggcgaccccgcggcggcggagagatgatgatgctgatcgactgctcgggctgccggacgccgctgcagctgccgcacggggcgccctgcatccgctgcgccatctgcggggccgtcacctacgtcgccgccgnccggcccgcaccgtgcccacggcgaccccgcccgcggcgccgcggggccgggggcggtggcgccccagcaccaggcgccggggtgggggccgctcccccgcccgcgcacgggcggaagcgcgccgtgatctgcgggatctcctacaagttctcgcgccacgagctcaagggttgcatcaacgacgccaagtgcatgcgccacctcctcacgacgcgcttccacttccccgacgactccatcatcatgctcaccgaagaacaaactgacccttacaagattccaacaaagcacaaacataaggatggccctgtattggctttgtaccaggttgccagcctggagactcattggtattccattattctgggtcacgggagccacaaagaaactaccgccgcattagtgcatgcatggtttaacctttgccattggatttgggcccccgaagattgggtaagacaaaaatcggctgggaacaccctaacccggagaacacacccggaagggcgattcatcgttagcgggggtaaacaaagatccggggggaaacggtgcccgaagacctgaccgggcgataggccccccaagcgagtaggaacgcggttgtcctgtgtgataatatt

SEQ ID NO: 5837 - DNA, 784 bp, Oryza sativa
  misc_feature (253)..(253): n is a, c, g, or t
  misc_feature (648)..(648): n is a, c, g, or t
  misc_feature (728)..(728): n is a, c, g, or t
  misc_feature (734)..(734): n is a, c, g, or t
  misc_feature (738)..(738): n is a, c, g, or t
  misc_feature (772)..(772): n is a, c, g, or t
  misc_feature (777)..(777): n is a, c, g, or t
  Predicted polypeptide sequence is orthologous to G898
ttcggccgcttttttttttttttctctttttttttggaaaactagatattttccctttttcagaacccacaggagaaaaatgcacgccattacatacaaatcagatcagatgtagtcaatgagctaagaatcgtgttgtgcacttcttaccacattgttagcctacagggctaacaaacaaagactaaatgtctaactctaactactgctcaagttcttttgcacacaagatgaatgtgcaggagtggactangtgaggttcaggccagcagaaactaattaatcataatcagcaggagtagggaggtaaacacgatggaagctcttgatccctagactcttcctacaagtagggcatttcttctgagccttgaggcatgcctggatgcatttctcgcagaagatatgaccgcaatttgtcgtggatggcttgtccagtttgttcagacacacaggacaggtaaaggttggttcctttggagcaaccttggcatgcgtcgtactggtttgggccacatttttcggcttgctggtcccttcttccctatctggagaaaggcatataacatgtacagcaccctgaaaatttctgccccgggaaaatatagctccagcaacgccataacctcccggaccagtatccttctncagatccactacagccacagagcgcctcataatttttctgctcctccttttatcatctagagcttcaacatcgatggggngagggnccgngtacccctaaaggatcagagcctcatgctggctnccagnggtcacc

SEQ ID NO: 5838 - DNA, 1146 bp, Oryza sativa
  Predicted polypeptide sequence is orthologous to G898
gtttctcttcttctctcttcactcgtgttgaaattgaaataaatcgcggtcaagataaaaaaaaaagaaaaaaaaagaagaaaaaaatcgcggtctcctcctcatcgagccgcgcggctggatcgaggattcgagcaggttgatttcagagttgagtgccactgattcagctccaaagttagcatgagtactgtcagcggcactcggcgtgccccaaggaggcaatcacaagatggtcctggtgataaagtcgttgtgaacctggacgcgatctcctccccagtggttggaagccgtcgcgcggtgccgacctccactggtgcgcgcgcctcccccattgatgtggaagctctggatgatgaagtgcagacattgtccgcttcgcaagtgcctcctccgagaaggaaccggagaactaggaggcagcctgtggcagtagttgatctggaagtagatgctagccgggaagggaacaaacgtcaaagggttgcacctgttatacactgcctctctccagaaaggggagaagggtccagcttgaagactagcaatgagcctcctaaggcaaaggaaccggtttttaactgtccggtgtgttggaacaagttggaggagccctccacaacaatttgcggccatatcttctgcacgacatgcatcaagcaagccatccagattcagaagaaatgccctacttgcagaaagagtctgagggcgaacaatttccaccgtatttaccttccaaactctgatagttaaggctcattggatgtaccaaaggaacttctggcagcagcagcagcatcctccaatctaatatattcagaggaacaggagttctcccataacgtgtaccattttgctgtggaattgtgtcacggcaaaatgaccacctagacccgcatgttcatccaaggctactgttgtttgtatgtagatgcatcaccaggagctcatcagctgcaggtgacaactctggtttaggctaccgaatggcctctctgcctccaaaggatacacaacaaaactaactatagtccccattggttagatttatctagtttgtgtactgttgtatttaccatgcgtttggccatgtaccttaccttctctccatagttgttgacgtagccttgaatcagcttg

SEQ ID NO: 5839 - DNA, 1243 bp, Oryza sativa
  Predicted polypeptide sequence is orthologous to G898
gagtcgtcgacccccgcgtcccccttcctctgctgggttcgcccgcacgcccgcccgcaccgccgcacgccgccggtcgcccctcctccccgccgacgctgagcaccgccggtccccgtcccgctaggcagcggcgccgccgtcctccgaccgagcccctcgccggttcctgctcctattgctcaagccattaggttgcatcgaaacagtatgagctctcatgattttgcaagaagggttccgaagaggcggcggactaacaagttgctttcgcaacttcttccggacctgaactcactcccagctgaaggagctgatgatgggggatcaccttccagtagtgtgctcgtctcacacgcccagacttctgctgtagctgtggctggaacctcgcagtatttggtgccagcagttgttgcggggccgcacattggaatgagtagttgtcccattatcgtggatgatatcaatgatgatgttgtgatttattctgcaagctcgttccctcaagtgaggcagcaggctccaaggacagaacctgttgtgaccatagaagatgattctgaaactacccctggacaagcaggggatgcagttgatgagcatgtggatatactactatctctgactctgggcaggtatcctaggcatggtcatcagagatcctccaacatcagcaccagccctgtgatacatataattgacacacctagcaatgtactcaaacttgaatttcttcaatacacctatcaggtctgtgatgttcagttaaataatgcagcgtttggtggtaatgcaggcactccctgaacccgagaaggccgttccgaaggaaccaactttcaattgccctgtctgcatgaacgagctggtcgaaccgtcatcgaccatctgcggtcacattttttgcaagcagtgtatcaaggcctcaatccaggctcagaagaagtgccctacctgccggaggaagctgaccatgaacaacttccaccgcgtgtatctcccttctgcggagtaagccggtttccaccattctggaaatcagcgtccctcctcccaccctgactctcgccacattggcgttctgatgattgtatctgaaaatgtttgacaggcttgctagcataccgttttgctggagcagttttaacaggtgttgtactgttgttggatccgttaaaagaatacgattgtatgtcctgtggaaatgatccatgctattaaaggtctagattttgtgggg

SEQ ID NO: 5840 - DNA, 1783 bp, Oryza sativa
  Predicted polypeptide sequence is orthologous to G903
actagctacactagctaacccttgctatgcttgcacaaacacctaaagacacacctttcaactttcacctttttaccacttcaaatattttattctcacacatacacacacaaacaatctctctccatcgatctcactctcactagcaaagctctatatttatcctgccttgatggttttgttgttgccactagctagcaaagcttatttatgcttgggggtaatgacccatacctaagaacaaaagttgcccttttgtctccaaagggaactagtcaagcagaagaggagatcgatcagcaactagcatagtttgatcccaagagagatcgatcgattaattagcaacaagccaacgacaagcttagcaatttgataacaatggcgactagtgaagccgcagccatctccaaccctttcgctcctctcaccaaccatcagcaagaacaccctcctcctcctcctcctcccgccaagaagaagcgcaatctccccggcacaccagatccggaggcggaggtgatcgcgctgtcgccgaggacgctgatggcgacgaacaggttcgtgtgcgagatatgcgggaaggggttccagcgagaccagaacctgcagctgcaccggcgagggcacaacctgccgtggaagctgcggcagcggagcgggaaggagccgaggaagcgggtgtacgtgtgcccggagaagagctgcgtccaccacaacccgtcgcgcgcgctcggcgacctcaccgggatcaagaagcacttctgccgcaagcacggcgagaagaagtggaagtgcgacaagtgctccaagcgctatgccgtccagtccgactggaaggcccactccaagacctgcggcacccgcgagtatcgctgcgactgcggcaccctcttctccaggagggacagcttcatcacgcaccgcgcgttctgcgacgcgctggcggaggagacggcgaggctgaacgcggcgtccggggccgccgcggcggcggcggcggccacggccacgtcgctgtgcgggcagagctacctgttcgccgggtcgggtgggccggggatggcgggcatgcggccaaacacgatgatgccgccgcagttcgacgcggcgcagctgagctggctgtacgggaacggcaagctctcgtcgtcgaatgccagcgagctgacgagcgccacggcggcggcgaaggaggcggagagcgtgccgtccgtgttcagcaaccagcagcacgcgaagcccgcggcgcccaccgacatgtccgcgacggctctgctgcagaaggccgcgcagatcggcgccgtgacatccaccgccgcgatgcccctagtgtccccgttcgagccgaccaagcccggcggcgccaccgcctcaccggccgacgagtgcggcaagttcgacggtgcagccctattcgccgccgcgagccatcacaatgccaacctcggcggcgcaatgagcgagctcacgggggccgccggcaacgtgccttacgacgtcttgtcggcggtgcgccaccatgccggcctgaaggacgccggcggcgtcgggagagaggaaactagggatttcttgggcgttggcgtgcaagcactgtgctcgtcgtcgatacatgggtggatttaaaccttaatttgcatgctaattctgtagccatgaagagattagttagtgctaattttgaagctatgtaagcaagtaagctacagtggagtgaagcatgcatgcaagctcacaaaagggctcaagaagagcacccaatttaatttactaaaatttc

SEQ ID NO: 5841 - DNA, 1380 bp, Oryza sativa
  Predicted polypeptide sequence is orthologous to G903
atgtcggtgggtgcagatccggaggcggaggtgatcgcgctgtcgccgaggacgctgatggcgacgaacaggttcgtgtgcgagatatgcgggaaggggttccagcgagaccagaacctgcagctgcaccggcgagggcacaacctgccgtggaagctgcggcagcggagcgggaaggagccgaggaagcgggtgtacgtgtgcccggagaagagctgcgtccaccacaacccgtcgcgcgcgctcggcgacctcaccgggatcaagaagcacttctgccgcaagcacggcgagaagaagtggaagtgcgacaagtgctccaagcgctatgccgtccagtccgactggaaggcccactccaagacctgcggcacccgcgagtatcgctgcgactgcggcaccctcttctccaggagggacagcttcatcacgcaccgcgcgttctgcgacgcgctggcggaggagacggcgaggctgaacgcggcgtccggggccgccgcggcggcggcggcggccacggccacgtcgctgtgcgggcagagctacctgttcgccgggtcgggtgggccggggatggcgggcatgcggccaaacatgatgatgccgccggcggcggcggcggctggagggcagctcagggcgggtcagatgctcggtccggcggcggggggcgtcggtggggacctgtgcgacggcggcgtggcgcggcacggcgggctgtcgctgtggggtggcgaggcgttgccgtccatgggccacattggcgtcctggccagcggtggcgcggcgacagtgccgccgcagctgtacgtggatctcttcgcgccgagctccggcgcgccgccgccgcagttcgacgcggcgcagctgagctggctgtacgggaacggcaagctctcgtcgtcgaatgccagcgagctgacgagcgccacggcggcggcgaaggaggcggagagcgtgccgtccgtgttcagcaaccagcagcacgcgaagcccgcggcgcccaccgacatgtccgcgacggctctgctgcagaaggccgcgcagatcggcgccgtgacatccaccgccgcgatgcccctagtgtccccgttcgagccgaccaagcccggcggcgccaccgcctcaccggccgacgagtgcggcaagttcgacggtgcagccctattcgccgccgcgagccatcacaatgccaacctcggcggcgcaatgagcgagctcacgggggccgccggcaacgtgccttacgacgtcttgtcggcggtgcgccaccatgccggcctgaaggacgccggcggcgtcgggagagaggaaactagggatttcttgggcgttggcgtgcaagcactgtgctcgtcgtcgatacatgggtggatttaa

SEQ ID NO: 5842 - DNA, 1558 bp, Oryza sativa
  Predicted polypeptide sequence is orthologous to G904
aagatgacaatttgacacgaaagccttcctgtgcctttttatggtaattacgtttatacccctgcgatccaccggtacagcaccatgaacgccgtctcctcctcctccgtccccggcggcgacatcctcaccgcctccgcgtcccacagccatggctcctcctggctgtggctatggtggctctggtagctctggctccaccgggagctccaccgcccggagaaggacgatagggatgacgcggaggtggccagccgttccacgtactcccgcagccagccgcgcgtcgcgcccgccgcttcggccaccgcctcgccgggaggcggtggagactgctcggctgctggcttgtcttccttgactgcggcggcgctcctggttgtcatgggcgcggcgcgggagacgacggcctcgacctcctcgtcgatgtggtagtcgaacgtgccgagcgagtaggtggggcgggcgttgccgccggtggccgtcgacgcgctgcggttgctgacgctgcccatctcgacgcggaagctcctggaacggtccctgctcctcggctccggcggcggcggctgctcggcggcgaggatggcggagatcgaggggtgcgggagcgtgacggtggcgcggcagagcgggcaggacggggtggtgcggagccacgcgtcgacgcaggcggcgtggaacgcgtggcggcacgccgggagcagccgcagctcggcgtccagcgtgaacggcgacaggcagacggcgcagtccggtgagctcttggggagcgccgccagcgacgacgccatcgtgaacagcggcagcgactcgatcagccgctgcttctcgtcgcccaccacctccttcttcccctcacaaaccccattacgccgcaccggagaagcgtccgccgcctcgacgttgtgcacctcacggcgcgtccgtgggagcggcggcggcggcggcggcggcggcgacgacctggacagaagtctgagaagtaggtggatcgagaccgacgctagtagaacgaaggcaagaagagcagcgatgatgaggagagacgggaggaaggacgaggcggcgtcggaggatccggtgacgggatcggcagacggcggcgacggagacgagagagtggacgccatggcgaggcttagccttagcttgagaatggtttaacttaacccgcccgggaatgagacctctcgcgccttttatccccgggtttctttggagtgcgcggtggtggtggtgcggatgcagaggccggaagtaaatagtggcgggtttgcactctcctgatggagagatcccagaaatggtggaggtcagccttggaaaccaatccacgtctcggtttctacttttctacctctgcctgccctttgcaacctgaaattctgctactactgctacgtggaaaatttcgcatagcagttgagcagacagcagctcaactgtttgcaattcgatagtttgttgcacaatagtacaatgttgtacactggttagtgaacttaagtacgtgcaaagaatcaaatccgcagtaaaaatactgcattacagcagc

SEQ ID NO: 5843 - DNA, 1562 bp, Oryza sativa
  Predicted polypeptide sequence is orthologous to G904
agctcaccttcctcctcaccgccaagatcgcaagaacgcaacaagagaggaggagattgatgtcgtcttcggctgtgattccgccgccgtcgccggagaggagggtgccgatggtggctgtgccggtggtggccgacgatggaggcggagggcatggggcgaagggggaggagagtgtgagcgggagcgtcgcgggcatttcgccgagcatcctcatcatcgccgtcatcgtcgtggtgatgctcctcgcctccgtctccatccactacttcatccgccacctgtgccgccgctcgtcggcgtcggcggccgcgtcgtcctccgcgccggtgctccccgtcgtggtgcgccccgcgtcgtcggcggccgtgggggagcaggtggtggggaaggcgtcggcggagcgcgcggcggagatggagcggctcatctcgcggctgccgctgttcacgctggcgtcgtcgctggcggcgctccccaagtcgtcgcgcgactgcgccgtgtgccagagcgcgttccgcgacgacgacgagctccgcctcctcccggcgtgccgccacgcgttccactcccgctgcgtcgacccgtggctccgcgccaacccctcctgcccgctctgccgcgcctccatcgcgctcccgcacccgcccctcccggacctcctccgcgtcgagctcggcagcgtcagcagccgccgctccaaccccaactccgccgccgccgtcgccagcgcgccgcccgagggcgccgccgtccgcgcctacccgctccccaccctccccaactccgagtacctcgtcgaggaggagctcgaggtcgtcatcaagcaacccgccgccgccgctgcgccaagaaccggcgagccaagccagcatccgctgccggcggcgcaggcggagcgtgggcagccgtcgtcggtgaccccgacggcgtcgttcagctcggcgaggtcgcaggagcggtggagcaacaggtggagcagcagatggagcagccggtggagcagcgggcggtggagcagccggtacgacgccggcacggtgacggcggccgccacggcggagtggtggtgggacatggacggcggcgcggcgcccgccgcgcggcggcgcgaggtggaggagcagggcaacgcgttccacggcttcatgcgctggctcacaggggcatactagtaatttaccactcgatcaatgcccagttcactcgctcgtcaacctcgccggcgccggcgatcgccggagaattgaattcaactgaatttgaaatgaattatgaatttctgatgcggctcggctctgcttttgggcattcgtgattaggagtaattaatagtgtctccttttctcttttttttggctgtgaattcttgtattatttttttcttgagtgcgtggatttcgagggtggaggatgcatatggtgggaaggtttttgatgccgtacggatttgaaaactgcttcttcctccgaattggagaatgtcggcgggaagattgaggaattcggggactttgaggcaaatgaactgaactgcccaataaaaaaacagaattatttcc

SEQ ID NO: 5844 - DNA, 1296 bp, Oryza sativa
  Predicted polypeptide sequence is orthologous to G904
atatctgtttagagcttttctggtgaggactaatacagtgtggtttgttcactctgttgtttgtttgaaggcaagaaaaagaagccgccatggcagtggggagaaggggatgaaggaatacttagacacgtggcatgatctcaggagccgaggggcctcaagtcggtacagctattgaaccaagagagcaagaaccaccggccgtgaagttcgcagcggggaaatggaattcgaggaggattcggcctccttccatggcggcgagggcgtcaccggcgtactgcgctggcacacgacgacgctatcggattcgcccatcggcgattaagaacccctctcactgggccacgacgtcaccagcctcttctccttgtgccgcgacttccgccggtgcagggttgtgattccgaaccccatctacggcggtgacgccggccttctacatgtgcacaacaacaagaagacgctggccatccgcgagcaggtgtcagtgtcgcctggccgcgaacccggcgtcaagaacaggacatccgtgtgcaagcggcgtcctcggacgtttcatctcccttcgtctgcttctcagaagcagtgggctccatatacatcacattgtatcagattacaaggataggaatgaagaggaatatgagggaatgaacatatcactcttggaggaggcctcagtgcagaaggctgatgcaaaacctgtgtactgcacaaagtttctatctgactgggtttgcagcttaagaaattttaagtggaaagtagtggcagggattcaccaagcattagtaccgaatgaatacagttgggaagaagtaatgggctcaccaattattcaatacgcaggaggctgctcgctctcggcgtgcagtgtatgtatcgaccggcttgcgtttgagagaatccatgggagaggatcctttgcatggagggtagaatcaccccctgcaaaactcagaaaagaatgccttaagaggaatgcctggtcacaggaaagtggtgggaaatctgacagggtgctggatgtaatcattgacaacggagggctaccaacgactgacggaattatcatgttaccttggttgctttgcagcgtcaaatggtagatgtccaaaagcatttcaggggtggctcataatccggctgcaatagatttgatgctgcatgttttcatttaacactgtaaaatgatgaatccttctttgtgatgttgatcagggataagatgcccatactatatatgtttctttgtcatttgagatcaagcattatgttccatttacgtgaact

SEQ ID NO: 5845 - DNA, 1509 bp, Oryza sativa
  Predicted polypeptide sequence is orthologous to G904
atgttattaatcagagaagaacgagacggatacaactcatgtcctacacctccaaaaaccacatctcgacacagagaaatgacactgagaacaatcaaggtcagaaaaagcaaccaaagtcagagacacaaatcacagatgaacaaggaaagtagagagaaaaaactggacatgttcactcaccggaaagtaatctccgacctggtctctagtgatgtgtgtgcttgtgtgtgctctacttctactcgtctcacggctaatcacctggtatttgcgctccgatttcgctcgctctccgtgccaacgccgcgcaccccaaaacccataaataaaggcgcgagaccacacgcagggccgagccttaaacacaccgtctccttcccccccatggcctccctgccgccgcccgcgccgccggccatcggcggcgacccgctcgccgccaccattccgccctcattgccgtcgccggcgccgtcgtcgtcttcgctcaacctctccccgtcgcttctcatcatcaccgcgctcctcgccttcgtcttcttcgcctccgtgtcgatccacttcctcctccgctgcctcgcgcggccgtcgcacccggctccgagcccgctgcccagggcgtcggcggcggcccaacgcgcgacgacggcgtccgccgtcgaggctggggaggctaccgccgcgtcggcggtggggaggagccatgagggggaggcggcggcggggggtggggaggaggtcgacgacgagaaggagcggctgatcgcgtcgctgccgctgttcaccatggcgtcggcgctggcggcgctgcccaagagctcccccgactgcgccgtctgcctctcgccgttcgcgcccgaggccgagctgcggctgctcccggcgtgccgccacgcgttccacgcctcctgcgtcgacgcctggctccgcaccaccccgtcctgcccgctctgccgcgccaccgtctcgctcccgcacccgccactccccaccgccgccgccgccgccgcctccaacgcggcgcaacaggatcccctcgactcgcggagcagcaacaactcgaggagcttccgcgtcgagatcggcagcatcagcaaccgccgctcctccgccgcggccgacgaccggcgcacctactcgctcggctccttcgactaccgcgtggacgaggaggtggaggccgtcgtgtcccgcatcgcgcgccccgcggcggccaagtcaacgaccggttccgtgacgccggcccccggcgaggcgctggcggaggcggcggggtcgcggggatggctgcgcgagtacgtggaccgcctcgcctcctccgcctcgtccctctccggccggtggagcgggcggtggagcgcgcggtggagccagagccaccacagcaaccggcaggaggactcgtggcggtgggacccggaggcggcggtgatgtcggcgccgcgcggggtggacgacgacgagccgggcttcgtcacgctgtaccgttggatcgtaggcgtatag

SEQ ID NO: 5846 - DNA, 777 bp, Oryza sativa
  Predicted polypeptide sequence is orthologous to G905
atgtcctcgccggcggagaagtcgacgagcggcggcggcggcatgagcatgaacacggtgacgacggtgatggccttctccgtcagcgccttcttcgtgctcttcatcttcgtcaggctgctctgcgcccgcatccacctcagggcgggccaatccgccgccgcagccgcggcggcgcacggcgacgccttcccggccttcagcgtggagcgcgggatccgcgggctggagccggcggtggtgacgagcttcccaacggccaagttcggcgacggcggctcgcggcctcgcgcggcggcggcgctggaggaatcgcagtgcccggtgtgcctggaggagtacgaggcgaaggacgtggtgcgcgtgctcccctcctgcggccacgccttccacgtcgcctgcatcgacgcctggctcaggcagcactccacctgccccgtctgccgcgcctccctccgcgccgccgccgccaacgccaagcacccacccccctcccccgccgccatgctgccgccgcccctctactgcccccccgccgccgccaggccctccaccccggcccccgcgcgtgcaaccttccggcagcagcagcagcagctctccgccaccgcgtcctcgtcgtcggacgccgacgcgctccaaccggcggcagccgcagacgaccggctggagatcgtcgtctccgatgagcagcccgcgccgtccgccgccgccggcggacaggcagaagaacatcctcatcctcctcctcctgccgctgccgcgggccatcgatga

SEQ ID NO: 5847 - DNA, 776 bp, Oryza sativa
  misc_feature (17)..(17): n is a, c, g, or t
  misc_feature (776)..(776): n is a, c, g, or t
  Predicted polypeptide sequence is orthologous to G911
tctagagtccactgggnctgaggctggcgacatgtattctttttatttttttttttttttttttgaaagaaacagcactccgctgcgtgcgcggaatatatagttaatggcacataataaatacaaatgtccggtatgtaaacatcgatatggtaatctaacactacgtggagaaataatttacatcgaggatgctaggatccatctctttcggggagtcaaggagcgctcttcctcatttttagagaagtccacaaaaacatggactttcagagaaacattcaacatttccgcatagctatgctcttcatgacaccttgttgctcaaagaagaaacctccccaactgtagatcagctgacttgggccgaagataagcactcgcatcattcagagaaacagtctcaagtttatatccatctgttggacctccaaatagaagccacgcaatctggcccatgacctgacgccattgcttccctgtgtgtgatccacaattagggatcattccaggattcccaaaggtcaagaatacgctgacaggagaccaagggaattggattgacgaattggcccaagacgggacgctgcctaatattgtgaggggaatccgtacgctactttgcagccacaccaatttatataagcaccttacatcaatatattacagcaccatcttctgccaccagtgagttacacacacaactcacttaacacatgatactcgtggcactctacatctatacctaaactctcaatctcttattcctcttctcn

SEQ ID NO: 5848 - DNA, 904 bp, Oryza sativa
  Predicted polypeptide sequence is orthologous to G912, G2107, G2513
actgcttgagacgtcgcacacgtcatggagaagaacaccgccgccagcgggcaattgatgacctcctccgcggaggcgacgccgtcgtcgccgaagcggccggcggggcgaaccaagttccaggagacgaggcacctagtgttccgtggggtgcgatggcgtgggtgcgcggggcggtgggtgtgcaaggtgcgtgtcccgggcagccgcggtgaccgtttctggataggcacgtctgacaccgccgaggagaccgcgcgcacgcacgacgccgccatgctcgccttgtgcggggcctccgccagcctcaacttcgccgactctgcctggctgctccacgtcccgcgcgcccccgtcgtctccggactccggccaccagctgcccgatgtgcaacgcgctgcctgcaaggccatcgccgagttccagcgccgggccgggggagcaccgccactgccactgccacctccggcgatgctgcatcgaccgctcctccgtcggcacccgttctgtcagccaaacaatgcgaattcatctttctttcttcactagattgttggatgttaatgtcaaagcttatcagcagtagcagagcaaaaggatcgttgtgcctgcgaaaaaatcccatttcattttgcatggttacaaattcttacactgctcttttgctcgaatacattatattgcagatgaattcaatgatcgttttaatccacgaattatcaaaatatcaagtctttctgctactaaccatgataacacaccacctttttcaatggaggaggtaggcgcggacgccctcgccatcatcgtcgatgtcgccactgatgacgaggtccgcgccgctcaccagctcgcacgcctcgtcgtcgtccatgctcgccacctcggtccagcagctgaacc

SEQ ID NO: 5849 - DNA, 194 bp, Oryza sativa
  Predicted polypeptide sequence is orthologous to G912, G2107, G2513
gagagagtcatccatggaggtggaggaggcggcgtacaggacggggagggcggaaaacacttatgatgtcggcgggaaggaccaagttcagggagacgaggcacccggtgtaccgcggcgtgcggcggcgcggggggcggccgggcgcggcggggaggtgggtgtgccacgtgcgggtgcccggggcgcgcggc

SEQ ID NO: 5850 - DNA, 1272 bp, Oryza sativa
  Predicted polypeptide sequence is orthologous to G912, G2107, G2513
agaattcaaaccggatcaacctcgctcgcttactcgtgtttaggcatggacgtttctgctgcgctcagcagcgactactcgtcggggacgccgtcgccggtggcggccgacgccgacgacggctcctccgcctacatgacggtgtcgtcggcgccgcccaagcggcgagcggggcggaccaagttcaaggagacgcggcaccccgtgttcaagggcgtgcgccggaggaaccccgggaggtgggtgtgcgaggtgcgcgagccgcacggcaagcagcggatatggctcgggacgttcgagacagcagagatggcggcgcgcgcgcacgacgtcgccgcgctcgcgctccgcggccgcgccgcctgcctcaacttcgccgactcgccgaggcgcctccgcgtcccgcccatcggcgcaagccacgacgacatacggagggcggcggctgaggcggccgaggcattccggccgccaccagatgagagcaatgcggccaccgaggtggcagccgccgcatcgggcgccactaattcgaacgccgaacagttcgcctcccacccgtactacgaggtcatggacgatgggctggacttggggatgcagggctatctcgacatggcgcaagggatgctcattgacccgcctccaatggccggtgatcctgccgtaggtagcggcgaagacgacaacgatggcgaggtccagctatggagctactgatcctgcgcgtttgaactcaacttggtttggcgcgaagagatcgcatgtacagcttaagggagtcgagtacaagtacctcaggtgtactccactcgttgcccctttcccttccctttcgtttttcttgagcttatctgcagggtaatgttatgtattgctgctcttctgatgaaatgtgatcggaagaagcggaaggccagatcgagcttatgggttctgaagacggtgaaggcttgtcgagtgttgtgagcatatattcagaaagtcaggcactgtgaaagtatgaatcagatcagccttgttacgaatgagagtgatcgaccttgttcagtgtttataattgaaccacttgtgtgtaataagcagcaaagccatgttgcttgcttgatctgactcttgggaatggtatatttctcaaagaatgcaggattgactactcagaatttgacattttgcagtgaaatgataggattgttaaattaacattggaggagaggcatgtgtatatatgttaagaaacattagtaatgatgagcctatgatacttcgatc

SEQ ID NO: 5851 - DNA, 840 bp, Oryza sativa
  Predicted polypeptide sequence is orthologous to G912, G2107, G2513
ccctcctctcatcgcaccaccacgccactgagctcaagctaagctaagtgctaacctaggtgttcgaccatggacaccgaggacacgtcgtcggcttcgtcctcgtcggtgtcgccgccgtcgtcgccgggcggcgggcaccaccaccggctgccgccgaagcggcgggcggggcggaagaaattccgggagacgcggcacccggtgtaccgcggcgtgcgcgcgcgggcgggggggagcaggtgggtgtgcgaggtgcgcgagccgcaggcgcaggcgcgcatctggctcggcacctacccgacgccggagatggcggcgcgcgcgcacgacgtcgcggccatcgccctccgcggcgagcgcggcgccgagctcaacttcccggactccccctccacgctcccgcgcgcgcgcacggcgtcgcccgaggacatccgcctcgccgccgcgcaggccgccgagctgtaccgccgcccgccgccgccgctggcattgccggaggatccgcaggaaggcacgagcggcggcggcgccaccgccacctcggggcgtccggctgccgtgttcgtggacgaggacgccatcttcgacatgccggggctgatcgacgacatggcgagggggatgatgctgacgccgccggcgattgggagatctctcgacgactgggccgccatcgacgacgacgatgaccattaccacatggactacaagctatggatggactgacatgtatacacacatatcgttcgagtatatatgcttacagatatagataatactccatcagttcctactaaatacggagtatatatttttagataaaggatttatataaaa

SEQ ID NO: 5852 - DNA, 711 bp, Oryza sativa
  Predicted polypeptide sequence is orthologous to G912, G2107, G2513
atggagaagaacaccaccgccatggggcaattgatgagctcctccgcgacgacggcggcgacggcgacggggccggcgtcgccgaagcggccggcggggcggaccaagttccaggagacgaggcacccggtgttccgcggggtgcggcggcgcgggcgcgcggggcggtgggtgtgcgaggtgcgcgtcccgggcagccgcggcgaccgcctgtgggtcggcacgttcgacaccgccgaggaggccgcgcgcgcgcacgacgccgccatgctcgccctgtgcggggcctccgccagcctcaacttcgccgactccgcctggctgctccacgtcccccgcgcccccgtcgcctccggccatgaccagctgcccgacgtgcagcgcgccgccagcgaggccgtcgccgagttccagcgccggggaagtactgccgccactgccaccgccacctccggcgacgccgcatccaccgctcctccgtcgtcgtcgcccgttctgtcacccaacgacgacaatgcctcgtcggcgtccactcctgcggtggcggcggcgttggaccacggcgacatgttcggtggcatgcgcaccgatctgtacttcgcgagcttggcgcagggtctgctcatcgagccgccgccgccgccgaccaccgctgagggtttctgcgacgacgaaggatgcggcggcgctgaaatggagctgtggagctag

SEQ ID NO: 5853 - DNA, 967 bp, Oryza sativa
  misc_feature (836)..(836): n is a, c, g, or t
  Predicted polypeptide sequence is orthologous to G912, G2107, G2513
gcccacgcgtcgcacactcgagcagagcagagcagagcaaatacagttcaggaatcaggagcaagcagaaacacacacacaaatccgaagatgtgcgggatcaagcaggagatgagcggcgagtcgtcggggtcgccgtgcagctcggcgtcggcggagcggcagcaccagacggtgtggacggcgccgccgaagaggccggcggggcggaccaagttcagggagacgagggacccggtgttccgcggcgtgcggcggaggggcaatgccgggaggtgggtgtgcgaggtgcgggtgcccgggcggcgcggctgcaggctctggctcggcacgttcgacaccgccgagggcgcggcgcgcgcgcacgacgccgccatgctcgccatcaacgccggcggcggcggcggcgggggagcatgctgcctcaacttcgccgactccgcgtggctcctcgccgtgccgcgctcctaccgcaccctcgccgacgtccgccacgccgtcgccgaggccgtcgaggacttcttccggcgccgcctcgccgacgacgcgctgtccgccacgtcgtcgtcctcgacgacgccgtcccacccacgcaccgacgacgacgaggagtccgccgccaccgacggcgacgagtctcctccccggcagcgactggcgtcgaatggacgtcctggtgaatgggtgggcctgtttaggagctggcagggatcctggcccacgcgggctgaaaggtacacttccagtcctgggctacccaaggaccgggtccctgtggccggtagataagaacaaaaaaagagaccgcgtcttctttcttcctcgcctttgtgtgnaaaagaaaaatacagaggtatgcctagtacggcagcagcaacaacagagaacaagagcgcaacaaaaatccgcgagactggaacacaagaacagtacagcagtaagcacgagatagcgcagagcgcagtgt

SEQ ID NO: 5854 - DNA, 961 bp, Oryza sativa
  Predicted polypeptide sequence is orthologous to G912, G2107, G2513
ggtcctgaggtacggccggaattccgggtcaccacgcgtcgctcaagctcgccggcgaagtaaccagagagagtcatccatggaggtggaggaggcggcgtacaggacggtgtggtcggagccgccgaagaggccggcgggaaggaccaagttcagggagacgaggcacccggtgtaccgcggcgtgcggcggcgcggggggcggccgggcgcggcggggaggtgggtgtgcgaggtgcgggtgcccggggcgcgcggctccaggctgtggctcggcacgttcgccaccgccgaggcggcggcgcgcgcgcacgacgccgccgcgctggcgctccgcggcagggccgcctgcctcaacttcgccgactccgcgtggcggatgccgcccgtccccgcgtccgccgcgctcgccggcgcgaggggggtcagggacgccgtcgccgtggccgtcgaggcgttccagcgccagtcggccgcgccgtcgtctccggcggagaccttcgccgacgatggcgacgaagaagaagacaacaaggacgtgttgccggtggcggcggcggaggtgttcgacgcgggggcgttcgagctcgacgacgggttcaggttcggcgggatggacgccgggtcgtactacgcgagcttggggcaggggctgatcgtcgagccggcggggcgccggaggttgttggaggagggagagatgccgggtcgaaaatggggtcggagagtaatattcaaatttggactggaaagtgtggaccatttgggatttcgcaaactggcgggaaagagaaggagtttggggaattaagagagtggcgggaatgggataggtacttgtattggaagggcagatgcccctaggaacgatatagaggagcaggaacggaattctcttcaaggaacgaaaaaaagggggcaaaacgaggaggggacctatgacaaggggtggagagacatc

SEQ ID NO: 5855 - DNA, 1021 bp, Oryza sativa
  Predicted polypeptide sequence is orthologous to G912, G2107, G2513
cgcgtaggtcggcggaatccgggtgaccacgcgtcgccacgcgtcgcacttcttcctcttcttcttcttccagcagcagcaacacacactactgacatggagtactacgagcaggaggagtacgcgacggtgacgtcggcgccgccgaagcggccggcggggaggaccaagttcaggaagacgaggcacccggtgtaccgcggcgtgcggcggcgggggcccgcggggcggtgggtgtgcgaggtcagggagcccaacaagaagtcccgcatctggctcggcaccttcgccaccgccgaggccgccgcgcgcgcccacgacgtcgccgcgctcgccctccgcggccgcggcgcgtgcctcaacttcgccgactcggcccgcctcctccgcgtcgacccggccaccctcgccacccccgacgacatccgccgcgccgccatcgagctcgccgagtcatgcccgcacgacgccgccgccgccgccgcctccagctccgccgccgccgtcgaggcctccgccgccgccgcgcccgccatgatgatgcagtaccaggacgacatggcggcgacgccgtccagctacgactacgcgtactacgggcaacatggacttcgaaccagccggtctactactacgacgggataggcggcggcggcgagtacagagctggagatgacggcgagacgatggttgcgcggggggtacgggggggaagtcccttggactatgatgatggattgggtaaggtttggctacggttgtctcataagtatatgggggaattgggcattccgctattgtaattccgaaagggaggggctaagggcagaccagtaactggaggaggattgcccctccggggaacgcgtattacggagagtttaggccagaagagatagagctacatgtgagaatcgacgagaggagctagagacttgaactacttttgacgagagctacgcatcagttctactatatcgcgcgaattaatcactagcgctcgagatctatgacgagttaa

SEQ ID NO: 5856 - DNA, 737 bp, Oryza sativa
  Predicted polypeptide sequence is orthologous to G912, G2107, G2513
gcgcgcgcacgacgtcgcggcgatggcgctgcgcggccgcgccgcctgcctcaacttcgccgactcgccgcgcaggctccgcgtgccgccgctgggggccgggcacgaggagatacgccgcgccgcggtcgaggccgccgagctgttccgcccggcgcccgggcagcacaatgcggctgccgaggcggcggccgctgtcgctgcgcaggcaaccgcggcgagcgcggagctctttgccgacttcccttgctacccgatggacggactggaattcgaaatgcaggggtacctcgacatggcacagggaatgctcatcgagccgccgccattggcagggcaatcgacgtgggccgaggaggactacgactgcgaggtcaatctatggagctactgatgatcgcccgtgcacctgaaccgaaccagccctgatgagcaggaggactcaatgtacagcttattatggtatataatcaagtacgaaccgtacttatggtgtgccgtttccctgctattctgacgaaaatggaatgcgatcagaaggagcagaggagtgtcctttaggttggtagggggggctccatgctcgtgcgacactggcaatgggggccaaaaattttattggcgccagaaatagcacttgctgcggatgatccctttagtttctgtagtaacaagcctcacctcccaggcttgtctaataagcagctaagtttgctgcatatttgacttgcaaaaaa

SEQ ID NO: 5857 - DNA, 955 bp, Oryza sativa
  Predicted polypeptide sequence is orthologous to G913, G976, G1753, G2514
atgatcacttgcatttcatcttttcatgaacgtttttttgtgcatgttgtttactgcatttttcagtttcagctgtgtagtagcacactctgtttgcttcatcgtttgtgttcgagatggatcgagacgagagcttgggcacgcagccattgaccgggaggcgggtgcgcgcggacacaaggcacccggtgtaccgcggcatccggctccgcagcggcaagtgggtctcggagatccgcgagccgggcaagtccagcaggatctggctcggcacgtacccgacgcccgagatggccgccgcggcgtacgacgccgcggcattggcgctgcgcggcgccgacgccgcgctcaacttccccggcacggccacgtcgcgcccggcgccagcctccggctcccccgacgacatccgcgcagcggccgcggccgccgccgcgatgatcggctccggtcaccgtggcaaccagcgcgccgccgacgcgagcacgtctcgcgcggcgacggcggcgccggaggccgccgtcgccgctggggcgggcgatcagaagcgcgtcgtggacgaggacgacgtcttcgagatgccgcggctgctggtgagcatggccgagggcttgatgatgagcccgccgaggctgagcccctcgacggacggcgtcggcggcgtgtcgccggaggacgacgaggacgaggacggcatgagcctgtggaaccattcctgaaatgggcttacgggtgcatagcatttgcaggaggacaccatgtattttccatgtgttcgtatgaattctgtgcctacgtacagtacgtactcggcacgtatgcgagataggaacagagcagagcaggatactgaattttatcgtagttgtcctgttacgtgtatacggtatatatggtcactccactgatgtataagccatccgtagacgaattatggctgaaaacgatgcccctg

SEQ ID NO: 5858 - DNA, 582 bp, Oryza sativa
  Predicted polypeptide sequence is orthologous to G913, G976, G1753, G2514
atggagcaacgggcggcggcggcggcgcagcagcggcaggggaggaggcagagcgcggcggcgtgcgggatcaggcgggcgagggcggagacgcggcacccggtgtaccgcggcgtgcggttcagggcggggaagtgggtgtcggagatccgggagctccggaagccgagcaggatatggctcggcacgtacgccacccccgagatggccgccgcggcgtacgacgccgccgcactggcgctgcgcgggcgcggcgcggcgctcaacttccccgacgccgcgcggtcgcgccccgccccggcgtccgcgtccgccgacgacgtgcgcgccgcggccaccgccgccgccgccgcgatggcacaccaggaggaggacgacgacagtcggcgtcagctcgaggacgggggcggcggcggcggcgtggtggacgaggacgacgtgctggagatgccgaggctgatggtgagcatggcggaggggctgatgatcagcccaccgccggtgatgctcggcctgcaggcggacggcggtggaataatggacgagggcggcggcgtggtgaggttgtgggatcacagctga

SEQ ID NO: 5859 - DNA, 546 bp, Oryza sativa
  Predicted polypeptide sequence is orthologous to G913, G976, G1753, G2514
accacgcgtcgctggtctcgatctcctcttcccttccctatctatactctctctatctccctcttgttgcataatcatatcgacttcttgcaagctaggttcgattgtgttgagacgcatactagcttaattagcagctggccggcagatattctcttggtacagcagccatagctaggggggagtaggtgcactgtagcttaatttggcggatataggtcatcccaaggtgtatatatgtcgatgggtgtgccctaatggtacatggctgacctgaccgagcatccgtcgccgactgctcctcctcaagtgcaaacagctggcctgccggtggcggcttctccgggtcctgcctcgcctcattcaccgtcggagcaaggggacaagacggcgcccggggcagccacggcgtcgacgatgacgacggcgagctcgggcgagccgtcgccacggtcctcggggaagcacgccttctaccggggcatccggtgcaggagcggcaaatgggtctcggagatccgcgagccgcgcaaagagcgccgcata

SEQ ID NO: 5860 - DNA, 1413 bp, Oryza sativa
  Predicted polypeptide sequence is orthologous to G921
actagctcatgcgcatttcggctctcgccttcttcgccttcttctcctcctcctcctgttcttgattttcagtatattcaattcatggattcgtggattgagcagacttccctgagcttggacctcaacgtcggcctgccgtcgacggcgaggagatcatcggctccggcggcgccgattaaggttctcgtggaggagaacttcttgtccttcaagaaggatcacgaggttgaggcgctggaggcggagctccggcgagcgagcgaggagaacaagaagctgaccgagatgcttcgggcggtggtggccaagtacaccgagctgcagggacaggtcaacgacatgatgtcggcggcggcggcggcggcggtcaacgccgggaaccaccagtcgtcgacgtcggagggcggctcggtgtcgccatcgaggaagcggatccgtagcgtcgacagcctcgacgacgccgcccaccaccgcaagccatcccctccgttcgtcgccgccgccgcagccgcggcctacgcctcccccgaccagatggagtgcacgtcggcggccgccgccgccgccgcgaagcgcgtcgtccgcgaggactgcaagcccaaggtctccaagcgcttcgtccacgccgacccctccgacctcagcctcgtggtgaaggatgggtatcaatggcggaagtacgggcagaaggtgacgaaggacaacccgtgcccgcgagcctacttcaggtgctcgttcgcgccggcgtgcccggtgaagaagaaggtgcagcgcagcgccgacgacaacaccgtcctcgtcgccacgtacgagggcgagcacaaccacgcccagccgccgcaccacgacgccggcagcaagaccgccgccgccgccaagcactcacagcaccagccgccaccgagcgccgccgccgccgtcgaccggcagcagcaagagcaggcggcggcggccgggccgtcgacggaggtggcggcgaggaagaacctggccgagcagatggcggcgacgctgacgagggaccccgggttcaaggcggcgctcgtcacggcgctctccggccggatcctcgagctctcgccgaccaagaactgatccatcgttagaacgccgatgaactttgctcgatttagctgagatcgatcgatcaatttacacggtaaaattttagagttgatcgatttgcatggctttgatcggagttaggctagagagagagaggattaactgtgtatatttagtgattgattttaattagctcgctctacacgtgccaaggtggcagtttaagcaaaacgtacgataattcgttgcaatttgtaattcagctagaagattagtgtattcatggagatctattcagagtctcccagatatatatatagagagagagatagtagcattgatgtt

SEQ ID NO: 5861 - DNA, 1343 bp, Oryza sativa
  Predicted polypeptide sequence is orthologous to G921
gaagtgtttgtacttggctttgctggcctgtttctgttttgattactcgagctccagagcacagcagcagagagacgcgagctgttcgtggtcgtcgtcgtcgtcgatggacgcggcgtggcgcggcggcgttggctgctcgccggtctgcctcgacctctgcgtcgggctgtcgccggtgcgggagccgtcggcggcgaggcacgagctgcttgaccggccggccggctgccgcggcggtggggattccaagtcgatgaccaatgacgaggcgaagatcgtcgaggcgaaggtcactcagatgagcgaggagaatcggcggctgaccgaggtgatcgcccgcctgtacggcggccaaatcccgcggctcggcctcgacggctcggcctcgccgccgcggccggtgtcgccgttatcgggcaagaagaggagcagggagagcatggagacggcgaattcctgcgacgccaacagcaacaggcatcagggcggcgacgccgaccacgccgagagcttcgccgccgacgatggcacctgccggaggatcaaggtcagccgggtgtgcaggcggatcgacccgtcggacacctccctggtggtcaaggacgggtaccaatggcggaagtacgggcagaaggtgacgcgcgacaacccgtcgccgagggcctacttccggtgcgccttcgcgccatcgtgcccggtgaagaagaaggtgcagcggagcgcggaggacagctcgctgctggtggcgacgtacgagggcgagcacaaccacccgcacccgtctccgcgcgccggcgagctcccggcggcggcggggggggccggtggctcgctgccgtgctccatctccatcaactcctccggcccgaccatcacgctcgacctcaccaagaacgggggagccgtgcaggtggtcgaggcggcgcatccgccgccgccgccggacctcaaggaggtgtgccgggaggtcgcgtcgccggagttccggaccgcgctggtggagcagatggccagcgcgctcactagcgaccccaagttcaccggcgcgctcgccgcggcgatcctccagaagctgcccgaattctagcttcctttacaattctccaattcttcttacaggaaaaaacatagaggcgcatttcaatagagattagagcttaatctccccccaaatttgaaaattttatacagggtaagaattccgaatgcttttctgctgcttttaggatgtgaattgtactctctcataataacctgttggtccttgggccgtcggaagaagattgcgggcttctatcgggcctcacgatcctgagcccaattgcgaggctccttgagcc

SEQ ID NO: 5862 - DNA, 1192 bp, Oryza sativa
  Predicted polypeptide sequence is orthologous to G921
gaaagttcacgttttggtccccctcctgttcggcgacgggcgacgtacggcgccactataagaaacgtgccctattgctgtcacgccgtacttcctcccgcccaccgggcagctagcttagctgccgccatggacgacgacggcgacggctcatcgtcaccgaccgacgacagcgccgccgccgggcttttgccgctcttcagccgatcgccggccgaggatcttgaggagaagctgaggcgggcgatggaggagaacgcgcggctgacgcgagcgctcgacgccattctggccggtcaccacgcccaccagcgcgcgctcttggcgccgtcgctgtcgccgccgccgccttccgccacagcaagggcgccgagcgtgtccaccagctgcgcggcgagggaggacgccgcaccggcggtcgccgccgccgccgcgtcgacggcatgtccgtcgagacagcagccgccgaccgcggagccacggcccaaggtcaggacggtccgcgtgcgcgccgacgccgccgacgccaccgacgccaacagcatggcggagaccgtgaaggatgggtaccaatggaggaagtacgggcagaaggtgacgcgtgacaacccctaccctagagcttacttccgctgcgcattcgcgccgtcttgccccgtcaagaagaagctccaaagatgtgcggaggataggtcaatgctagtggcgacctacgagggagaacacaaccatgccctgtccacgcagacaaccgaattcgtcgccagcggctgcactacgagccagcacgccggggggtcgtcgtcgtcgccgctgccgtgctccatctccatcaactcgtcgggccgcacgatcacactcgacctgacgaaccaagcagggtccggatcgatcgcgagctgcggcgtcgaggcggccgccgtctccggcgagctcgtcacggtgctctcgccggagttgaggaggcacctcgtggaggaggtggtgcaagtgctcaagaacgacgccgagttcgtggaggccgtgaccaacgccgtggccgctagagttgtggatcaaatcccacacattcctgttcatttgtagttgtttttttttttctctttgagaacgttgatttgtagtttgtaggcagtatatatatcccaaaatgcttgcaagtatatgtacacatgtattcgcaaatgtgagt

SEQ ID NO: 5863 - DNA, 1078 bp, Oryza sativa
  misc_feature (735)..(735): n is a, c, g, or t
  misc_feature (812)..(812): n is a, c, g, or t
  misc_feature (969)..(973): n is a, c, g, or t
  misc_feature (975)..(975): n is a, c, g, or t
  misc_feature (1014)..(1014): n is a, c, g, or t
  Predicted polypeptide sequence is orthologous to G921
cgggtcggtcggaattccgggtcgaccacgcgtcgcggacgcgtgggttctctccttggctcagcttgacatcgtcggagcagcagaaaagtttgctcgatcgagctagctaactaggtcgtcggatcagtgataaatcgttcgccgatggatccgtggattagcacccagccttcgctgagcctggacctccgcgtcgggctgccggcgacggcggccgtcgccatggttaagcccaaggtgctcgtcgaggaggacttctttcaccagcagcctctcaagaaagacccagaggttgcggcgctggaggcggagctgaagcggatgggcgcggagaaccggcagctgagcgagatgctggcggcggtggcggccaagtacgaggcgctgcagagccagttcagcgacatggtcaccgccagcgccaacaacggcggcggcggcggcaacaaccagtcgtccacctccgagggcggctccgtctcgccgtcgaggaagcgcaagagcgagagcctcgacgactccccgccgccgccgccgccgccgcacccacacgcggcgccgcaccacatgcacgtcatgcccggcgccgccgccgccggctacgccgaccaaaacgagtgcacctccggcgagccctggaagcgcaatcgcgaagagtgcaagcccaagatatccaagctctacgttccacgccgaccaatcgaactcaggctggtggtgaacgatcggttnccttggcggaggtttgtccaaagtgtccaggaaaccctgtcaaaagcctattaaatgccattgtcccgctgctgttnagaatggttaaaccgcgggaacagcctgtgcagtcagggggcaacgacgacccgcgcgtttgcgggaaacatgctgcagcgagccaccctgcgggcgcggtgtctcacaacattaaccgggtgtgttgaacagtcaccgccccttcgtcttttcttnnnnngntgcgctagacactatgtagatacatgtccgtacacatgncgtgagtgctacactagcgacatatacataattacatagtaaggactcatacactgactagtgt

SEQ ID NO: 5864 - DNA, 2052 bp, Oryza sativa
  Predicted polypeptide sequence is orthologous to G922
ctcaccggttttgatttgatctgtgtgatttgagtgagtgagtgagattctttggaggagggattttggtttggtttggtttggtggtttgtgcgggattttgtggggaggagagtaatggcgaccgcagggaaggtgatcaagtgcaaagcggcggtggcatgggaggccgcgaagccgctggtgatcgaggaggtggaggtggcgccgccgcaggccatggaggtgcgcgtcaagatcctcttcacctcgctctgccacaccgacgtctacttctgggaggccaagggacagactcccgtgttccctcggatcttcggccatgaagagtgtggccgcgtcgcgacgccgccgggcgccacgccgtgacggcgtagagcggcctcttgtgccagcagaagaagaagccatggccgccggcgtcgtgcctcacctcgtacggccccgcccacccgcagctctgcagcagcttcctcgcctccatggcgccgctgtagctcagccccacccgctccatgccggccgcctccatccgcgccgcccactgccgcgcccgctcgtgccgctccacccgctccgccccctcgcacgccaccacgccgcggatctcctccccgagcagcacccgctccacgcgcgcgcgctccgccgccgccgccgcgctccgctgcaggcagtcgaacagcgacgcgtagtagttgagcgcctcgtcgaaccgctcctggaacgcgccgccgttgtggttcgcctcctgctccgtcatcaccatgatcttcggggacagcgacctcaccgccgacaggaagctccccagctttggcgtcgacgtcgtcgggtgcgccgccgttgctgctgcgggggagtggggtgacagcgacgacaccacggacgcgtcggggctcagctgcagccgcgtgttcagctcccgctccagcagctcgccgaagcttctcgggctggagcgcgcgatgatctggaccggggtgaggcagccggcggcggcgtgcctcctcccgtcgtcgacggcgaggaggcggtgaagctgcagcacgacgctgacggcgagcgcctcgccggacctgacgccgaggtcgtggcggagcgcgtcgaagtccatctcgtcgagcttcgcctccacggcgttgaactggaacgcgatgtcgaacgcctccgcctccttggacagcaccgcggccatgttcgcgaggaactccttgctgtcgtggacggcggtgatgcggaggtgcggcgggccttcccggcggcctcggaacgcgtggaacagcgcgatccactgcaccgggttcgccgccgggccggagaagtcgacgacgtggacgaacctctccccctccattgcctcaaggatggcatggttggtggtcaggtacgcgagcttcaggaacgggagcacgtcgaacatgtggcggcgcgcgacggggacgaggtgggcgtcggcggagttggccgacgacagcagcgcgcgcgagaggcccaggatgaggttgagcagcttgcgcgcgagcgcgtcggcgaagacggcggcgaggcgctggagcgcgtgcggcgcgtccagggacgcgagctgcgtgatgtgctcgaggcagaggttggcgcggtcgaaggagccggcggacacctcggcggcgcactggtaaagcaggccgatcagccgaacgctctgctggtcatggctcagctcctgcacccacgacccgttcgacggcgacggcgacggcgagtacaccgacgacgccggcgatgacgtcgccgacgacagcatgtcgtcctggaacatgcccctgtccgtgcagcacagcctcaactgctaccagttttcagagccgtgaagcttatcaagcaatggcatcattggcatgtcgccattgttgggtttgagacaaatgttgcaaggtcaggtgttcctgtgcgacgaagttgtcatgggacgacgaagggacaaagaagaagtggatgcttcttcggatagaactaagagatgtcgtctgtatcttggtggaataactaaggagcttggaattattcccttgg

SEQ ID NO: 5865 - DNA, 789 bp, Oryza sativa
  Predicted polypeptide sequence is orthologous to G922
gtacctttcttcctcctccctctctctctttatctctctcttttcttatcctcttcggctatggcaacgacgggtgggacaacgggtactggagcagcgacggcggcgaggggacgagggctagagtagtggcggcggggagcggcgtttgccgattcccctcctcttccttggctccccaaaatcctcctcgcacacaacctccgcatcgcacgccgccggccgccggcgtcgcatcgctcatagattaccggctgcgccagccatggaccatgtcaggaactcggcgttggccgcactcgagggcggggtagcgggtaataaatccgtcgccggagccggcgctgccccagggtcatcctgcaaacgaggggagcacaagcaccaagagaggagcgcgtcctgctcagggaggagacccgcggcgtggtagcgtgtgagggggcgaagctggtggagcggcacgagcgggcgcggcattgggcggcgtggatggaagcggacgacatggagcaggtggggctgagctacagcggcgccatgcatggaggcgaggaagctgctacagagctgcaggtgggcggggccgtacggccatggcttcttattctgctggcacatgaggctgctctacgccgtctccgcgtggcggccggcgccgtcgcgccgccaccacgctcggtcataggtgagccagctagctgctcgatcgattgaggtgcacgcgcatgtgttctctgatcattggagtagagtggagaactgcattaatcaacttgtgttgttttc

SEQ ID NO: 5866 - DNA, 1329 bp, Oryza sativa; identical to SEQ ID NO: 2141
  Predicted polypeptide sequence is orthologous to G922

SEQ ID NO: 5867 - DNA, 700 bp, Oryza sativa
  Predicted polypeptide sequence is orthologous to G922
gatgaacgcttacgtgtggataggatgatcctgagggaagagattaaaacatactggtatgcgagggagtccatcggcacgaacggcacgagaggctggaccagtgggcaatgcacatggaggaatctgggttttcacaatgtgcaacttagcttcagtgccatcagggagggtaaagagaatctgctgagctttggattgaaaaactgccagaacaaagaagacaggggttgcctcctactgtgctggggttatacgaatctctactctatctcggcatggaggcaaaatagaggttcatcctctgggagcagagagcatatgttagttcaacgccaaataatatggccattccagtaggcctctctgtccgtggcaattagagagcagcagactacatccaaatttcccactctgggtgctctgttcagcatatgtctggcagctcaaggtacaagctgataatgtgtgtttgcagcaagatttgactcctgcactaaagatatgctaataagttcacttggtgtaaaaaaaaaaggatggtataggtaggacatagaaatatcttttggtgtgaagtatgtaaagaactgaaaggtctgtgttttttttttctctttgaaaattggaaccaacgaaatgggattggcagagatgcttaattcatcatcgatcttgaatgattacccatcatttcgtg

SEQ ID NO: 5868 - DNA, 1959 bp, Oryza sativa; identical to SEQ ID NO: 2225
  Predicted polypeptide sequence is orthologous to G926, G2632

SEQ ID NO: 5869 - DNA, 2034 bp, Oryza sativa
  Predicted polypeptide sequence is orthologous to G927, G1334
caaaagcagcagtggcagcagccaccactttgcacaaaagaagcaaagtaaatggatggccatcgccgttgaggaagggttggtggccatctagagagagagagagaaactagagagagagaggggtgagcagctgagctctgcatctatatacagcactgcatctctctctatttctctctctatatatatctctatctacagtggattttctctctcctctctctctcttgccgttgctgttcgatactgttgttgtcctctcgtggccattattagatggcctcctgctgctgaaatgtgagtgagagctttgctttgcttgcttgctggctggctggctggctagctgggggttggcttcccctcatcctcgtgcatcatccactgtgctcggctcagctgtctgccctgttcttgctttggtggttggacggttagcatcttcctcctcaagctgagatccttcttgacgccattggaggggtcgctgtcgcctgcgtccttgagcctccctgcttttctttttctctctctctctcctcggcgagggagacgacgacgacggtggcggcggcgatgctgagcttcaagcagagccacgaggggttcggccatgtcgccgccgctggagctggaccgcagcagcagcagcagccgtggtgggcggggtcgcagctgctgtacggggaggcgtcgccggaggaggcggcgctgcgcgacggcggccagttccaggtcgtgcccggaggccgcgccgcgctggatccggcggcgccggagccggagaagacggcggtgccggcgatgcccaagagaggaggaggaggaggggctcctgaggtgctgaaattctcggtgttttcaggtaatttggagccgggagatacaggagagaagaacagagagcactctgccactattgcaatgcaatcgccgttgccagaatacaacggccatttcgagcttggtcttggtcaatccatggtctctcccaattatccttgtattgaccaatgctatggtcttatgaccacctacgcgatgaaatcaatgagtggcgggcgaatgctactgccgctgaacgcgccagccgatgcgccgatctatgtcaacgcgaagcagtacgaaggcatcctccgccgtcgccgtgcccgcgccaaggcccagagggagaacaggctggtcaaaggcaggaagccctacctccacgagtcgcgccaccgccacgccatgcgccgggccagaggctccggcggccgcttcctcaacaccaagaaagaagccaccgccgccggatgcggcggcagcagcaagacgcccctcgcgtccctcgtcagccccgccgacgtagcccatcgtccaggctccggcggccgcgcgtccagcctctccggctccgacgtgtcgtcgccgggaggcgtcatgtacgaccaccaccgccacgacgacgccgacgcggcggaccactacaacagcatcgaccaccacctccgcacgccgttcttcaccccgctcccgatcatcatggacagcggcggcggcggcggcgaccacgcctcacactccgccgccgccgtcgccgcccccttcaggtgggcgacggcggccggcgacggctgctgcgagctcctcaaggcgtgacagccttgaggcggggatctccaggcgtgcccagagctgctgctgatcgatcaccatcagctttggctgcctgtaggcaaatcattcttggctctttacttgcattggggttcttgcaagcaactctcctcgtcacctaccaaaactgtccctgaaacttctctagtgctggggtctcgatcagggatgatgatgtgatggaggagaggcttacccatatgcctgtaaattatggttagtgttctgattaagcaactagtagtacttggtaattactggctatgaattagtagtatggactctggtgtcaggttgctctttgtctgaataaactggagtcgtttgaagctttgcaacagctgtgagtgaaactatgtgcttgcttgcttg

SEQ ID NO: 5870 - DNA, 1640 bp, Oryza sativa
  Predicted polypeptide sequence is orthologous to G927, G1334
ggctgctgctgaaagcctgatgaaattgggtgattaggtgcttaacataatcccaatcctagaaaaatacattcggagtggttgctgctgagctcaaccaatcaagcttgttggggaggcaagcagtcacaatgatgagcttcaacaagagccaagaaggatttgggcaggttgctgctgtggccaccctggcctccaatggaggaggctctctaccatggctgctgtacggcgagccactggggcaggggaagccggccatgtcgccggagggcgtggtgccgagagcacagactcctctggatcctcctcaggttccagccatggacaggggtgtccctgaaattctgaacttctccatggttccaggtaaaggagaaaaatgttctgagcactcaactactattgctctgcagtcaccatttgcagaatataatggctgttttgagctgggccttggtcaatctgtggttccctctaattatccttatgctgaccagcactatggcctactttctccttatggagtgagaccaacgcctagcgggcgaattcttattccaccaaatatgccagctgatgcaccaatttatgtgaatgcaaaacagtgttcagccatcattcgacgtcgccatgctcgtgccaaggcagagagggagaataggctggtcaaagctagaaaaccatatcttcacgaatcacgccatcttcatgcaatgcgtcgtgcaagaggctctggtgggcgcttcctcaacacgaagaaagagaccaatgggaaaaccactggtggaggcaggaaggtgatggacatcatcatcccgcctctgtgccccgccgcatctcccagctcggagcagtgcaacccaagcagcgtttccagcctgtccgggtcagaggtgtcgagcatatatgaacacgaagacatggaccacttccatagctttgatcatctccggacacacttcttcaccccgctcccgagcctcatggatgtcgagcacggggctggtaaccccttcaagtggacagcagcctctgatggctgctgtgacctcctcaaagcatgactagaggggggatacaccgggcagccgaagctggcaaacatcagcagtttctgctggatacattgcccagctccaggtcagggattgtccctgctggtattggctgtctgtaggcaactcattcttggctgatcggttccgctcatcgcctacttgtcccggaaactccagcaccggtttctgggatcctgcggtgatcagaacaacccatcgcgtgtaaaaaaaaaaaaaaatcatctatgctatgctgttactgcttgctaccattatctgaactgctactactaggtagcaagcttaatctggcaaggtaaataaagtctggaactttgaactggttccagtggtgatgattgtggtgtgcttgtatcctgataactattgtgagtttgagacctggctttgttgatctactgaactactactgtagcactatgcttgaagtttgtgtgggcttggtttgcagtttgtattgttaaaaaaaactcaaatctagtgatgtattaagaccttgtttgtgtgtatcttgttaatgtggtatatctgcaagaaggtataatctgtttgggagtg

SEQ ID NO: 5871 - DNA, 1125 bp, Oryza sativa
  Predicted polypeptide sequence is orthologous to G927, G1334
atgggcttcaggcgatcaccggccgtggcggcaatggcggcgccgccgctcacgcattgccatggaggaggagaagaatcattctgccaattaagcaacacaatcatggaggacacccgaatcctgcaaaaccaccaccaccagatcctcgccgccggccggcagctgcagcagcgccaccacttcccggcaatgccgccggagcgacaccaccaccctcctcctccagctcctggaagccctgccatgaagttcccaatcatctcaggtgactctgatcttggcaaagatctgaagttccatgagtcctccgcgccgaccatcgccgcgtactcgccattgcaggagtaccaaggacactttgagctagcccttggccactccatggtttgcaccaacttctgcaactctgaacaaagctatggtgtttactccccctatggagctcaaaccatggctgggaggatgctgctgccgccggcgatcgccaccgacgtgggtccgatctacgtcaacgcgaagcagttcaacggcatcatccggcggcggctggcgcgcgccaaggcggagcgggagcaccgggtttcccggagccggaaggtaagacggcggcgacggcgacggcggcggcgagtgctcgtcgtcgtctccttcccttgtcaattcgccggcgaactggcagtgacagtgactgactcgtcttcttcttcttcttcttcttcttcggcgacggcgcagccgtacctccacgagtcgcgccaccgccacgccatgcgccgcgcgcggggcagcggcggccgcttcctcaacaccaagaacgcctcctccgccgccgccgcggccgccgacgcggcgccggtgagctccggtggcggcgaccacggggcgagcaacaagagctcgtcggcgtcggaggcgacgcgcgtgtacgacgacgacgacgacatgggcgcgggcggcggcggcgacggcggcgacttccaccacgcgatgggtcacctccgctcgccggcgttcttcccgtcgctggccgcgatgatggacggcggcggcggcggcggcgaggggaagtgggcgaccgcgacgcctcaccatggctgccgcgtcgacctcctcaaggtgtga

SEQ ID NO: 5872 - DNA, 456 bp, Oryza sativa
  misc_feature (43)..(43): n is a, c, g, or t
  Predicted polypeptide sequence is orthologous to G927, G1334
cccccatctgcatgctttgaaaagggcaagggggtccgtggtncgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggttgaacaatagttccttggaaataccatgagaataacttgtttacagaacggtttgttcattcccgaattcggtgaggacttgcttggataaaaatgtgtcactgttgttcggtgtgattgctaaccgtatatgataaaaatttcatgcgcttaaaagaagcaagaaagcgtctggagcaattcagcaatatctgtgtgcttagctgacctacgtgagcatacttggtgcacgttatgaactttttactcttcgccttgac

SEQ ID NO: 5873 - DNA, 1412 bp, Oryza sativa
  Predicted polypeptide sequence is orthologous to G928, G931
gatagagcacagtcctctcctcttccccgtgctccccatttctgcttcttttcccacaaatttctctctctatctcagaaaggattcgggagacttgaagagaggagctcgaagcgggacaggagagagaggctaattatagaagtacacgaagaaaaatggtgcctggaccaaagtgagaccatctcataatgctaatgcttttgcgacaaatggaagatcatcgagcccatactacgcccaactatgattttttctctggagattatcagatgaagcagttaggtcataagatgtatgatcaagattccccgtcaagcgattctggacagtcacaccaagaagaatctgccatgaatgatagcagtccaaatgagcgacatacctcaacacaatctgacaatgatgatggtcatcagatgccagatcaggacaaaacaaagtcagtatcatcgttggggaatccaggagctttgcctccaaagctcaactatagccaatcctttgcttgtattccttatacagctgatgcatactatggtggggtcttgactggatattcttcacatgcaattgttcatccccagcaaaatggtacagctaactcccgggtgccgttgcctgttgagcctgcagcagaagagccaatatttgtaaacgcaaagcagtaccatgcaattcttaggaggagacagatacgagctaaattggaggcccaaaataagttggtgaaaggtcggaagccatacctccatgaatctcggcatcgccatgccatgaagcgagctcgtggatctggagggcgcttcctcaacacaaagcagctcgaggagcagaagcagcaacaggaggaggaggccgcatccggtggcgcgagctctggcaataggacatgccttcagaatggcaccggtagcgcgccttcagcttcctctccctctgaaatcgcgagcgtctcaaccagcagagaattccttggtaaccatgagcagagccacttcccctcagctggcttccttcccacaatgagcttcagagcgcagaatggcggagatgggaagctggtcgcgaacgccattcaccagcgcgtttccatgatgaggtgaggtgaagaggggtgaagtgggttcagctcagcaccatcactttggctctctccctgctggtggcaattcatccttggcttatgaaaataccttatgggaaaaaaaaaagtagtttcatcctcaaatggaccaaacatgtgtggctccattttaagttttcctgtaactaaaagcactgcaatgatcaactgactgttggttctgtttgtggatgcttatatctgtacttgctgtatctaatactgaactctaagttgaaaccctgaaactgatggtccccgtgaatattgtagcttgcattttatc

SEQ ID NO: 5874 - DNA, 1631 bp, Oryza sativa
  Predicted polypeptide sequence is orthologous to G928, G931
gagtacaaaggagagagagagagagactctagtgcatatttggcaggaagagccgaagaggggaggtgaggatcagaggaggcagcctcatcgtcatgcttcagcactagtagtagtagtgccaccatttctttgccctcgatctttccccagagagagagagagagagagagagagtcttgattgggggaggagagagggagagagagaaagagagaggacagaaaatgtttgtggatcttgagtaatgccttctaataatgataatgctgttgcaagaaatggagaatcatcctgtccaatgcatggccaagaccaactatgattttcttgccaggaataactatccaatgaaacagttagttcagaggaactctgatggtgactcgtcaccaacaaagtctggggagtctcaccaagaagcatctgcagtaagtgacagcagtctcaacggacaacacacctcaccacaatcagtgtttgtcccctcagatattaacaacaatgatagttgtggggagcgggaccatggcactaagtcggtattgtctttggggaacacagaagctgcctttcctccttcaaagttcgattacaaccagccttttgcatgtgtttcttatccatatggtactgatccatattatggtggagtatcaacaggatacacttcacatgcatttgttcatcctcaaattactggtgctgcaaactctaggatgccattggctgttgatccttctgtagaagagcccatatttgtcaatgcaaagcaatacaatgcgatccttagaagaaggcaaacgcgtgcaaaattggaggcccaaaataaggcggtgaaaggtcggaagccttacctccatgaatctcgacatcatcatgctatgaagcgagcccgtggatcaggtggtcggttccttaccaaaaaggagctgctggaacagcagcagcagcagcagcagcagaagccaccaccggcatcagctcagtctccaacaggtagagccagaacgagcggcggtgccgttgtccttggcaagaacctgtgcccagagaacagcacatcctgctcgccatcgacaccgacaggctccgagatctccagcatctcatttgggggcggcatgctggctcaccaagagcacatcagcttcgcatccgctgatcgccaccccacaatgaaccagaaccaccgtgtccccgtcatgaggtgaaaacctcgggatcgcgggacacgggcggttctggtttaccctcactggcgcactccggtgtgcccgtggcaattcatccttggcttatgaagtatctacctgataatagtctgctgtcagtttatatgcaatgcaacctctgtcagataaactcttatagtttgttttattgtaagctatgactgaacgaactgtcgagcagatggctaatttgtatgttgtgggtacagaaatcctgaagcttttgatgtacctaattgccttttgcttatactcttggtgtatacccattaccaagttgccttaaaaaccctccaattatgtaatcagtcatggttttatagaaccttgccacatgtaatcaatcacctgtttttgtaaattgatctataaacgctataggctgctgtgttatct

SEQ ID NO: 5875 - DNA, 1253 bp, Oryza sativa
  Predicted polypeptide sequence is orthologous to G928, G931
gagagagagaaggagaggggctttgcacttgcagaggagagaagcaaggtgagaagtgaggaggcaagggaggaggtttgccggagaggggacatgctccctcctcatctcacagaaaatggcacagtaatgattcagtttggtcataaaatgcctgactacgagtcatcagctacccaatcaactagtggatctcctcgtgaagtgtctggaatgagcgaaggaagcctcaatgagcagaatgatcaatctggtttggactagacacaccatatgcattttttgtatcagtaaataatattgcaatacagcacctccagggtaaaaggaatattgatggatgcaaagtttgtttgcatctacactactgaagttatgtgacatttcttttcttcttgtactaatgctaggtaatcttgatggttacacgaagagtgatgaaggtaagatgatgtcagctttatctctgggcaaatcagaaactgtgtatgcacattcggaacctgaccgtagccaaccctttggcatatcatatccatatgctgattcgttctatggtggtgctgtagcgacttatggcacacatgctattatgcatccccagattgtgggcgtgatgtcatcctcccgagtcccgctaccaatagaaccagccaccgaagagcctatttatgtaaatgcaaagcaataccatgcgattctccgaaggagacagctccgtgcaaagttagaggctgaaaacaagctggtgaaaaaccgcaagccgtacctccatgaatcccggcatcaacacgcgatgaagagagctcggggaacaggggggagattcctcaacacaaagcagcagcctgaagcttcagatggtggcaccccaaggctcgtctctgcaaacggcgttgtgttctcaaagcacgagcacagcttgtcgtccagtgatctccatcatcgtcgtgcgaaagagggcgcttgagatcctcgccgtttctgtcatggcaaatcatccttggcttatgtgtggtgcccagcaaaaaaaaatctgactgaacctgtgtgtaaactgatgggtatgggtgggttttgtgcaactgtaactagggtgcttgacatctgtgtctgttgttcctctgcctccttagtttggagacggtgcagctgcagctggtaccagtaatctgatcatgctagacttgtgacaaggacaaaactagcaccccgttatgtttcctggcttctgaatttggtggtcattcagc

SEQ ID NO: 5876 - DNA, 1312 bp, Oryza sativa
  Predicted polypeptide sequence is orthologous to G929, G2344
gcttctcatctcatctccctctcctctcctctcgccgtcgccgtcgccgtcgccgccgctcgccgccggcggggatagagttcgccgggatcgcctcgccgggagagttccctcaccatcccgcacctccgctcgcctggcctcttcctcccggaagtgtggtgtgctgcaagctcctgtctctcctacaaggtttcaaaaccaaaatatgcctgaagcacacggaaagctggggtgattaacgtctgtttcttttgactacaatcatcctgattctgcttctgtctgcaaaaacaaccaagccatgacgtctgtagttcatgatgtttcaggcaaccatggagctgatgagcggcaaaaacagcaaaggcaaggtgaacctgaggaccagcaagaagcctcagttactagtacagatagccatacaatggtagcaacaccttcaacagattatgcgacaccctatgcccatcacgatatggcccatgcaatgggccaaattgcttacgcaaatattgatccatattacggaagcctttatgcagcttatggtggacagcctatgatgcatccaccattggtcgggatgcatccagctggactaccactgcctaccgatgcaattgaagagcctgtctatgttaatgcaaaacagtacaatgccatattaaggcgtcgacaatctcgagccaaagctgagtctgaaaagaagcttgtcaagggccgtaagccatatctccatgagtcacggcatcaacatgccctgaaaagggctaggggagctggaggccgatttcttaattcaaaatcggatgacaaggaagagcattctgattccagttccagagataaacaggatggagttgcaccccgtgatagtggccaaccgtctacctctccgtcttcaaagggtgcatcatcagctaaacaaaataagaagtcaaaaaccagtaactaaacgggatttaaacacctggtgtgaaacatggaaacagttttgtacagtacatgctagcgatcgacaaagaatggtgtcattgggtgttgtaggataatgctccatagagaatatatagacagggcaacagattttgcagcctttggttcggtctgctcagtttctttaccttcttgtacaatgagtagttttcgtcagttgtgctttgtcatggggatagctgaatttcttcaggaagtcttgtagttttaaagagttcattagcttgccaattgtttgctttggattggattggtctcttactgcctttgcatcatcatctgcagtgcacagaataaaacattggctatgtgt

SEQ ID NO: 5877 - DNA, 927 bp, Oryza sativa
  Predicted polypeptide sequence is orthologous to G929, G2344
atcttcgagagattcctcccaatcccgagcagaatcccccgccccggcgaatccgcgcggcgctcgagtgaatttgactagctagtagccacgcatgaagccagatggtgaaactcagcttcgtcctacagctgctggacatccagatcctggtttgggcacatcatctgcagaatacgtggcctctctaggaccagctacagctccagtatcttatccatatatcagtacctattatggaggcacttatggtgcttatagtggacaacctctggttaacgctgctttaatggcaatgcctccgcattctgtgcccttggtgaccgatgctgttgtagagcccatatatgtcaatgcaaggcagtatcatggtatattaaggcggcgccaatctcgtgcaaaagctgaatcagaaaataaggccaacaaaatccgcaagccttacctacatgagtcccgccatctgcatgctttgaaaagggcaagggggtccggtggtcgatttctcaactctaaggctgtggaggggaagcaagacactaaatctgtagataaaaaggatggagctgtgccatctgaggagaagagagacaagaagttggcaaatagcattatcaaattggagaactcgagcccaacaacacaaccaggtgcagatgcgtccgatgttgtatgatgcaaatttagccaatccctccctaatccaaccaaattgccagaatcgatcgaattgtgtgcttgctttctgttcgtgacagtttaagtctgtacatagctgttagttttgatgattggataaatccatgatagtatagtgaacatgttgtgggagcagttcagtgctagggtttgttgctgagtgtagattatgaaccttgtgtcactgttgtgttttgcttctgttaatgaatggtagcttacaatggg

SEQ ID NO: 5878 - DNA, 450 bp, Oryza sativa
  Predicted polypeptide sequence is orthologous to G932
ccgttgttgtcctcgtcgtggtcgtctgcgagccgcaccgcctctgcccagatctggcgaggagggtcaccggtgttgtctatggcgatggaggagggtcgaaggacagctccgggctaccgatggaggatgcgtcgggcctcgagctccgccgccatcggccccgagcttcatcgctggtgctgccgacgcccgacacccatctcgtctctccatcaggagaggggaagaagagagatggaaagggaggggcaaaagtgacatttaacagtagggattagacggaggttgacagaaaattagacggcagtggcatggttccaattttcctaaattttagtagcacgtagccgatatcgtaaatagtagtggcatgtattatattattaaaacagccttgaaaggagacaccacgttcgctgtggaggctagaaattcccaaattaatcg

SEQ ID NO: 5879 - DNA, 560 bp, Oryza sativa
  Predicted polypeptide sequence is orthologous to G938
ctcacccttcctcttctctctctcttctctagctctgggcaggccggcgcccgggcgaggccgggggaggagatccagcggccggcgacgtggcggcggtggcggcggcggcggacaccacgctgggtttgctgctctcggcgctgatgcagcactacgacccgtcgtagcgccacttcctactggagaaggacgtgccgtcgccgtggtggccggagcggacagaggcgtggaggagtcatcggcggcctggatgcgttgacggtggagcacccgtgcgtagcgacgtagtaggtccggagcacgtcctggcggacgcggagcttgccaaggtagtcgaggacggagaccatgttcgctgtagtttgagcactggatttgtgatttcttttctttttttttttttgccttttcatgatttgctcgatgtagatgggcatggagctctgatttgctcgctgcagtttgagcaggatctctgattttctaatttgatttttcatttgctcgcatgttgatattgaaggatttagcctaaaaaattaaaaaaaaaaaaaaaa

SEQ ID NO: 5880 - DNA, 2435 bp, Oryza sativa
  Predicted polypeptide sequence is orthologous to G938
gatattctcatctgattactccgcggcggcggcggcggcgggagcggcatctcctacgagattcctctcttgatggtatcgttgaacaagccaactaagcacaaggagttgtctcgggtgatgagataatttggttaaggaaggtaggaaacagtaaattcaatgggcaatccttctattctcacggaggatttaggcgatacgtctgactttgaggttgatggcgtcgagaacctcacggagaatgatgtcagtgatgaggagattgatgccgaggagctggcccgacggatgtggaaagacaagatcaagctgaagaggatcaaggagaggcagcagaagcttgctctgcagcaggcagcactagaggagtccaaaacaaagaagatgtctgagcaggctctccgcaagaagacggcgagagtccaggatgggatcttgaggtacatgctcaagctgatggaggtgtgcaatgctcgtgggtttgtttatgggatcattcctcataaagggaagcctgtcagtggtgcatcggataacattagagcttggtggaaggagaaggttcggttcgatgtgaatgggccggttgccattgcaaagtatgaggttaagaactcaatgctggttgatgctaagcgcagaggggtcttgaaccagcatagcttgatggatctccaggatgctaccctgggatcattgctctcatcgttgatgcagcattgcagcccgcagcagcgcaagtacccactggataagggtgtccctcccccatggtggccatcaggaaatgaggattggtggatttctttaggccttccaatgggaatatcaccaccatacagaaaaccgcatgatcttaagaaggtttggaaggttggcgtgctgacgggtgtgatcaaacacatggccccaaactttgataagatcaggaattgtgtaaggaaatcgaagtgcttgcaagacaaaatgactgctaaagagagcttgatttggctgggagttcttcgaagagaggaaatatattttcgcagttctgacaatgttggatcacagattacacaccgtagttctcgtgagggaaaaagtgatgatatatatagcagcagtgatgagtatgatgtcgaccatttggaggaacctcctcgctcttcatcatccaaagataatgtggggcgtcgtcagccaactgcgcagatcagagaggagcatacctctagtcgacacaacagaggacgccatgatcagcaacccaatcaagtacttcctagcaatgaagggaccaatgaatcaaggaagagaaagagacctagtggtcatttacttactgctgaatctgaggttgaggtaacacaaaaagatgacaatcaactagccattgtgagcaatgcattgcccaatatgagcagaataaaccaaacggagatgatgggcatggctaaccagatgacaagcctcagccatgtcaatacaactgaaactctacagcatcaatatgttcaagggaacttcgtatcttctcctgctgctgtggttaataactataacagcaaccagattacaaatgttaatccttcaaggatttatatgggatatcagcctttagcatgccaaaataatggtcacacaaatccatggtctgaagacacttttcaggttgatgttggtccaccacctattggttttactactaattcttcgtcaggtggtaatcattcttttcccatgaaacaatcactaccaaaatctatagatgatcatgtgcctattacggagacaggggtgttggctgatagcagttcatatggttatcatatcacagccacaggtagtaggaattcaacctctgttgctggccatggaaatcagctcatgggagatcctttcgacagtggtactgctgataagttcaatgggaattcgtttgatggattgccttttgacttcattggtagtagtccaatccctgacatcggtgtattgctagatgatgatgatataatgccatatctgggaacataacctaggcaactcttttgcaattgtaagaactgcgacatccagaaatgtaaatggtggcagaagttcctgtatcgttcattagctaatcgctgagaacttgagaagggcgcgctcatcatggcatgctggtgttccgcttaacctgctgcaaccagtgaaggatgcgtcgtgccaatgatctgtaatttgtacctatcgcttttaattagcctgttctggattatttagcctggctgtaaaaaagctcatagaaactcgcttagctggagaatttcctgcaatgctggatggttgtatacatttttacctgtgctaccatgttaattttgctcagttactcatagataaatcttgatgtatatgagacatgttcattgcagctagctcagacataataatacctgaattcttgc

SEQ ID NO: 5881 - DNA, 2991 bp, Oryza sativa
  Predicted polypeptide sequence is orthologous to G938
ggcctttgcttgcttgctgctatccccttctctttctgttgtgggcttgctgttctccatgtcctcctgttgatggttgcttgtgttcgagtttttttctttttttttctttttttttcttggagaggatgtggttgtgttcatgataggttggtggtctgtgatctgtttgggtagatcttttgtcctctttttcagatatttcgtggatgctagagctgcctgcggtagccaattcctgtttggctacttcttcgttgccctttattcccttccaattttattccgtgattttctgttcttgtgcgtagaattgtttctgccaagcttgagtaaatccatggcagaggtcaaagcttagcttttttcagattatacgatttgctgccagccaaaggagaaagggaaaaaaacttagaaattttctactagttttctcttgttgtgttcattagatctcagagattaacctaatttaaggaatacatgttgtaaatcctgctctgggaatgttaagtggttgggtgtaaggaagcatcttgttttgcatcgagtttatggccaaaaacaatcattgatgcttcctctaaggcggtgtatgttttcctctgttctccatttgatgtgttcttgatccattttcgtctcttgttttcttctgttcttttagatggcctccgattccttttgataagcacatgggtacatgttcttgtttccaacagtccatgccggtcgtggtagaccgaaaaaataatccataaaaatatatcctttttctgaaatgtttttcccgtgcttttctattcctttttcatctcccactttgatctgatcaaggcttgttgtttcatgtgtttcaaaatacttcacggaaaggataagaaaaggagaaatttcacatgtttaagtttcttttgatccctacttgtttcaaagcagcatgaaaataccgtttcagctaatcccgtgcatcgcaaaatgttttcatgcttcggctttgactaattcttccgttagtactttatttatgatcatgtctgaatcatgatacctttatgctgtgtagtatgattatgtcacaacaaaagataaccatgtcctatatgactgttaattgcgtgctcttaactctgtgagaggattgcaggagatatgtctgatcagataaagatctctctgtttcaccaaacacatgcaaaattaggctctggcccttgcttcaataggcaaacctaattttactcgcgcgataatctcctggtctcctggctttctagatcttagaatgttttctgaagggaaacaaaccagtactgcctctttatttttggtaatggcgtaattgccgcattaggatgctgcggtaaccgtagtcgtgttgcgcatgtattctcagttaaggaggtagtagtaacacttattgcgtttagacgaagtaatcagttgcttaaacttggttttgatttctgtaattaacatcagcttcttctcttgcttgtgtgcaggtgaattactacttgagtagaagtggtacaagaagagtcgtcgtctacctgtgggcgaattatttcgaggttgtgcgttgcgatgatgggaggtggtctggtgatggaccagggcatgatgttccccggcgtgcacaacttcgtggatctcctgcagcagaacggcggcgacaagaacctcggcttcggcgcgctcgtgccgcagacgtcgtcgggggagcagtgcgtgatgggggagggcgacctcgtggacccgccgccggagagcttcccggacgccggtgaggacgacagcgacgacgacgtggaggacatcgaggagctggagcgccgcatgtggcgcgaccgcatgaagctgaagcggctcaaggagctgcagctgagccggggcaaggaccccgcgggcggcgtcgtgggcgacccgtccaagccgcggcagtcgcaggagcaggcgcggcggaagaagatgtcgcgcgcgcaggacggcatcctcaagtacatgctcaagatgatggaggtgtgccgcgcgcaggggttcgtgtacgggatcatcccggagaagggcaagccggtgagcggcgcctccgacaacctccgcggctggtggaaggagaaggtccgcttcgaccgcaacggccccgccgccatcgccaagtaccaggccgacaacgccgtcccgggcttcgagagcgagctcgcctccggcaccgggagcccgcactcgctgcaggagctgcaggacaccaccctcgggtcgctgctctcggcgctcatgcagcactgcgaccctccgcagcggcggtacccgctcgagaagggcgtccctccgccgtggtggcccaccggcgacgaggagtggtggccggagctcggcatccccaaggaccagggcccgcctccgtacaagaagccccatgacctcaagaaggcctggaaggtcagcgtgctcaccgctgtcatcaagcacatgtcgccggacatcgagaagatccgccggctggtccggcagtccaagtgcctccaggacaagatgaccgccaaggagatctccacctggctggccgtcgtcaagcaggaagaggagctgtacctgaagctgaaccccggtgcccgccctccggcacctaccggcggcatcaccagcgccatatcgttcaacgccagctcaagtgagtacgacgtcgacgtcgtcgacgactgcaagggcgacgaggccggcaaccagaaggctgttgttgtcgccgacccgaccgcgttcaacctcggcgcggctatgctgaacgacaagttcctcatgccggcgtccatgaaggaggaggccaccgatgtcgagttcatccagaagaggagcgcgtctggcgcggagcctgagctgatgctgaacaaccgtgtctacacctgccacaatgtccagtgcccgcatagcgactatggatacgggttccttgaccggaacgcgcgcaacagccaccaatacacttgc

SEQ ID NO: 5882 - DNA, 3156 bp, Oryza sativa
  Predicted polypeptide sequence is orthologous to G938
gtgggaagagaagcgaatcttttccacctccactgggcaaaaaaaattaaaaaaataaataaaattccccattcccccgaacagattgattcgcttcgattcgagggaggaggggagcacagcgatttcttctctctctttcgccgtcgcattcgcctcgcgccgcgccgcgcacaatcccatccgctgctgcccaaggcttgtttcgcggattcggattggtgctgactcgctcccgattggcaccgggaggtatgaattctcgctaggatttcggtgggcggattgctgacgaggagagggttgggggggagtggagttggatgtgatcgggttgtgggaaatccctagtttgtggtgtagtgatggatcatctggctatcattgcgacggagttgggggattcgtcggacttcgaggtggagggcatccagaatctgacggagaatgatgtcagcgacgaggagattgaggccgaggatctggcccggcggatgtggaaagacaggatcaagctgaggaggatcaaggagaggcaggacaggctcgcccttgcgctgcagcaggctgagctggacaagtccaaggggaagccgatatccgatcaggccatgcgcaagaagatgtcgagggcgcaggacgggatcctcaagtacatgctcaagctgatggaggtgtgcaacgcgcgcgggttcgtttacgggatcatccctgataaagggaagcccgtgagcggcgcttccgacaatattagagcttggtggaaggagaaggtgaagtttgataagaacgggccggcggcaatcgcaaagtatgagtcggagaacttggcgtcggctgatgctccgagcagcgggatcaagagccagcacagcttgatggatctccaagacgccactctcggttcactgctttcgtcattgatgcagcactgtgatccaccgcagcgcaagtacccattggagaggggcactccacccccgtggtggccttcagggaacgaggattggtggattgcgttgggccttccgagggggcaaattcctccgtataaaaagccacatgatcttaagaaggtctggaaggttggggtgcttacaggtgtgatcaagcacatgtccccaaacttcgataagatcagaaaccatgttaggaaatcaaaatgcttgcaggataagatgactgcaaaagagagcctgatttggttgggtgttctacagagagaggaaaggcttgttctcagcattgacaatggcatgtcagaggttactcaccacggtgctctggagtacagaaatggggacacacacagcagcagtaatgagtatgatgttgatggttttgaggaggctcccctttcaacatcatctggagatgatgaacaagatctttctccggctgcacagttgagcgaggagcatgccccaacaaggagagaaagagctaaagtcaaacgccctaatcaggttgttcctaagaaggcaggaacaaaagaaccaccaaagagaaaaagaccacgccacagtgtcaccgtaattgagcaggaggtacaaagagctgatgacgcatcagaacattcaaggaatatgattccagatatgaaccgactggaccaggtagaaatccaaggcatggctaaccagattacaagcttcaatgaggaagctaatacgagtgaagctttgcaacacagaggaaatactcaagaactggcccatcttcctgccgattttaatcactatggcaatgcgcaggcaacaattgctactcctgtaagcatatgcatgagaggccaggctgtaccttatgaaagcagtgacaattccaggccaaaaactggaaatatcttcccacaggattctgattcaggctttaacaatatgcctagtagttaccagaccatacctcctaagcaaccacttccactatctatcatggagcatcatgtggttcccttgggtatcagaacaccagctgacaacagtccttatagtgatcaaataattggtagtgggaattctacttctgttcctggagatatgcagctcattgattaccctttctatggcgaacaagataagtttgctggcagttcctttgcgggattacctttagactatatcagtatcagtagcccaatcccagatattgatgatttgctgctgcatgatgatgatctaatggaatacttgggaacataacataggttaggctccaatgcctccttgcatttgtttctgtcgcccattttgtcagtaggattaccatcgtaacttgagtatggaaggctatacttcttattttgccatcaaatatcaatcttgttagttgataccgtttctagcatggcaaattatacctgacttgcattctttggaaatgatatatcaaatgatgaccgaattgtaaatgggaaaggtgtatatgatttaagtttgaaatatggccttttctgaagaaagatatctagtgaagaatgaacatagtttttgtaatttttttagcctgcgagaaatgaaagttttggtctcctgctttctctcactctctccccttatgcattctacagaaacattgagaattcacctcaacattttatatgcgactaataaatgaaaaatcatcagttgataggaacctcctgtatccgatctgtccatatgttcaattacaatgaagtagagaactgttgtagcagatcaaaagctctttgccagtgccattttctaatagttacaaaagtgaagcaattctataagtgcatataaaattttaggatactctaatgtaatggcactatctaccaggtggcaatgggggctgctactaaatcacaccaacactatcctcctctgtccccttgtgctacttggcaattggcatagttatttttggagatagctgagagaaaagaacccttgatgcaacgatacatcatacatggcaatatggcatagttacttttggtggtctcatgcagctgtgaagttagatcgatgtaattgaacatcagtacccaggcttgatgtgatgatagacaagtctttgtgcattccctaaaagaaaataacccttaaatctgtatgatactatgatagcttgtcctgctggacattttgtatgactggtacattttccaatttgtagaatctgttt

SEQ ID NO: 5883 - DNA, 2103 bp, Oryza sativa
  Predicted polypeptide sequence is orthologous to G938
ctagctgagtgccaagcttatggaaagagtggtagagtaatcagaaggagatagataagggcatagagagagtcagagagaggtggatctatagatagctactgctctgctgctgctattaagtcagtctgtgctacgatcgaggagatgatgggagcagcggtgaccatggtggatcggcgcatggcgttcgcggcggaggccgacgttgatagcaaggccgcctttggattcttcggaggcgagtgcttcgtcggcgagggcgacctggtcaacccggcgccgccgccgccgcagcagcagcaggtgcacgagggcggattcgccgccgaggacgagagcgacggcgacgacgacgacgacgacgacgacgacgtggacgacatcgaggagctggagcgccgcatgtggcgcgaccgcgtccggcacaagcggctcaaggagcttcagcagagccgcgccgggagggagagccgggcgggcgacgccggcggcggaggcaggcagcagcggcagtcgcaggagcaggcgcggcggaagaagatgtcgcgggcgcaggacgggatcctcaagtacatgctcaagatgatggaggtgtgcaacgcgcaggggttcgtgtacggcatcatcccggagaaggggaagccggtgagcggcgcctccgacaacctccgctcatggtggaaggagaaggtccgcttcgaccgcaatggcccggccgccatcgccaagtaccaggccgacaacgccgtgccggggtgcgacggcgacgccggcggcgccgcgccggcggggccgcactccctgcacgagctgcaggacaccacgctgggatcgctgctctcggcgctcatgcagcactgcgacccgccgcagcgccgcttcccgctggagaagggcgtgccgccgccgtggtggccggaggggagcgaggcgtggtggcccgaggccggcgtgcccaaggagctcggcccgccgccgtacaagaagccgcacgacctcaagaaggcgtggaaggtcgccgtgctcaccgccgtcatcaagcacatgtcccccgacgtcgacaaggtccgccgcctcgtgcgtcagtccaagtgcctccaggacaagatgaccgccaaggagatcgtcacctggctcgccgtcctcaagcaggaggaggacctctatctcaagctccatcccggcgccctccccccgccgctctccgccgcgtccttcaacgccagcgtctccggcgagtacgacgtcgaaggagtcgacggcgacgaggccgggaacaacaacctgcagaaggcgcagaacgacgcgaccgcgttcatggacctcaccaccaccatggatgctgctctgagcaacaacaagttcctgatcatgccgctgatgaaggaagaggccatcgacgtcgacttcatccagaagaggagcgagccggagctgatgctgagcagcgacagccatgcccgcgtctacacctgcggcaacgtgcagtgcccgcacagcaactacgcgctcggcttcctcgaccgcaacgaacgcaacgcccatcagtacgcctgcaagcacaacgccgccgccgccgccgccgagagcaagccgccgccgccgcacatcttcgagccactcggcagcttcgacttcgacctccccgtcgacggccagagatgcctcgccgggctgatgaccatgtacgacaacgacgtcgccgccgccacgcagatgcaccaccaccaccatcagcagcagcaggctaatttcttcatccgcgacgacgcgccgttcggaggcgacgtcgccgccacggcggcggcggcgccggagttcaggttcagttcaaatttcaacgtgacaggagggggcgccgtggactacggcggcgccatgcagcagccgccggcgaagtacgccggatccaactggttctactgaaacgaattcgaatcgaatgggaaccaaaagaatcaccacccctagttcgattcgatcagtagcttgtagctgtaggggattagaggagctcataagcctgattaattttcagtgtgcttgtaagaattattggttaataatttttcagtgtagatccatgctatgcaagcttgc

SEQ ID NO: 5884 - DNA, 1299 bp, Oryza sativa
  Predicted polypeptide sequence is orthologous to G938
atggcgttgtcgagcttgcaagattctgccttgggcggtggcggtggcactagcgccgctcgcgactgctccgccgacctctcgcgcaacggccaggcgtgtggccccgtcgccggcaacttcaagggctcctacctcgccatgctcagctcggggggactcgtcttcggcatcatcaacatcgtcggcaacttcggaacggtcttcgtcgacaacgagcaagacgggatcctcaagtacatgctcaagatgatggaggtgtgcaacgcgcaggggttcgtgtacggcatcatcccggagaagggcaagccggtgagcagcgcctccgacaacctccgctcctggtggaaggagaaggtccgcttcgaccgcaacggcccggccgccatcgtcaagtaccaggctgacaatttgttggcgacaatgccgtgccgggggccgcacttcctgcacgagctgcaggacaccacgctgggttcgttgctctcggcgctcatgcagcactgcgacccgccgcagcgccgctttctgcttgagaagggcgtgccgccgccgtggtggccggaggggacaggcgtggtggcccgaatccgtcgtgccctcaccatcgcggcccccgcccccgtttccaccgtcctccacgccgccctccgacctcgacggcatcctcgccatgggcggcgacggcatcctctcccgtcggcgccggcgcgcgccgctccctctccgtcacgcctgagagagagagaggagagacaggaagagaggggagatagggaaagaggaggaagaagaggatgggacgcgccggatctgggcaaggagccagatccggctgtcttcctctccaccaacgccggccgacgcctagaggggcgccggaggacgccagtggcagccgcggggtgcctgcgtgctctggccaccaccggccgccgccggatccgggtgcgccaccgccggatccgcggcctccaccattgccaccccaacgccgtcaccatccccgccgccatcacccacaacaccaccccgcgcaactcacctcgaccgccaccgtcgcccgtccccgccgccagcccatcccgtcagatccggccggaacggcgcggatctggcggacaccgccgtcgccactccgggcggctccccaggccgcccgagcgcgaggagacgaggagcgccccgccgccgccgtccttgtggctgcgcggcttcgccggcggccgctcgggcgacggcgaggcggagaagggggtgggggtgggggagaggggcggccgggtcgttgcctcctga

SEQ ID NO: 5885 - DNA, 2140 bp, Oryza sativa
  Predicted polypeptide sequence is orthologous to G956
gactctctcctcgctcccactcccacccacactgctcacgctgccattgtcgcagtgtttgcacttcattccattccattccacctccactgcttcgtcttctcttctcttctccgagtacggtgacagggagtgcaggttcgcgcgccaccatgccgccgctgtcgctgtcggccaaggcgaggaggggcttctcctcgtcgtcgtcctccgcctccgccgccgcgtcctcctgcaggtcgcagctggagcaggacgtgaagaagctgcagaaggcgctgcaggaggagacgacgctgcacgccatcctcgagaacgcgctccaccgcgccgcgctcactctcgccgacatgtcctacctccccaccaacgcacaggagctgctctccaacatctccatcctggaaggcaccatctccaagctggaggacgacatggtgtccctgcattttcagctcatccaggagcggaacgagaggaggctcgtcgagtaccgcctcaagcaggcgccgccgccaccgcagctgcagctgcagcagccacgctccgtctgctcctgccactccaccaaatccgaatcagatgacaccgcaaacgagaagtcatgtagagtggacaaggtttatccttttgctgtcctgcacgactcagctatgaaactacagaggcagctttcatccaaatgctttggcaatcctaatcagctttcggaggacatcgttcgctgcatgaagaacatcttcatttccttgtcagattcctgcagggagtcctcgaggactccctcgacggagaagcagcagtctggaccatctcctagcggaaactattcaatttctgcattctggtcgctgtccgaaccaacttccatatcctcctgggtgcagagtcctcaggtcgatttgaactacaacaataatctattagcttcagagaccgtctttgatccgtacaaagctcgcgagaagcttagttgggctgacattgggagctacggtgcagcggctgaagtttcgtggatgtcagttgggaagaaacaacttgagtatgctgcagaatcactaaggaaattcagattgctgattgaacaattggcagaagtaaacccaattcacctcggtgatgacgcaaagttggcattttggatcaatttatacaatgcactgatgatgcatgcttatcttgcttatggcgttccacggagtgacataaaattattttccctaatgcaaaaggccgcatatacaattggaggtcactcattcagcgctgcattcatcgagtatgtgattctgaagatgaaacctccaaatcataggccacaaatggctctgcttcttgcccttcagaagataaaagtgcctgaggagcagaaaaagttttgcattgggtcacctgagccactcttgacatttgctctcagctgtggattgtactcttctcctgcggtgaagatatatacagcaggcaatgtaagggaagaactccaagatgcacaacgtgattttattagagcatcggtaggagtcagtcgaaaggggaaacttctggtccctaaaatgctgcactgttttgcccgcggttttgttgacgacaacagcttccctatctggatatcacattttctacctcagcagcaagctacttttgttgagcactgtgtgtctcaaaggcggcaaagtctcctgggcacccgcacatttggcatcattccgtttgattctagatttcggtacctcttcttgccagatatgggattttcaaattaactgccctgacatgtttccccatccagataacatagaagcctaacatgagaaacacagtgaccaagtctcgtgagcaaacctattggttacagttgaaacaagcttttgcagcaagcaagtatctggattacagtatttcttaaacaagcaaatgcacatccagtgatcttggaaatgcaggtttggtaaaattttgaatcggtataagcactggattaagattgacatctttggatgtcagatgtaaaaaaaatcttcagcatgtcttaataggttcccttgcctcgacttcttgtcgaactcagcaaaacatgttgtacattgtatgtgtagtagcaaataaacaatgaagttagtaaaggaattcactg

SEQ ID NO: 5886 - DNA, 2268 bp, Oryza sativa
  Predicted polypeptide sequence is orthologous to G956
ggcgcggaggacgcattggccgccgctgcagccgtggccgtggcgtccgacaagatgcgctccgtgaccctgggcggttcgatccagagggtgatgcggaggattggcggcggcggtggtggccggagatcggccgggtcgaggggcgcgccgcagcgggcggaatgcctgggggcggggagcggcgacgcgtcggcgagctgctccggggatgatagtagcaatggcactggcaagagggatggaagcagaagggtaaggatgcggcggtacagatcggagctcgagcaagaagtaaagaaactgcagaggcaactggaagaagagattgacttgcagttggcattaacagatgccatcacaaataatgctacactgatacttgagccctctgcaaagcttccaaacaaggcacaggagctaataattagcatagcctccttggagaatactgtctcaaaacttgaaaaagacctaaatgacttatgttaccaactgtgtcatttaaggaacaatacgcgacttgcagaaaataattccagatacttagaaactctagctgaagaaaataattccagaggtctactgtctacatcattacagtaccaaccaccgtcaacttgtaaatgtacaggggaggaagacatttcaacactaagagatataaagctcggagaatctgaatcaatgcaagaaaatttattccctgggcttgaggaccaacagaacattcaaaaagagagtgaagggagagagatagtatctcaagatgggcttctcgaagagcatcaagatgttccttcaaatagattgttggaaaaacactggaacgaagagatgcaagagtcctatcctatggaaaatggaggcagagaatatcagataatagatgcgttatcatttgaccaatctcatcagaggaaaagcagcatcaatggtaatgtgtggaatggcaatccaaataagctctctgaagaaatggtgcgctgtatgagagatatcttccttcgtttatctgactcatcatccgagatatcaccaaaagggtcttctgttaattcaatttcatcaacagaacgtctatctggctgtacattgacatctgtatcagattcatccttgatggcatcagtgatgcaaagcccttcagttgattcaaaccatgacagtattgatgaagttagatacttcgatccctacaacgttaatggcaaggaagttcgaagagacattgggaactattgttcagtagctgaggtgtcttggatgtatgttggcaaggaacagcttgcatatgcatctgaagctctaaaaaatttcaggaatctcgtggagcaactatcaaaggttgaccctacatgtatgacctgtgctgagcggttagcattttggattaacctgtacaatacgttgataatgcatgcatatttggcctatggggttccagaaaacgatatcaagctcttctcactaatgcaaaaggcctgttacattgttggtgggcagtccttcagcgcagcagaaatagagtttgtgattctgaagatgaagactccagtacaccggccacaactttcgttgatgttggcccttcacaagttcagagttaccgaggagcacaagaaatattcgatcgatgatgcagagccccttgtgttgtttggccttagctgtggaatgttctcatcacctgctgtcaggattttctcagccgggaatgttcggcaggagcttcaggaatcaatgagagactacatccgagcatcggttggtatcaacgacagcgggaagctcatcgtcccaaagctgcttcagagctatgccaagggcaccgtggaggactctctgctcgccgactggatctgccgtcacctcacaccaaaccaggtcgcagctgtccaagacacttcgtcgtcgcggaaacagcggcttcttggtgtgcgcagcttcagcgtcgttccatttgactcaaaattccggtatctgttcttgcctgacaacagtagctcccagcactgaaccaagcttgccctgccaattgttcagaaagaaaccaagagtagcattttgacaaactgaaaaagaaaatgaagagatcagctgtacatgttgtaaatcttttagggtgattcttttttttttttgggcttgtaaagatcgtttgtaagccatgcatgcttatataaaaactgtagtataaaggtttgtgtataatttgcttgtttttagcaacaatcaagatggtaaaattcagacagtttttcttcc

SEQ ID NO: 5887 - DNA, 1849 bp, Oryza sativa
  Predicted polypeptide sequence is orthologous to G956
caacttgcacgtgcacatgggaagaacacatatcatcattgagagatttaaagtttggaggatctgagtcaatgaggtcaacacaacaagatttatactctgaacttgaatatgaacaagatgttggagaagatcctgaggagagacaaatggtttctctaaatagactatttgaaaaacaccgggatgtttctttaaatagacttctggaaaaacaccgggatgaagagatgcaagaatcttgctctactgataaagaaggcgaagaagatgagaagattgatactctatcatttgaacaatccatactaaagataactagcatgaaattagggaatctttggaacaatcctaaccagctctcagaggagatggttcgttgcatgagaaacattttcctccgtctatctgaatcctcgaagatgttaccaaaggaatcttctgattgttcatcttcctcagcagaacgtctttctggttctacactggcatccttctcagattcatccatcattccctcaatgctacgaagtccttcagttgactcgaatcgcaatgatgagatgacaactgaagccagcaactttgatccatataaagttaatgggaaggaaagccgaagagatattggaaattatcattcagcagctgaagtatcttggatgtctgttggaaaggagcaacttgaatatgcatctgaagctctaaaaaaattcagatttcttgtggaacagctatcaaaggttaaccctaatagtatgaactgtgatgagcggctagccttttggattaatttgtacaatgcactgattatgcatgcatatctagcatatggagttccacgaaatgatatcaagcttttttccctaatgcaaaaggcctgttacacagttggtggtcagtctttcagtgctgctgaaatagaatttgtgattctaaagatgaagactccagtgcatcggccccaactttccttgatgctagctcttaacaagttcaaaatactgaggagcacaagaaatactcgattgatgggacagaaccccttgtgttgtttggactcagctgcggaatgttctcttcacccgccgtgaggatcttctctgcagcaaatgtccgtcaggagcttcaggaatctttgagagactatgtccaagcgtctgttggtataagcgaccgagggaaactgctaatcccaaagttactgcagagctatgccaaggggaatgtcgaagattctttgctcgctgactggatctgccatcaccttacacctgatcaagttgcagtcatccgagattcttcttcacagcggaagcagcggcttcttggagcacgcagttttactgttgttgcattcgactcaaaattccgctatctgttcttgcctgacagcagtggctcccagaagccagaacccaaccggacttcgtgagctgtgttcagaaaacacatgctatgagcgagtatgtttggtcctagaaccatttcttgcatactggacaatggagtagctagttgtatatgatgtaaatttttggaggaagagtatatgatgcaacaaagatgagaagctggagggtgatacaaagagctccagtaaggatacaggatagttcatatgtatgatcagattatctcagctgaattggcgatgaaggttcatctggatctcattttgttctgttactgtctttccataatgaagataaccttttgtaatttttgttttcgacatacctttttttgggggtatagttcttgatcttggtcaattgatttgtaagttgtgctctaaataatgtatagtgcttttacctctttataataatgtgagttactttgtcac

SEQ ID NO: 5888 - DNA, 1425 bp, Oryza sativa
  Predicted polypeptide sequence is orthologous to G957, G961, G2535
tcgtccatccttctcccaatcaagcatccatccatcctccccaactatatataaaccccacacctttccctcgccaccgccctcgatcgtcttcttcctcctcctctcaatctcttcttccttctcctgcagccgccatttctagctagctatacgatcgatctatacatatatatcagaaggaaggaagaggctaattaagctagctgttgctagagctagcaagagcgaggagattgagcagctaggtaggtagcaagaaggagaagaagaagaagatcatcaatgagcatctcggtgaacgggcagtcgtgcgtgccgccggggttccggttccacccgacggaggaggagctgctcaactactacctccgcaagaaggtcgcctccgagcagatcgacctcgacgtcatccgcgacgtcgacctcaacaagctcgagccatgggacatccaagagaggtgtaagattgggtcagggccgcagaacgactggtacttcttcagccacaaggacaagaagtacccgacggggacgaggacgaacagggcgacggcggccgggttctggaaggccaccggccgcgacaaggccatctacaacgccgtccaccgcattggcatgcgcaagacgctcgtcttctacaagggccgcgccccccacggccagaagtccgactggatcatgcacgagtaccgcctcgacgaccccgccaccgacaccgccgccgccacacccacggttacttctgctgctgctgcggcggcggcgatggcggcggcggcggacggcgggcaggaggatggctgggtggtgtgcagggtgttcaagaagaagcaccaccacaaggaggccggcggcggcggcggcaagcacggcggcgacggcagcgccggcgccaaggcggcgcacgcttactcctccagcgacgacgcgctcgaccagatcctgcagtacatgggcaggtcgtgcaagcaggagcacgagctccccccgccgccgaccacctgctgctccaccaccaccaccgcacggactgggccatgatggaccgcctcgtcgcgtcgcacctcaacggcgccaactccgacgcgcccgacgaccagctctgcttcgacgccgccgacgacgacggcctcgcctactactccgccgccgccacgaggctgctcggcggtgccaacgccggcaccgacgacgacctgtggagcttcgcgcggtcggctgcgccgccaccgccgccgccgccgccgtcgtcggccacgccagagcgtctcagccacgtggcactgtaacacatgattcgtagctgtacgtacacgtacacgtatacgtacacgtcaggctacgtacgctcgagctgccaccctagctgctagtacagtaattacagagacaagacaagtaagaagaaaattgtaagtg

SEQ ID NO: 5889 - DNA, 1774 bp, Oryza sativa
  Predicted polypeptide sequence is orthologous to G957, G961, G2535
cctgtttggtttgcactgagtgaacaagcaattaagcttggtagtagtagtagttgttgtattgatcgatcgatcgatctagagacgacgatgagcatatcggtgaacgggcagtcggtggtgccaccggggttccggttccacccaacggaggaggagctcctgacatactacctgaagaagaaggtggcctcggagcgcatcgacctcgacgtcatctgcgacgtcgacctcaacaagctcgagccatgggacatccaagagaggtgcaggattgggtcagggccgcaaaacgactggtacttcttcagccacaaggacaagaagtacccgacggggacgaggacgaaccgggcaacggcggccggcttctggaaggccaccggccgcgacaaggccatctactccagctccaaccgcatcggcatgcgcaaaaccctcgtcttctacaagggccgtgccccccacggccagaaatcagactggatcatgcacgagtaccgcctcgacgacccctcctccgcctccgcctccgtctccgtcaacctcccctcctactactcttcctcctcatcgtcatcttccccaatgcacggtgtcgccggagaccaaggagctcaggaggaaggctgggtgatctgcagggtgttcaagaagaagaacctcgtgcaccacggcggcggcgccgccgcggcgagccaccacgcggcggccaagctcgcggcggcggccatggagggcagcccgagcaactgctcgacggtgaccgttagcgaccacgtcaaggcgcagatgctgcactcgtccgccagcgacgacgccctcgaccacatcctccagtacatgggccgctccggctgcaagcaggagaccaagccggcggcgatgtcggcgtcgtcggcggcagcggcggcggcgctggagcagcacctcagtacgcctcagtacggcaagttcatgaagcttccgccgctcgagcacgtcgccggcggcgtgggcctcctggcggcggccggcggcggcggcgagtactgctccgccgccgacgcgtcggggatcgccgactgggacacgctggtccggctcgcggcgtcgtacgagctcaacggcgccctctccgacgtcgcctccggcaagaacatggccggcttcttcgacgtcgtcgatcagcccgccggcgccgccgccttctcctccggcgacggcgacctgtggagccttgcgcggtcggtgtcatcgtcgctacacgcagacttgacgaccatgaataacgtataataattggagacaagaggtgacgatggagatgatgcatctagacgtggatggcgtatgcgtgcactaactctactcttaatctggtcggtctacgcatattgcatgcatgcatggacgacggtattgtacgtacgtgatcaataattaattactagttagggttccagcgagagtacaagacgacgacgacgacacaatagctagctgagctggccatgtgagcaagctctagacactaggtcaagatctaaccgtcgatcgatctgagccgttgatcgatcgatcgacgatgatggtgttgatcgatcgaattatagtgcagtggtcgagcgagttgttgtgtcgatctgaaacaagagagaggaaaaaaagaattaaaaggacgtacggcgtggtaggagagagagagagagagcatatataaatattatgtatctatatattgttatatattgtacctatagcttattatatatcaaagacatttttctagtgc

SEQ ID NO: 5890 - DNA, 622 bp, Oryza sativa
  Predicted polypeptide sequence is orthologous to G958
caaattggtatgaagaagacacctaggtactacaaagtcgagctcctcaggggattagaaccacttggtgatgcatgagtaccgcatcgaggaaagcgaatgcgagaacgccatggggattcaggactcctatgcgctatgtcggattttcaagaagaatgtgtgttgggtgaatttgacaagaaaggggagtgcagttcatcacaggctaaaggaaatgaagaacacagttacagatttcggggatgctggacatcctcgggagcacaatgagaatgataaagacattcatggatgcaattcatagcagaggatctatggtgcaccaccaactaaagtgaactagaaaactgagagaaaacagcttgttaacttcatctaaccagatatttcggtattagttatactgcgcgtatcttctgtatatgtttgataaggacacttctcactttgcataggaggaccactttaagtttggatgctggttcttaaattaggtttatacttttgttcctttagtactgtataatatatctaaaattgtgctactttgtacttcaatcttcaattaacatgtacctatcatctaatgaaatgataccaaaaaaaaaaaaaaaaaaaa

SEQ ID NO: 5891 - DNA, 1998 bp, Oryza sativa
  Predicted polypeptide sequence is orthologous to G958
gacccatccatccctagcttcctcgctgcttcgcccgccacgtcaccctcctcctcctccccttttttttctctcgctcgcctcgccatccatggcgtcgatggcgaaccagcagtagtagtagtccaccccaacgacgcgcgcgagccagctccggggtacccgccgctcgtgcccgggggggaagggggtgcaccggggagccgtcgcgccgcgcggctctgattcttcccgttcccggagatttgaaccatggagtctttacgtgacatggtcctcccaccaggatttggattccacccaaaagatactgagctcatttctcactatctgaaaaagaaaatacatggccaaaagattgaatatgagatcattccagaggtggatatatacaagcatgaaccatgggatttacctgcaaagtgcgatgttccaactcaggataataagtggcatttcttcgctgctcgtgacagaaagtatcctaacggttctcggtcaaatagggcaacagttgctgggtattggaaatccactggaaaggatcgagccataaaaatgggcaagcaaactataggaacgaagaaaactttagtttttcatgaaggccgcccacccactgggagacgtactgagtggatcatgcatgagtactatatagatgagcgtgaatgtcaagcctgccctgatatgaaggatgcatatgtactttgtcgtattaccaaaagaaatgactggatcccagggaatggcaatgagttggacaacagtgatcctcatccagaaccatatgatgctcctccatcagttatcagtactgaacagctaaatcctgctgctgaaccagttgtcggtgttgaagctgcaccagttaccgttgctgaacctgacggtgttactacgtcagctatcactgctaatataccatctcctagtgatgacattaatctggatgattggttgaatgaactatttgatcctttctttgaccctgaacagagtctggcttctgctgatctgtctccagatgaacaaaatgttgaatcatcgaacgtaggtgctttggctccaaaggtggaacaagactattctagtcctaacgagaacgtagtagatgatacggagtacttgttgcctgaagatgtttacaacatactgcaccctggtacagatgacttcaatatgctccagaatcctttggatcagtaccccattcaatatgcaaccgatgtttggagtggaattcagaaggaagaactgtggtcgccccaggccaatgctgagcctagtcagtcgaatgaagctgctgataatggaattataagacgttatcgtagtatgaaaacacctgaaactagtgtgccgcagttcaagggtaaaactcaggctaaaatgcgggttgggatcaacaagatggctacgagtagttctgaatctatcaaccagactatcaagtttgagaacagtggtcgtcttgttgagcaccagaagaaccaagcgcatgatgtagcttctaccaagcggtcagacgcagggaagccaagtacagagctcagcagcaatcgaggatttctcaggggtatccgaaatgcatttgcaggctgttcggatgctcgatggaacatgatacttgttgcgggtttcgctattggagtcgctgtggtagcgcttcatataggccaacgccttggattaagccagagagatcagcagcatacctagcctttaggtttgcaggttactgggtttctatgctttttgcaatctggagaaacgtaaacaaactccgatctttggttggtgcagaacatttgatgtatgcgccgttttttttgtgttggttttgtacatattattatcttcggttttggtcgacttttgttctcgccagctagtagtactatgttgacgaatgtagaagaaaacctcaaaaaaaaaagaacaaatgaaaaaaaattgacgatgaaaatttatataattaaccgcttgcattgtacc

SEQ ID NO: 5892 - DNA, 1953 bp, Oryza sativa
  Predicted polypeptide sequence is orthologous to G958
atggcgcccgtgagtttgcctccaggtttcaggttccaccccaccgatgaagaactaatcatctactaccttaagcggaagatcaacggaagacagatagaactcgaaatcattccagaggttgatctttacaagtgtgagccttgggatctgcctgaaaaatcctttcttccgagtaaagatctcgaatggtacttcttcagccctagagaccgcaagtacccaaatggatcaaggacgaaccgtgcaacaaaagccggatactggaaggcaactgggaaagatcgaaaagtgaactcacagaggcgtgcagttggtatgaagaagactcttgtgtactaccgtggtcgagctccacatggttctcgcaccgattgggtcatgcacgagtaccgcctcgatgagagggaatgcgagactgacactggcttacaggatgcatatgctttatgccgggtgttcaagaagacagcgcccgggccaaagatcatagagcattatggtgtggtgcaccaccatgtcgagcaacctcaatggatgacgagcagtatcgatcgctccccaacgttggacgtgtcgtgtgatggaagaggtgatgactttgagagcagcagcttctctttcccaacagagacgccaatggactccatgcacggtgggtttggaatgcagatgagtgcacctcacgaggatggcaaatggatgcagtttctgagtgaagatgccttcaacgccaccaatccattcttgacgaacccagtttctgccaacttctcatgccttccatccaaggtggatgttgcactggaatgtgcgaggctgcagcacaggctcaccttgcctcccttggaggtggaggatttcccacaggacgtcagccttgacacgaagattggcatacttcgcagtaaccccaacgaagttgacattctccaagaattcctgtcagttgcgactgcctctcaggagctaattaatggctccaccagtagctaccctgaaatgtggttaggagctagcacaagcagtgctagctacgtcaatgaactgtcctctctagttgagatgggcggcgttggcacttctaaccaccacgaatccgcaaggctacaggtcgagatcgctgacatggaggtgttcaaggacgagaagaagcgggtggagaaccttagaggagtcaagttggtgaacaatgaccttggggagattgttgtagaaggagatgaaagcaatccaacagaagacatcatcgcgcagtaccctataaaagtcactgcagataattcaggagaagccggtcatcgcatgaccgatcccactgacgtaggcggcatcgacactgccccgatcttctcgcaatctcaacctgacgactttgctgctggtttcgacgacgtcaaccctaatgcatctttcgatctgtacgagaaggttgacgtcaaccacaggctattcgtttcaagggtcgctgcggcgaagacattcttccaccgcattgagccatcgaagaaggtcagcttccactcgaacccggcagcaaccgccgtcagtaaggcgaccgagaagttccatttccccgttacgaccaaagttagtggtagggtttccatttttagcaagttcaaggcactcataagggacaagttcttgatgatgaggccatcacattcataccaaaggttgggcagcaaagaaaccacagtgaatgagctgctgcagattgtgtcactccttttagcaccgaagcaaatcaatggctgccctactgagcaagagctggtcaagaagaaggcgaaagaagtgatgaagccgggatggggtcgtgaagggagcaacaaattgtggcttccgctctccaaagggaagggcatttccagcatgtttttgagtgggaaatggacgtttctaacctccgcgttggccatcagcactccagctgagtgcgatcactaa

SEQ ID NO: 5893 - DNA, 739 bp, Oryza sativa
  Predicted polypeptide sequence is orthologous to G961
gacaaagctgggtaccgggccccccctcgagttttttttctttttttttaaactgtcttaatgtcttaccaccgtgccaccgttgacaagtacgtacatgtctaagggcatcaagcatgacgagtagaatttacattttccagacttcactacagtttatgaacaaagttcaagcccaaaatctgtataatacagcatggatgcctctacctacatctctggtttattatgaatagctgaattctttggtcttcgcaccgttccttccaacatctctggtttttgcaatttgcattgcccagattgcctactccagtttgtgaaagatgtcagaagaggatatccggaaattatgcacacatcgcctttccaaaattttgtacatgacacagttttcatttgtccaacgatgaaatgccatatatcagatagagataggcctgcaactctcatgcaaatgaatgctagcaaatcgtggcatgcaggtctgctagtctgctactgcatcgaagttggaacttggaacacaaactcaaggtcatccatgcaagggcacttcaaattcagacggacctcccactattgtgcactgaagcctgaagccggcaacactggaaaaatcgggagcactggcatgtcactaacaaacctgcagtcggatgatactatggggacaatttcttagcgatatgcttaaggaccgcaacacaatgtcctgacattagaagcccaatattct

SEQ ID NO: 5894 - DNA, 763 bp, Oryza sativa
  Predicted polypeptide sequence is orthologous to G962
cttgcatttgctcccccccaaattctcttctcctcctgcttttccagctatagctagctcgccgtcgctgccgccgccgcgccacagcgcacgctatgccggtgacgaccgcgagggagaggaggagggagccatgagcagggacgacgtcgacgacgtcacggcgggcgccgccgggtcaggggaggaagcggcggccgatcaggaggaggcggccgccgctgtcgccggcgactcgcacgagaacgacctggtgatgccggggttccggttccacccgacggaggaggagctgatcgagttctacctccggcggaaggtggagggccggcggttcaacgtcgagctcatcaccttcctcgacctctaccgcttcgacccatgggagctccccgcaatggcggtgataggggagaaggagtggttcttctacgtgccgcgggaccgcaagtaccggaacggcgaccggccgaaccgggtgacggcgtcggggtactggaaggcgacgggggccgaccggatgatccgcggcgagaacagccgccccatcggcctcaagaagacgctcgtcttctactccggcaaggcccccaagggcgtccgcagcagctggatcatgaacgagtaccgcctccccccgcccgccgcagacgccgatctcttctacaagtctgagatctcgctctgccgcgtctacaagcgctccggcatcgacgacggccacggccaccaccagcgccccgccggcaacgtgcaagcgtcg

SEQ ID NO: 5895 - DNA, 1631 bp, Oryza sativa
  Predicted polypeptide sequence is orthologous to G962
gtgcctgtcatccctttctctcttcttccgccgccgcgttctgcttcccaacttgaacactactactactcccccacggcgagctcgcgttctccgggaccaactagccctagcgacggatgcatatgcggagggggagagcggctggaggcgaaggagaggcagctgcggtggtggtgatgaacaggtacgacaacaacgggcatgcggcagcggcggcggcggctgcggtggcgggaggaggaggaggaggaggagggaataaggcggcgggggaggtagatgggcatgaggatgacctggtgatgcccgggttcaggttccacccgacggaggaggagctgatcgagttctaccctccggcggaaggtggagggcaagcgcttcaacgtcgagctcatcaccttcctcgacctctaccgctacgacccctgggagctccccgcaatggcggcgataggggagaaggagtggttcttctacgtgcctcgggacaggaagtacaggaacggggaccggccgaaccgggtgacggcgtcggggtactggaaggcgacgggggccgaccggatgatccgagccgagaacaaccgccccatcgggctcaagaagacgcttgtcttctactccggcaaggcccccaagggcgtccgcagcagctggatcatgaacgagtatcgccttccccccgccgacaccgaccgctaccacaagactgaaatctcactatgccgcgtgtacaagcgcaccggcatcgacgacggccatggccaggtatccacggcgcggtcgtcggcgcactcccgcggcggcggcgcggcaccggtacaggacaacaagcaaggctcctcgtcgacgtccacgccgacgccgcctccaactccgtccaagctccacctcctcagcagcgagtgcacgtcgccgcccgccatcgtcacggaccacgccgccatggtggcgcacaaggcaccgtcgccgcggcaccatcagcagcagcagcagctccacgctgccaagccttgcggcggctacctgcagaattcctcgatggcttccgctgccggcggcgatcagcagcagcaatttcagcaagacttcgcggcggcattgtaccagcagtactccaagaacacgagcggtgccttcgcctccacgtactcgctgctcaacctcgtcaacgcggcatccatgggcagctccgccgctgccattgatgagctgagctcgctggtgggccacggcacgccgtcctacattaaccccgcggccggcagccacaactatagtcaattccttcacctgcctacgacgccgtcgtcgcatcaaccaacgccggcgccgctcgggacgacgacggcggcagcggcggcgacgctgccgatgtcgctcgccgccttctccgacaggatctgggactggaataatccgatccccgaggccggaggtagggattacagcaccagtactggattcaagtgaatcagctatagctacagttcatgcacgcgtgcatggcattctgatcagatggtaccaccatgtactacctctctctctctctctctctctctctctctctctctgtgtgtcccactctctggttcacagttattaattctgatgaaacgatc

SEQ ID NO: 5896 - DNA, 2424 bp, Oryza sativa
  Predicted polypeptide sequence is orthologous to G962
gactggaaggtgatgagagtactcaagttgatcgccggagcagcatcagcatcagcatcagcttcaccatgcggggatcagatcatcatcaggatgtcgtcgcggcaccgcggggcggtggcggtggaggagacgacgggcaggcgcacgacatggtgatgccggggttccggttccacccgacggaggaggagctcatcgagttctacctccggcgaaaggtggaggggaagcggttcaacatcgagctcatcgccttcgtcgacctctaccgctatgacccgtgggatcttcccgctctggcctcaattggggacaaggagtggttcttctatgtgccaagggaccgcaagtaccgaaacggcgatcggcccaaccgagtgacgccatcggggtactggaaggccacaggggcggataggatggtgaaggtggagggtgaccgtcctatcggcctcaagaagacgctcgtcttctacgtcggcaaggcgcccaaggggcttcgcagcagctggatcatgaacgagtatcgtctccctcatggcgacgctgaccgctaccaaaaggaaatttcgctgtgtcgagtctacaaacgcccaggaatcgaagacaacttccacctcaccggcacaaccactaaatcctccggctcaaaggcggcggcggcgatgggcaagaagcacgccgccgcgaaccggacgtcatcgacggcggcggctgcggcgccccgcctcgccccgatgttcgacggcggcggcggcggccaccactaatccgccctcatgggaaaggcaacatacaacgcatcacacaccgccgccgaagggacgaacgccatcgccatgtcactgtcggcggcggccgcgctgcatcctccggcgccggcgatgttccggtcgacggcgtcggtggcctcgctgagctccaccacgtcgacggaggaggacggcacgtcgctcttccacctcaaggccggcgcgacgacgacgaacacgacgacgatgcatcatcaccatcatcatcagcagctgcctgcttcaactcatgctctgctcaacaccaactcgtcagcaatggcgaccatccccatcgacgagctgagtagggcgattggatcttacagcaacatccaccatcaaccaaactctactacaactcatcaatcaactgctttgccgccatcgcaacaaagccctcttcttccattcgctagcatggagaagatttgggattggaaccctctcctagaatctcccaaggtttgcacaaacttcaagtaactttgattatgatctactcttggatgatggattaatgtttgtatgcatgaatgcatctatgcaactatgcatatatatgcattgcatggatgcaaaaaccatatggtattatatgtgtacttaattaattatgtatatgtataacacatatttgggctaggacagggttatctatctatataatggaacatggtaaggtagttctagtcccatgcaattaccggcttaccgcgccattattttagttcacattagtggatggaagtaactgtatgtcaatttctattggatatgatctcgaggacaatgtgtagtgttactcgtcgatctagagttgtaataaagatgaaatagcattatatatgtgatcttttttcgcttccatagtatttattctacatatatataaattatccatgcagccggcagcatatatgcatatgcatgaactgcaggtgtgtgttcataatttatgtagtatatttgataggtgatcttggaagatatctagtgttttggttgcatgaaatgatattgcgcgcgctcattactctggaaaaccacgcatgcatatggtatgaaattaatactgtgttacaaattaaaatggtattggtggtttttgctactcttttcccattatttcgaattttaaacatcacaataatataatcaattttttgctagttaaattggtttgtgcctcgaacagatatatagccactgtatctaattaacatttcttatgtgttcttatggatttatagtcagataataatcggccggttggatggataagtactgatcatatgcagtcttttcacaatggttgacaattttctgcatattgctttgtctatgaataaatgaggagtgcaaaacatcgatccacctgaattaatttaactcagtaaatacagataaatactgctatttgtagtatttcttagcaggagcgttgccattttgcgtcacttatttcttctcagatttaataatgtattttactttaattagttgtgagaacctggtggataaattaatatgtaaacatataataatgtggaatgggtggaatatgatttgacttgattattccctacaattaatatataacacaagctggcagcagtgtatatattct

SEQ ID NO: 5897 - DNA, 651 bp, Oryza sativa
  Predicted polypeptide sequence is orthologous to G962
atgcatatgcggagggggagagcggcgggaggcgaaggagaggcagctgcggtggtggtgatgaacaggtacgacaacaacgggcatgcggcagcggcggcggcggctgcggtggcgggaggaggaggaggaggaggagggaataaggcggcgggggaggtagatgggcatgaggatgacctggtgatgcccgggttcaggttccacccgacggaggaggagctgatcgagttctacctccggcggaaggtggagggcaagcgcttcaacgtcgagctcatcaccttcctcgacctctaccgctacgacccctgggagctccccggaattgagcatctaattaacaagctcgatgggggtgcagcaatggcggcgataggggagaaggagtggttcttctacgtgcctcgggacaggaagtacaggaacggggaccggccgaaccgggtgacggcgtcggggtactggaaggcgacgggggccgaccggatgatccgagccgagaacaaccgccccatcgggctcaagaagacgcttgtcttctactccggcaaggcccccaagggcgtccgcagcagctggatcatgaacgagtatcgccttccccccgccgacaccgaccgctaccacaaggtacccatccatccatga

SEQ ID NO: 5898 - DNA, 1305 bp, Oryza sativa
  misc_feature (178)..(178): n is a, c, g, or t
  misc_feature (188)..(188): n is a, c, g, or t
  misc_feature (217)..(217): n is a, c, g, or t
  misc_feature (268)..(268): n is a, c, g, or t
  misc_feature (306)..(306): n is a, c, g, or t
  misc_feature (363)..(363): n is a, c, g, or t
  misc_feature (415)..(415): n is a, c, g, or t
  misc_feature (417)..(417): n is a, c, g, or t
  misc_feature (463)..(463): n is a, c, g, or t
  misc_feature (507)..(507): n is a, c, g, or t
  misc_feature (549)..(549): n is a, c, g, or t
  misc_feature (650)..(650): n is a, c, g, or t
  misc_feature (777)..(777): n is a, c, g, or t
  misc_feature (818)..(818): n is a, c, g, or t
  Predicted polypeptide sequence is orthologous to G962
ttttttttttttttttcggcaagttgccatagttattgcaaacatactcgcagtacacatataccattactcccttaaaagcagccatcggcccaccagcataagcaattctcactcaccaatcgtgcacattggctccacatcaatgagccagcaccgcccagccaacaccccatcntacagcagcncactatcaataattgagcgcccagacacncagcataaataacacacaggcacacgacattagcacaccataggttaacanccattcatcagcgtcatattgagcatgtgctcccagcncacacaagaagagaaggcagttgcgttctacacaagcggagcacacaatttgagctnacaagtcaagcacaaggcacagacgtcaaatattcagcaggtgcctggtacntncagcagacaacatcacgtcatcgcaaggcagtaagcgacatttcanaaacgaacgttatggggcccacaactgtattggacaaggtggtntctagcaaacagagcaaagacattagaatccctgagcaatantatatcagttacacaaaagagagcgcaatttctataaggccagacttaccttgatatagcattcatccattacaaccaggccgcaaggactcattattacntatctatactccatatttaccgcgcacaggaacaaaagaaccgccacatatccacagttcctatcaatataataggacgaaccagttatccaaggaaacaacacgcacaagtactatcacattgcgnagaccacaaaatacaggaagtatgtgattactcccatgagncgccaatactccacacagcgggagttcctgaacccacatcacagaggttggaaccaaacaacagaggcaccgcaccagcggcacagtatacagcacaagcacaccggacaacaacaacgtctcttgtcatgtaacacatttcaatgacgaatacacgacagcaacacaactccaagagcacaaggacttactcatggggtcttacaacaccgaagagaaatacacatatcgcggatgacattagcatatgtggagaacaatcacaagactccctcatctagtcgacccgacatatgtgatggccaccacccaaaatatatttgagtggtgaccaatacaccaaatgagatacgccactccagcgacacatacagtggactatcatgacgtcacacaaccgcaaacaccaagattcatgtaacaggtgtggctcagaaacaccaacgtgaacatgacagtaccgtcatcactgagtaatgcaccacct

SEQ ID NO: 5899 - DNA, 1599 bp, Oryza sativa
  Predicted polypeptide sequence is orthologous to G963
atggcagaactaccaccggaaggccgcggcggcggtggcaacaacaatgggaagtggaaggggaaggaaaaggtggtgcccgagtacggcaagaaccggcacggcatgtccgtcggctggtacttcgtccccaaggatctggagctctttgccatcctcaagtgcaagctcgtccgcggccagctccccggcgccctcaacaacgtcttcgagcatatcaggatcctcgaattccaccccgccctcctgcatgagatgtacatcaagaacgaggaggatgggtacatctacttcttcagcaagaggcagttcacgacgaaggcagggaacaagaggcggccgacgcgggtgacaaagggcgggacgtggaaggcgtctggcgggagcaagacagtgaggagcaagaaggtcggcggcatcgacgttggccagaagctcaccatggtgttctacgagcgcaggtttgagggtgaccggaaccccatcaagaccaattggggcatgcatgagttcaccaagatcattgatggcaccaaaaaccagcttgaggaccttgccgtgtaccgcctgtacaagatcaaaaggaaggaggacgaagaaccgtcgaacactgccgccgcggcgtcgagcaccgacgagccctccacgtcgtcggcattgccacctcctacgccaccgcggccattgccggacatggccggaccgtcgtcagcaacgccgctactgccactgcaattgccgggcctggccgggtcgtcgtctgcgatgtcgctgcctgcactgcagctgccgggcatggccgggtcgtcgtcggcgatgccgctaccgccactatcgttgccgggcctggctggagggatgatgtccatggcggaccaggcgaacatggcctcgacgtcgcaggcgtccacaccgtcgtcggagctcctgcaagactggtacgacgagttcgagatcacgtacggcgccgtggctccgccgtctcctagcacgatcagctgggtggcgccgcagagctcgccgacggggtggtggccgtcgccgaacggcgggccggtgcagcacgacggctacctcgggatggcagcggatccaacgtcgtacatgctggaaaacctgttgcccaccgcggcgatcccgccggagccgatgatgccgccgacgagctcgccggcgccaccaccagccgtcgaccaccaccaccggctctcgcctccgcatgacgccgccggcagcaactacaaccacccggagctcgccgactacaacggcggcgtccaggcgcagcacgagcatcagtatcacccacaggagccgcaggcatcgctggtggatgccgaggacggctacagcgccatggccggtggcgacgacgcgcagctgggcggcgcggagcttgacaccgaacgaatcgccgaaatggtaaaccatataatggatggcgaattcgagttcaaattcgaggacaacaccgtccttaagtacaacgaagtctttcctgacaatgatgaggtggtggcggcgccgatgatgatcgacggtggtagggatggcgatggcgcagatggaggtgatggagacgacccattcgacaattag

SEQ ID NO: 5900 - DNA, 904 bp, Oryza sativa
  Predicted polypeptide sequence is orthologous to G971
ttctttttttttttttttttttttgttgtgatggttctgtgtgaaaactgagctgcagctttatctctgtaatctcattggagaaccactaatcaggccaatgtaatatgccaagatgcattactgcatttcttgtcttgtattattgatagatcttaacatcttaagagctgtcaccgtgtcattgtggtccctagtttggaaggtatacttgccttgtgggttgggtcctgtgggttatttagggaattttgggggatttaactgaatgggcattttaaaatttataaatgggtaaaaaagatttttttattaaacaatggttggtagatttgtaaatctggtttttattggatgaatgggtgggtacttgggtggaaaacagagtgttacctactgatttaagactccgtctaagggcatgtacagtgctacattaatggtgttgaccgttcacagttgcatgatactactaggcagataggattagattagaaacaacttattctaagagaattatcttaatgatcttttcctatcagaaattgacactgccagagatgtgagggactacctgaaaggactgcgggtacaaacactgaacatatgggaaggcagggaacagcaacataatgccgcaacatagctcactagatcaagtgccaactacggcaaaacgagagagtccacagagtagcgccagcactgcagaatctgccaagaaacagtatctcgtatatcgtgtcttctactcttgtttgtcgcctccaccacccccaccaaccaccgacgaagtgcgtagcaagcagagagaaatagactatcgacatacagaccgagccacgaagacgcacaacggaccacaagcagcacacgcaggagcaagaagcaacacacagcaaac

SEQ ID NO: 5901 - DNA, 1205 bp, Oryza sativa
  Predicted polypeptide sequence is orthologous to G975, G1387, G2583
gattgaacgcacgctacactgcaagaaaggcaagtataggggtggcaggtagtttatattcactggaaaccgagaacttcactcctcccagcactccacactaggaggatgctcactgtctgaatgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 5902 - DNA, 1328 bp, Oryza sativa
  Predicted polypeptide sequence is orthologous to G975, G1387, G2583
gaacgcacgctacactgcaagaaaggcaagtataggggtggcaggtagtttatattcactggaaaccgagaacttcactcctcccagcactccacactaggaggatgctcactgtctgactgactgactggctgctgctgctgctcattccttctcctactctgcctgcctcctctgctgtgtccttgggagaattcttcagggacagtatccctgcagaggtgagatcatgggacagtcgaagaagaagttccgcggagtcaggcagcgccactggggctcctgggtctccgagatcaggcaccctctccttaagaggagggtgtggctgggtacctttgagacggcggaggaggcggcgcgggcgtacgacgaggccgccatcctgatgagcggccgcaacgccaagaccaacttcccagtcgcgaggaacgccacgggggagctcacaccggcggctgcggtggcagggcgggatggccgtgtcggcggcggcagcggcagctcgtcctcaatgacggccaacggcggcgggaacagcctgtctcagatcctcagcgccaagctccgcaagtgctgcaagacgccgtcgccgtcgctcacctgcctccgccttgacccggagaagtcccacattggcgtctggcagaagcgcgccggcgcacgcgctgactccagctgggtcatgaccgtcgagctcaacaaggacacggccgtgtcgtcggctgcgacggtggcagcagcaacagcagtgtcgtccagcgaccagccgactccgagtgacagcacagtcacaacgacgtccacgtccaccacgggctcgccgtcgccaccacctccggcaatggacgacgaggagaggatcgcgctgcagatgatcgaggagctgctgggcaggagcggcccgggctcgccgtcacatgggctgctgcacggtggtgaaggtagcctcgtcatctgaattccggaagaacaggaaagaaattgaaaatgcaaggttaaaacagcatgatcaggtcaccatctaagatcaaggatctggtagggtggttggtgcacaggcagttaagattgctacatatgataggtatatctctattactactacatatccagcttaattaggaaacaattataagatcgattactactgtgtgaagtgaagctgtgtatttattaaagacttacttgtatgtacaagacgtccccgtcattatagtcatactggtgaaagctctgctatgtatcaacgtcatcagagatcagactacatatatataagtggtgtcaacttctaataaaagtaaataaaaacattgtaattgtgt

SEQ ID NO: 5903 - DNA, 873 bp, Oryza sativa
  Predicted polypeptide sequence is orthologous to G977
actgatcacctcgacctcacttcctcctcaacctcgagctcactcctcgctctcccgccgcgagcgcgcgctctctctcgccgcgaccacgcgcaatccgtcgccgagctcgaggacgtcggcaatggcgcggccgcagcagcggtatcgcggcgtgcggcagcgccactggggctcatgggtctccgagatccgccaccctctcctgaagacgaggatctggctgggcacgttcgagacggcggaggacgcggcacgcgcgtacgacgaggcggcgcggatcatgtgcggcccgcgcgtgcgcaccaacttcccccacgacgtcgccgacgaggccgcgccgccgccgccgccgcacagcgccgccgcagcctcctcgtcgttcctctccgcggcgctcgtcgccaagctccaccgcttcaacctcgcctccgtccaggctgcgcagcgcggcaacagcaacgacgacgactccaccacctcctcctccgccgccgcgtcgtcgcgcgccgtgattccgtcccttcccgccgccgccggcgcattgggcaatgcggcggcgacggcggagtggagcggcgggttcctcgaggagcagtacgtggaccagatgatcgaggagctcctcgactccaacttctccatggagatctcctgctgatgtgccctgttcatctacctgttcttctctgctccatctcctgtttctttctctctctcttttttttctttctttttttttgtttttttagtttagtaagctatgtgaggaagaactctgatcgaggttagtttggtcacagtgagttctggagcagcttgtgtatacggtagcatcatttagagcataatagggttgcagttgagaccttc

SEQ ID NO: 5904 - DNA, 519 bp, Oryza sativa
  Predicted polypeptide sequence is orthologous to G977
atggcgaggccgcagcaacgataccgcggcgtgcggcagcgccactggggctcctgggtctccgagatccgccaccctctcctgaagacgcggatatggctgggcacgttcgagacggcggaggatgcggcgcgggcgtacgacgaggcggcgaggatcatgtgcgggccccgcgcgcgcaccaacttcccgctcgccgacgccaccgcggcggcggcggcggccgccgcgtcctcgtcgttcctctccgccgcgctcgtcgccaagctccaccggttcaacctggcgtccgtgcaggccacgcagcggcagagggaggccgccgccaccgccgccgcggcctcttcggcctccgccacgacgccgccgctcggcaatgccgccgccgccgacgacgacgcgcggaccaccacgacgtacggcgcggaatggagcggcaggttcctcgaggagcagcacgtcgagcagatgatcgacgagctgctcgactccaacttctccatggagatctgctactag

SEQ ID NO: 5905 - DNA, 868 bp, Oryza sativa
  Predicted polypeptide sequence is orthologous to G979
ctacattccacttccccaatatgcgccgctgcgtgcaggacttcgtgcgggaatgttccacctgccagcggtacaagagcgagcaccttcacccggccgggctgctgctgcccctgccgattcccacagcagtctgggccgacattggcctcgactttgtggaagcgctgcccaaggtgaacgggaagtcggtgatcctttccgtcgtcgaccgcttcagcaagtactgccacttcatcccgctggcgcacccgtacaccgccgagtccgtggctcaggcgttcttcaccgacatcgtccgcctccacggcatgccgcagtccatcgtctccgaccgcgacccggtgttcacttcactgttttggcgtgagctgatgcgcctcatgggcaccaagctgcacatgacgtccgccttccaccctcagtctgatggccagacggaggcggctaaccgcgtcattgtcatgtacctgcgttgttttacaggtgaccgaccccagcagtggctccgctggctgccttgggctgaattcgtgtataacacggcctaccagtcctcgctcaaggagacgcccttccgtgtggtgtacggccgtgacccgcccaccatccgctcgtatgagcctggtgagacgcgtgttgcagctgtcgcaagggacatggaggagcgagagaccttcctggctgaagtccgccaccgcctggagcaagctcaagccctccagaagctctactacgaccggcagcaccgcccggtgtcctatcaggttggcgactgggcgctgctgcgccttcgtcagcgcaccatggcgtccctgcctcaagcgcagccccggcagctgaagccgcgcttcgtcggtccctaccg

SEQ ID NO: 5906 - DNA, 1866 bp, Oryza sativa
  Predicted polypeptide sequence is orthologous to G979, G2106, G2131
aaggctagccgcctcactccctctctctgtttcctcttcttcttcttcctcccgccggtcagctcagctcgcctcgtctcctccattttggcgacgcgagcgagcatattaaagctgtgccggcggctgcaactttgccgccatttatttagctccggctcttttaaaagctctcttctcctgctgccatcttcttctggttggcaccaccattccatatataccatctccctcctcctcccgcgctcgctcttcgccaatggccaagcgacgcagcaacggcgagaccgccgccgcgagcagcgacgactctagctccggcgtctgcggcggcggcggcggcggtgaggttgagccgaggcggcggcagaagcggccgcggaggagcgccccgcgggattgcccctcccagcgcagctccgcgttccgcggcgtcacacggcaccggtggacggggcggttcgaggcgcatctctgggacaagaacacctggaacgagtcgcagagcaagaagggcagacaagtttacctcggggcttacgacggcgaggaagcggcggcgcgcgcctacgacctcgccgcattgaagtactggggccacgacaccgtcctcaacttccctctgtcaacatatgacgaggaattgaaggaaatggaggggcagtccagggaagagtacatcggatcgctccggaggaagagcagtggcttctcaagaggggtgtccaagtacagaggagttgcaaggcatcatcacaacggcaaatgggaggctcggattgggcgtgtgttcggcaacaaatacctctacctaggtacttatgcaacacaagaggaggcggccgtggcgtacgacatcgcggcgatcgagcaccgcggcctcaacgccgtcaccaacttcgacatcaatctctacatcaggtggtaccacggctcttgccgctccagcagcgccgccgccgccaccaccatcgaagacgatgatttcgccgaagccatcgccgccgcgttgcaaggcgtcgacgagcagccgtcgtcgtcgccggcgacgacgcgccagctgcaaaccgcggacgacgacgacgacgacctcgtggcgcagctcccgccccagctgaggccgctggctcgcgcggcgtccacctccccgatcggactgctgctgcggtcgcccaagttcaaggagatcatcgagcaggcggcggccgcggcggcgtcgtcctctggtagcagcagtagcagcagcacagactcaccttcttcttcgtcgtcgtcatcgctgtcgccgtcgccattgccatcgccgccgccgcagcagcagccaaccgtaccgaaggacgaccagtacaacgtcgacatgtcgtcggtggcggcggcgaggtgcagcttcccggacgacgtgcagacgtacttcgggctggacgacgacggcttcgggtacccggaggtggacacgttcttgttcggggatttgggcgcgtacgcggcgcccatgtttcagttcgagctcgacgtctgaactctcaactccgaccagggtgtttcgggaggcccacaatcccagcctgttcccgtagatgggctggaaagatcgaatcaaatttgggcctattcaggggatgggctgggagaattgatatgggccggcagggatggccgaaagggaaggcctcccaagttttggctgtcaagaagctagaactgagttctctctcaaaagagagagagagagagaagctagaactgaggattagttgcttactcgcaaatactagtagtttggaggaagagtaaaatattggtttatttgttgcccatctctgcgaaggggaatttaccgtaataaagagtacatattgccgtttt

SEQ ID NO: 5907 - DNA, 1272 bp, Oryza sativa
  Predicted polypeptide sequence is orthologous to G979, G2106, G2131
atgaggaagaagaagaaggcctttgctgttgcagctgcaaccaccttgctttcccctcctcggtcctcctcctcctcctcctccacggcgtcctcctgcattgtgccgccgcgcactgagagcggcaagaagaagagtaagcacaggaagagggccaaggatggcaccggcggtgacgacgacgacgccgccgttgctgctgcgccgaggaagggatcctccatctacaagggcgtggcaaggcacaggggttcagggaagtacgaggcgcacctgtgggacaagcaaggctggaacccaaaccagacaaggaagagaggcaggcaaggagcttatgacacagaggaggctgcagctcgcacttatgatcttgcggcactcaagatctggggctcagaccatgtcctaaacttcccgattgacacgtacaggaaggagcttgagaggatgcagcgaatgacaagggaggagtacctggctactctgaggcgcaagagcagtggcttctccaggggtgtctccaagtacaggggagtggcaaagcatcaccacaacggccggtgggaggccaggataggccgagctgtaggcaagaaatacctctacctgggaacattcgatacccaggaggaggcagccacggcctacgacctggcggcgatacagctccgcggccgcagcgcggtcaccaacttcgacgccagctgctacacctacacggaccacctgccgccgccgccgccgccgcagccaccgtccgtctgcaagaccgagccggagctggagccgccgcagccggcggcgcctccaggctcggagtcacttctccggcccaagatggagccctgcgacgactgggagccgccggcgatttgcccgtcgctccgtgacgcggacgacgcggaccacgccatcgccgagatcctgccggcgctctgcatggaccgcgccgacttcgaggccaggtaccctgcccgccgcgcccgcgacgccgccgccgacggctggtcgacgtcgtcggacgacgtcgccgccgcctccgtcgacgatgacgtgctgcgtagcctgccagacgacgtgggcttcgtcgacgacgtcgagagcctcttcctggacgcgcccggcccggccgccgccgccgccgccgccgcgatgccagacgacgtggaacgcgcggtgcagcgcgcgccttctgccgcgtctcgtcgggccaacgccgcggcggtctcctacgcgatcagctcgttggcgtccgggcgctggtggtattga

SEQ ID NO: 5908 - DNA, 1910 bp, Oryza sativa
  Predicted polypeptide sequence is orthologous to G979, G2106, G2131
gttgcctctcctcctcctcgtcacctcacctgcacctgcaccaacgcgagagatcatggcgaagagatcgtctcctgatcccgcatcatcttctccatctgcatcatcctcgccgtcgtctccttcctcctcttcctccgaggattcctcttcgcccatgtcgatgccctgcaagaggagggcgaggccgaggacggacaagagcaccggcaaggccaagaggcccaagaaggagagcaaggaggtggttgatccttcttccaatggcggtggcggcggcggcggcggcaagaggagttctatctacaggggagtcaccaggtatgcgtctctgcatggcatcggtggactggcagatttgaggcccatctgtgggacaagaattgctccacttcacttcagaacaagaagaaagggaggcaagtctatttgggggcttatgatagtgaagaggcagctgctcgtgcatatgaccttgcagctcttaagtactggggtcctgagacagtgctcaatttcccactggaggaatatgagaaggagaggtcggagatggagggtgtgtcgagggaggagtacctggcctccctccgccgccggagcagcggtttctccaggggtgtctccaagtacagaggcgttgccaggcatcaccacaatgggcggtgggaggcacggatagggcgggtcctggggaacaagtacctctacctgggtactttcgatactcaagaggaggcagccaaggcctatgatcttgctgcaattgaataccgaggtgccaatgcggtaaccaacttcgacatcagctgctacctggaccagccacagttactggcacagctgcaacaggaaccacagttactggcacaactgcaacaagagctacaggtggtgccagcattacatgaagagcctcaagatgatgaccgaagtgagaatgcagtccaagagctcagttccagtgaagcaaatacatcaagtgacaacaatgagccacttgcagccgatgacagcgctgaatgcatgaatgaaccccttccaattgttgatggcattgaagaaagcctctggagcccttgcttggattatgaattggatacaatgcctggggcttacttcagcaactcgatgaatttcagtgaatggttcaatgatgaggctttcgaaggcggcatggagtacctatttgaagggtgctccagtataactgaaggcggcaacagcatggataactcaggtgtgacagaatacaatttgtttgaggaatgcaatatgttggagaaggacatttcagattttttagacaaggacatttcagattttttagataaggacatttcaatttcagatagggagcgaatatctcctcaagcaaacaatatctcctgccctcaaaaaatgatcagtgtgtgcaactgattctctctgtgtgtgtttctgggtgttgaaaatcttgagatatacagggaagttttcaggtttttatcttggggtatatttctctgtccaatggcactgccacaaagaagcaaagcttctgtaggcgttctgttcaggtggggaagattcatatgcttctccctatggtcctagtctcctagaaacccaaaggcattcaacttggcatgagacaagtgtctgtgttccttttcttgtaatacccccaaggctgattgattaactagggagacaattttctcccttaccctagattgagctagttaattctgattactcagaatcttgaatgcttgagtagtactataggtattcccacaagaaaactctgggtagttcacagttttataaggtaatggagcatatgttatacagaaatcacaatatgtaaatctatctaactttcagaataaactatactatacatcttggttgaggcatgaatgcat

SEQ ID NO: 5909 - DNA, 1572 bp, Oryza sativa
  Predicted polypeptide sequence is orthologous to G979, G2106, G2131
gagcagcggtgtcgccgccgccgccgccgcggcggcggtgaagccgaagcgcacgcggaagagcgtcccccgcgagtccccctcccagcgcagctccgtctaccgcggcgtcacccggcaccggtggacggggcggttcgaggcgcacctgtgggacaagaacagctggaacgagtcccagaacaagaagggcaagcaagtttacctcggggcgtatgacgacgaggaggcagcggcgagggcgtacgatctggcggcattgaagtactggggacccgacaccatcctcaacttcccgttgtctgcatatgaaggtgagttgaaagaaatggaggggcaatcaagggaagagtatattggatccctaaggaggaaaagcagtgggttctcaagaggagtatcgaagtaccgaggcgttgcaagacaccatcacaatgggagatgggaggcccggattggccgtgtttttggcaacaagtacctctatctcggtacttacgcgacgcaggaggaggcggcaatggcgtacgacatggcggccatcgagtatcggggcctgaacgccgtcaccaacttcgacctcagccggtacatcaagtggctccggcccggcgccgacggcgcgggcgctccccagaatcctcaccccatgctgggtgctctgtcggcgcaggatctcccggcgatcgacctcgacgccatggcgtcgtcgttccagcacgacggccatggcgccgcggcggcggcggcacagctgatcccggcaagacattcgctcggccacacgccgacaacgtcggcgctcagcctgctgctgcagtcgcccaagttcaaggagatgatcgagcggacgtcggcggcggagaccaccaccaccagcagcacaaccacctcctcctcgtccccgtcgccgccgcaggcgaccaaggacgacggcgcctcgccgcagtgcagcttcccggaggacatccagacctacttcggctgcgccgccgaggacggcgccgccggcgcgggatacgccgacgtggacggcctgttcttcggcgacctcgccgcgtacgcgtcgccggcgttccacttcgagctggacttgtgacggcggcgccgccgctgccgcagccgagcagtgtcagcttgtgcctcgccagtagcccaacggccacggcgcaatacagttacaggccgttaattaaattctttaattgggtggatttggtccataggagaatgaccaaaaaaagagaaggaacagacgaacagacaaatggaaggcaggcaagaatgcaagatactcttatagcacaagctagtgcttacagagttaatgacagtattatagtgacaagctgaagaccgagaattacttcaagattgattttcttaccttgacaatccgaatgagagagagagagatagtgggtgtgtgacagtgtgaggagaggagattgtttcatttttgcttcatccctgacaaaatgaacaactatatagtatcttttttttttgagaacgactatatagtatctataatctacataaatacttgatagaaggatttgtgagtttctg

SEQ ID NO: 5910 - DNA, 1296 bp, Oryza sativa
  Predicted polypeptide sequence is orthologous to G979, G2106, G2131
atggatcatagcatcatgatggtgaagaatgagattgaaaactactcaggatcatctccagcaatgatcatcaatgcgctggaaggcggcgccgaggcgggcccggttgtcaggaggagaaggagggagccgtctttgctcgcaccgatcaatggtgatggtgacaccaatggtggtggcattggcaagtcgtccttgtcaggcatcactgtcaagaggagctctaggtttcgtggagttagcagattcagagcttgtagagatgacaagaagatgttgtcatgtaggcatcggtggacaggtcgtttcgaagcacatttgtgggacaagaactcgtggaatcctacacagaggaagaagggcaagcaggtctatcttggagcatatgatgaggaggaggcagcagcaagggcttatgaccttgctgctctcaagtactggggaccaactacctatacaaattttccggtaatggactatgaaaaggagttgaagataatggagaatcttactaaggaagagtatcttgcatctctaaggaggaagagcagtggcttctcaagaggtgtgtccaagtacagaggggttgcgaggcatcatcaaaatggaagatgggaagcaagaattgggcgtgttttcggaaacaagtacctctacctaggaacctacagcactcaagaagaggctgcccgtgcctacgacatcgccgcgatcgagtacaaaggcgtaaacgccgtcacgaacttcgacctcagatcatacatcacatggctgaagccaacccctgctcatgttgccatgaaccctgcagaagctcttgcaatgcagatccctgtagatcacttcctcccaatggaaacccagatgatgatgctccctcagagcaatcctttcacctcatatcacaatgcacaatcactgggtggtggtgacggtggcagtagcagtactaataatcaagaagcctccatgataatctctcccagtggctcatctagaaagagatcatcatccactgctcttagccttcttctgaaatcgtcgatgttcaggcagctggttgagaagaattcagatgcaggtgaagaaaatggaggtgagatgagagagccgggtgcccatccaggagaaggatatgaataccacaacttcttccagggagatgctgctccggacatggacatgtgtgatctgctttcatcaggaaatgtgcatgctgcaagtggtagtgctggatttgaagaggacatcgcatgttatagtggttttggaagcatgcagtcgctgcagcaatag

SEQ ID NO: 5911 - DNA, 2565 bp, Oryza sativa
  Predicted polypeptide sequence is orthologous to G987
ggggagttgggagttgggactccctgtgcctctcctctccaccgcaacgaccacaaatcaccatctgctttctagtttcttcctgaagttctgcgtcataaaggcaaaaatccaagattgattttggatgaaaaagactgcagtgcttagcaagtgttctgttcttggagtcgcaagctgcggctagctagcaagcaagcagcttttttttttttcgcagatcttggtgaagagcctgttcttccatggctttcgctttgtgagagaaaagggtattgttagtcagtaagtaaaagggtggatcttgttcgaagattcaagagtcatgttggattctggttcttatgatgatgttgactatggggatttgttctccatccccaatccacctgcgcctcacttgctcaatttccccctccagttcttcccttccaacggattcatcagttctgctgatgattcccatagatcaccagctggtatgtttggctcgaccccaagccccacatcaaccacaaccgagttggaaaattcagaggatctgtctgaatccgccgacgatgcggtcctagcatacatcaatcagtttcttcttgaagatgaggaagatgaatcttgtcctggcaccatcacatcggtggaggactctgccctcctcgccgtcgagaagccattcgttgacatcctcactgctagccaagaggcctgtcaagagaattcttggatagattcttgttgtgatttcacggggaatggaggattgcttgatacgttcacaaccacacatgccgcttgccagccagcgccttgtgaatttgagaaggagaagggggagtgtgctgttcataaaggccggaagaacccgcatgatgattgcctattgttagaggaagagagcaggaggagcaagcagttggcagtgtctgaggaggagactgtcagagagatgtttgacaaggtgcttctgtgtaatggcgaatgcgagctccgggcaccactgccagctgaagcacggaactgcggggtgtacgtgaaaggatctggaaataagagaggccgaaagaaaggaaaatctggagcatctgcagaggatgatgcggttgatctcactaccctactcattcattgtgcccaggccgctgcaatcgatgatcaccggaactccaatgagttgctgaaacaaattaggcagcgttcttctgcatatggagatgccggtcagaggttagcacattgttttgctaatgcgttggaggctcggctagctggcactggcagcaacatttaccgttcacttgctgccaagcgaacttctgtttatgacatattgaatgcattcaagctgtatgttacagcatgcccgttcaagaaaatatcgaacttcttctcgatcgaagccatcttgaacgcatccaagggtatgacaaggttgcacattgttgactatggtatacagtatggattccagtggccaatcttcttccagcggatctcgaagagacctggtggccctccaagtgttcgaatcaccggtgttgacttaccacagccgggattccgccctgcacaactcattgaggcgacgggccgtcggttgcatgactatgcccgtatgttcaatgttccatttgaataccatgctattgctgccaagtgggacactatccgtgtcgaagatcttaagatagacaaagacaaggatgaacttcttgttgttaactgccttttccggatgagaaacatgatggacgaaatggtgacagatgacagcccaagaatgcaggttctgaagacaataagagagatgaatccaaatttgttcatccatggcgttgtcaatggcacctacaatgcgcccttcttcgtgacacgattcaaggaggctttgttctactactcttcactttttgatatgcttgaaacaactgcttcacgggtcgacgaaaacaggctgctgatagaaagagatctcttcggccgggaagctcttaatgtggttgcttgtgagggcactgagagagtagaaagaccagagacgtacaagcaatggcaggtgaggaacatcagggcaggcttcaagcagctaccactgaaccaagagacggtgaagaaggcaagatacaaggtgaagaaatcctaccacagggatttcctagttgacgaagataacaaatggatgctgcaaggttggaaggggcgtatcatctttgctctttcagcatgggaaccaaactagcaaactgtaaatatgactaactcagctgatttcttctgtggaggtaccactccattagttatgtctgattcctatttcaatgaattttgacctatttctgggcaatagaagatattggattttgactgggctagagtatactttggatgagtatctgacagaaaaggatatacttctctctaagcgtgtgtgacctgtggggctcaaaactgtactttgaaaacacaattacacatcatgcatgtactgttcacatggtccagcctgggcaaagggttaaagcctacatggtgaattggtgatataaataacgaaatggtttatctgct

SEQ ID NO: 5912 - DNA, 2147 bp, Oryza sativa
  Predicted polypeptide sequence is orthologous to G987
aatccttcaatttaattgcacttgattaatagctagtgatagtggaaggaactggtaggcaatggctaccacgccggaggcggcggagtccctccgattccgatggccggcagcggaggaggagttcgacaacgacatggtcctcccctacatctcccgcctcctcatggaggacgacgtccacgaccacttcttctaccagtaccccgaccaccccgccctcctccgcgcccagcagccattcgcccagatcctcgcctcctccccctcctccgccgccggcgcctcgtcgtcgtcctcctcctccgatgccccgcccagccgccccttcttcgatgacgaggcggccaccgccaagactttccccactgctgcggtccacagcgttgaccaccagtactccggcggcctcgacatggtcaacatggcgttcctcaagggcatggaggaagccaacaagttcctgcccaccaacaccctcctcctctcgaccgactcttctactaccttgcagttgcaggttcagggtgaggtagtcgtcgacggacatggaatgctcgggggggtcgggggagcagctgcagctcatgctcatggtgcaatcaacagcaagaaagtcaactgcagggacgacgacttggaagctggcactggcagggccaccaaactgatggcgcccgagccggagctggaggaggaaggtgcacgccagatgttcgacgaaatgatgctccaggagcacgagatttgcatgaagggggtgaagcagctgagcctcaagtccaagagcagcagcagcaagaaggcgcgggggagacgcactgtgatccacaccgagccggtggacctgcacaacctgctgctccactgcgcgcaggcggtggccacggacgaccgccggagcgcgcacgagctgctgaggcagatcaagcagcactcgtcggcgtggggagacgccggacagaggctggcgcactgcttcgcgcaagggctggaggcccggctcgccggcacggggagccaggtgtaccagtcgctcatgtcgcagcgcacctccgtggtcgacttcctcaaggcgtaccggctgtacatggaagcctgctgctgcaagaaggtggccttcgtcttctccaacaagaccatctacgacgccgtcgccgggaggcgcaagctgcatatcgtcgactacggcctcagctacgggttccagtggcctgggttgctgcgcgagctcgcggcacggagaggcggcccaccggaggtgaggatcaccggcattgacctacctcagccgggattccgccctgaccaacacatcgaggagaccgggcggcggctgagcaggtacgccgacgagctcggcgtgccgttcaagttccacggcatcgcggcgacgaagaaggagagcgtgaggcgggaggagctgggcgaggcggaggaagacgaggtggtggtggtgatcagcctgtgccatttcaggaacgtgatggacgagagcctgcaggaggacagcagcaggagccccagggacgaggtgctggggaacatccgcaggatgcgccccgacgtgttcatccatggcatcatgaacggagcctacggcgcgacctacttcctgacacgcttccgggaggctctctactactacgcggcgcagttcgacctgctggacgcgacggtggggcgggagagccacgagcggatgctggtggagcgggacatcttcgggcgggcggctctgaacgtgatcgcctgcgagggcgcggagcgggtggagcggccggagatgtacaagcagtggcaggcgaggaaccagcgcgcggggctgaggcagctgccgctgaatccgcaggttgtgaggctggtgctggacaaggtgagggacaagtaccacaaggacttcgtggtggacgaggatcaacgctggttgctgcacaggtggaagggccgcgtgctctacgccttgtccacttgggttgcccaacactagctcttagcctcttaccaattatttataccaattttcagatatgcacatcataagtacaaccatgtctatgatcgatgtggaccatggttgagtaaaccctattgtatgtttcttgtatcacatttttgctcctccttggtcatggtgaccactgacc

SEQ ID NO: 5913 - DNA, 1992 bp, Oryza sativa
  Predicted polypeptide sequence is orthologous to G987
atgcaggaggacattgatgacagaggcaatgaagatactgctcttcaagctatggaggagcccttctatgaacttcttggagaaaagtatccggcattccctcagcaacaaccactttgtgtatgtgatcacctgcagaacctcagtgccaacactgacaagtctaatggtcacgcatgcaatacctggtctgtcactagaatgacaaacattagctcaagtatgaattccaatggcaactttcaagggtttcagtttccatggagtttgtcttccattactagagagacagaacagttcactcatcactcaaatagaatggttgttggtctaaaagtggatggcctttccatttccgaaaagcctagccaggacaattgttcacttcaaattgatgcgcattacatgaggaagcatccattgtttgaggttcatgatagaaaaagttatccgtgtattgaagatcttgatttgttagaaggaaggagcaacaagcagtatgctatttactatgatgaaccgattcgggatgagatgtttgacaacgttctactatgttctgatcataagcctctagatgaaggtgttagtttgagcagagccatgacaaacaattcaagcaagtcttcacaaattggacaaggaaaaacatcagctcggcgaaagacaacaggcaaaaggatacaaaagagagatgttgtggatctaagaaccctccttatcaattgtgcacaagcagtatctgtgagcaaccatagcctagctagtgacatactgaagataataagacaccatgcttcacctaccggggatgattcccaaaggctagcactttgcctagcgtattgccttgatgtacgattaacgggaactggaagtcagatataccacaagttcatcaccaaaaggaggaatgtaaaggatattctaaagggaaaaccacaggtccacattatagattttggcatttgctttggtttccaatggccatcactatttgaagaacttgcaaaaatagaagatggaccacctaagcttcggattactggtatagaattacctgagtcaggcttccgaccatatgctagaagaccagagaggattgagaggccagagagttacaagaagtggaaggtaagaaaccttaaggcaggactggtgcagcttccattgaatccagccatcgtcagagaaacacaagatatggtaagaaagggttatcacaaagattttcttgtcgacgaggaagatcaatggttagtgttgggatggaaaggaaggatactctatgcatcatccacatggcaaccaaatgattcaggacgccgtccccctccctcccaatccagtgcgatcgaacggccctcgatcacgagaacacctctgtcatggccgcacccacctgaagctgaaggtacatactggagtggagtggagtctgatagagtctatagagactgttctcttaacaatagagggccactatgcaacggaatcccgtttttaaacgggatgataccggtatcagatgacttctaccacgtatcaggtgatactcgtgagatatcatgtgatacctatcaggtattagacgatttctaccacgtatcgggtgatacttacgagatatcagatgatacctaccggatatcagcgtcctccgccgccatgcgccacgccgggctcgtcgctagcggccacgtcctccgttgtccatgcatcgcgtcgcgtcgaagctcgttgccagaggctgcgtcctctgccatccatagccacgccacgccgggagctcgtcgccggcggccacgccggagctcgtcactggaggctgcatcctccgccgtccatagccatgcgccggagctcatcgtcggaggttgcatcctccgtcgtccacaaccatgccacgccgggagctcatcgcttgagactgcgtcccctaccatccacaccccatgctacgccggagctcgtgcagcagtcatgctttga

SEQ ID NO: 5914 - DNA, 3032 bp, Oryza sativa
  Predicted polypeptide sequence is orthologous to G987
aacctgcgcctctcgaaaacactggtccgcctccgttcccctctcctctcggctctcttatctcacccttcgtttcgctcgtctccctcccgccgcagcaggtggggggattcgagtgttgggaggtttgcatgctctgtggtggcggtagagttggtggtggtggtggatacagatggtcatggatgctggggtgcacgacgtgtgcacgatgctgcccggatccaagcgcgacgcgcacctgccgctgccaatctacccccaaatcgccgccgccaatgggttcgcgacggcggaggagttcgacccgctgctgttcctttcgcccgatgcggtttgcggcggcggcggcgactacctgaatattgtctccgcgcagcccatctcggcggcctccaccaacggcgcgtcgccgccgagagatgtctcggtctctgcttcggcggcgtcgtcggcggcggcgcagcatgacgactccgaggctctctcggatatcgtcctggggtacatcaaccgcatgctcatggccgaggacatcgacgagaagttcgagcactacccggtgaacgccgatgatctgctcgccgccgagaagccgttcctcgagatcctcgccgaccggtcgccgtacttgggcggcagctcggtcgagagtcccgacggcagcagcgccgccaactcctgtaacagcctcagtccctgcaactgtagctcgtcctccgacgggcttggcgccgtgccgcagacgccggtcctcgagttccccacggccgccttctcgcagacgccccagctgtacggggatctgatccccacggggggcatggtggaatcgggcggcgcctggccgtacgacccgacggaattctatcagctctagaccaagccggttcgtgagaacctcccgtcgcaatcttcgtcgttcgcgtcttcgaacggcagcagtgttactttctcagaaggattcgagtcgttgctgagcccggctggtgtcttgcctgatgttagcctgaatgattttgttgtgcagaaccaacaggctttgcagttccgccgcgggtttcaagaggcaagcaagtttcttcctgatgagagcaagcttgtgattgatgtggataagctctacagtggagatgaggggagtaggttccttggtgaggttagacaagagaagaagcttgtgaaggtgaagacagaaacctctgatgttgaatcagcaggtcaccgaggaaagaagcatttctatggtgatgacctggatgcggaggaagggaggtgcagcaagcattccgcgcaagggattgacactgaccacctagtgagggatttgatggacaaggtcttgctatgcaatggtgagacatgctcaaaaggtgttaaggagttgcgtgaggctctgcagcatgatgtggcgaaacattcaggcggaggccatggcaaagggtccagccatggcaagggtcgtggaaagaaacaacccaagaaggaggtggttgacctggagacccttctcatccattgtgctcagtctgtggccactgatgacaagcgcagtgcaactgagctcctgaagcagatcaggcagcatgctcatgccaatggtgatggtgatcagcgtttggcacactgcttcgccaacggcctcgaggcgaggctggcaggtactggtagtcaaatttacaagaactacacgataactcggcttccatgcactgatgtgctgaaagcgtaccagctttatttggcagcttgcccatttaagaagatctctcattattttgccaatcaaacaattttgaatgctgtggagaaggccaagaaagttcacattgtcgattatggcatatactatggatttcagtggccgtgtcttattcagcggctatctaacaggcctggaggcccaccaaagcttaggatcactggaattgacacacctcagcctggtttccgcccagcagaacgcacagaggagacggggagatatctaagtgattatgctcagaccttcaatgttccttttgaattccaagctattgcgtctcgatttgaggctgtccggatggaggatctccacattgaggaggatgaggttctgattgtcaactgcatgttcaaattcaagaatttgatggatgagagtgtggtggctgagagtccaaggaacatggcattgaagacaattaggaagatgaacccacatgtgttcattcatggggtggtgaatggatcttacaatgcaccattttttgtgacacgcttccgggaggccttgttccactattctgctatcttcgacatgttggagactaacattcccaaggataatgagcagaggttgctcattgagtctgctctatttagccgggaggcaatcaatgtgatctcttgtgagggactggagaggatggagaggccagagacatacaagcaatggcaggtacggaaccagagggttgggttcaagcagttgccattgaaccaggatatgatgaagcgtgcgcgggaggaggtcaggtgctaccacaaggacttcatcatcgatgaggacaacaggtggttactacaaggatggaaagggcgcattttgttcgcactgtcgacatggaagccagataatcgatcatcttcatagcttgttcagctctaattattgcatgatattgtaaatgtagacctgttcatatttttttggggggcatttggaccgattgttcctggtaggcaatatattgctaggtatgttatttgaacaaccaagtaatgggaaacttctgcttaggaattgtcctatatgatgatctggttcatctctgtccgtacataagatgaacccgcctgttcctagaatctctgcacatttgttgtgatcattattgttgcttccgacgggaacagttggttcaattttggtggagctgctagatatgttgaagttgtagaccttgggttgtcttatgtatggatgagccttgtacagtatttcttccaaacattcagtacttgtcactaagttctggttctggataatc

SEQ ID NO: 5915 - DNA, 1583 bp, Oryza sativa
  Predicted polypeptide sequence is orthologous to G989
tttgcagtggttttgccacggagaagggtcacctgggaaattattgtttaggctgacgtgatgctccagggagtcctgtcgcgagctcccggcgccgacgcggcagcgatgaaggcgaagcgcgcggccgacgacgaggaggaaggcggcgagcgggagcgcgcgcgtgggaagcggctggctgctgaggggaagcaagggttagtggtggtgagtacgggggaggaggaggaggcggcggcggagacgcgtgggctgcggctgcttagtttgttgctgaggtgtgcggaggcggtggcgatggaccagctgccggaggcgcgggacctgctgccggagatcgccgagctggcgtcgccgttcgggtcgtcgcccgagcgcgtcgcggcctacttcggggacgcgctgtgcgcgcgcgtgctgagctcctacctgggggcctactcgccgctggcgctccgcccgctcgccgccgcgcagagccgccgcatctccggcgcgttccaggcgtacaacgcgctgtcgccgctcgtcaagttctcgcacttcacggccaaccaggccatcttccaggcgctcgacggcgaggaccgcgtccacgtgatcgacctcgacatcatgcaggggctgcagtggccgggcctcttccacatcctcgcctcccgccccaccaagccgcgctcgctccggatcaccggcctcggcgcgtcgctcgacgtcctcgaggccaccggccgccgcctcgccgacttcgccgcgtcgctcggcttgcccttcgagttccggcccatcgaggggaagatcgggcacgtcgccgacgccgccgcgctcctcggcccgcgccaccacggggaggccaccgttgtgcactggatgcaccactgcctctacgacgtgacgggctccgacgccggcacggtgcgcctgctcaagagcctccggccgaagctgatcaccatcgtggagcaggacctcggccacagcggcgacttcctgggccgcttcgtggaggcgctgcactactactcggcgctgttcgacgcgctgggcgacggcgcgggggccgccgaggaggaggcggcggagcggcacgcggtggagcgtcagctcctcggcgcggagatacggaacatcgtcgccgtcgggggccccaagcgcaccggcgaggtgcgcgtcgagcggtggggcgacgagctgcggcgagcggggttccggccggtgaccctggccggcagccccgccgcgcaggcgaggctgcttcttggcatgtacccatggaagggctacactctcgtcgaagaggacggctgcctcaagttcgggtggaaggacctgtccctgctcaccgcctcgtcgtgggagccgacagacggcgacgccgacgccgacgtcgccgtcgccggcgatacccaccatgagagccacgattcttgatcacatgatcgcagtagcagccaggtcgattcacctgtcgcagctttttttggtcatattcattatcctctttctgctagctacttcattcgatcgttcttcctcctgtgagtagtattttggccgatgattaagcttgtaatataatc

SEQ ID NO: 5916 - DNA, 678 bp, Oryza sativa
  misc_feature (678)..(678): n is a, c, g, or t
  Predicted polypeptide sequence is orthologous to G991
ttttttttttttttttttttttttttttttttttttacgaaaaaaatcatatgttattcatggagatcgatataaaaacactgaaatggcacaaggacaatattattctacccctggtcaggagtaacaactgcaacgcttaatttttttaaccgatgccatttcagcacttaaaagctaattaaaacattattagtctcttacaagggtagcaacaacggatgatggtagcagcatatatttggagctaattaaaagcggcagagaattaattattggagatagatagattggacgaaatgacgcggttgcagctatgcttgcgatagccatgtagctatatcaggcgaagcttgggtcatcgttgctcgcggatcccgcaacatcgtcaacggcgtcagctgcagaagcaacgccatcgtcagcagcaactccatctccatgttcggcagcagtagcagaagaagcccggttggcctcttcctcctcctgaaatgattttcattctggtgttcggcaggggacaatggagatgtttttgactgggggggggagaacctcccatgggacatcaccaaggaagcaccgacccccttccatttttgcgcacaagagggtcaaggactgtgatattgggaccatgtttttacttgttaccaagatgcaataagtgttggn

SEQ ID NO: 5917 - DNA, 1414 bp, Oryza sativa
  Predicted polypeptide sequence is orthologous to G1013
ctgatcctatcttggaagaattaagcaagtagcagcagcagcttaggttgatcatatggatggtgcgatgcaagagagcagagagtattggcgcgacggcggcgatgtcgtcggagaggagctcttgagggagatcctcgatgagaccgccgcggtgcattccaattccaattccaattcaaattcaaattccaattcaaaggaggcggaggaggaggatgagagagaatattttgccgcagctgcagcggatgagcagctgcaggtggaggctccttgcgggcggcggcggcgggagtcgatggtgaacaagctcatctccacggtgtattctgggccaaccatcagcgacatcgagagcgctctctccttcaccgccgccggcgaccatcagctactcgccgacggtcacaatttcgctgcaagtagctgtagcccagtggttttctcgccggagaagacgttgagcaagacgatggagaacaagtacacactgaagatgaaaagctgtgggaataatggtgggctcgcagatgatgggtacaaatggagaaagtatggccagaaatccattaagaacagcccaaaccccaggagctactaccggtgcacgaatccgcggtgcaacgcgaagaagcaggtggagcgagctgtggacgaacccgacactctgatcgtcacctacgagggtctccacctgcactacacctactctcacttcctccactccacttcttcctcctcgtcgtctactaccacccaacaacaactgcagcctcagcctcagatgatgaccaactgcaagaagaagcccaagctgcacctgcacccgctgctgcacgacgacccacccccacccccaccgccgccggaaatgacgaccatgatgataatgcagagcttcagcatccagcaacaacaacatgatgatgatcagctgctgcagcctgctgcagatgatcacttgatggtgcaggctccccccgatgattgttacaatattaacggcagcagcagcagcggcttgatgatgagcttggacgacgacgagcaggccgccggcgccggcgggctactggaggacgtggtgcctctgctggtccgccgcccgccgccgcccatctgcaacaacaacaactactactactcgccggccaccacctgcacctctgacaacgagtacggctcgtcggcgtcggcgtcgccgtcctcctccgtctccgtctccagctggactactcccatgtctccctgcatcgacatggccatactctccaacatcttctagctatattcaaattaatgaaatttcatctagtattctctagctagctagctagtcgatctagtacttacaagatatatataggtatgtatgcgtactgtacgtacgtagctagtgcagcacgtatta

SEQ ID NO: 5918 - DNA, 636 bp, Oryza sativa
  Predicted polypeptide sequence is orthologous to G1013
atgtatggccaatcccctcacaagcaacgacggcgttttccaggaccatatctgatgggagatgtgctgcgagctcaggccaccgcgtcggcggaggaggtggccggcggcgtctggccctgcgagctcgacgaccacctcataggcgagctcctcggtgacgacggcctgttcgtcccggccgccgaacaccccaccctctactactcgttcggcgcggggtcatcagcagccgccgccgccgcgccgtgcaacgggggcggcagcgctgatcacgagcggcggccgcggccggcaccggcggtgagcagggatctgtgctcggtgtactcaggcccgacgatccgcgacatcgagaaggcgctgtcgtcgtcggcgtcgccccggccgccgtacccctccggccgccgctacagctctctgtatttggtggaagcggagagcaagtacacgagcaaggtgaggagctgcggcggcaagatgccggccgacgggtacaagtggaggaagtacgggcagaagtcgatcaagaacaacccacatcccagagaagtttctcttaaattactcatccgatttataatccgattacaccgttgtgttcgtaacaataaaatccgatttaatccgatttag

SEQ ID NO: 5919 - DNA, 2826 bp, Oryza sativa
  Predicted polypeptide sequence is orthologous to G1017, G2567
gtggaaaccacctcattagtcatcccatcgagttgggttgagagatgctcaccttcatggagctcgcggggccgacggaaggcgacggcggcgggtccgtggactcccagctgtgggcggcgtgcgcggggagcatgtcgtcggtgccgcccgtgggcgcggcggtgtactacttcccgcagggccacgcggagcaggcgagcgcggccgtggacctgtcgtccgcgcgcgtcccgccgctcgtgccgtgccgggttgtcgccgtgcggttcatggccgacgcggagagcgacgaggtcttcgccaagatacgcctcgtcccgctacgccccggcgacgcggtggtggacgtgggcgaggcggccgcggccgaggcgcggcgggaggaggagaatagtaggccgaggccgacgtcgttcgccaagacgctgacgcagtccgacgcgaacaacggcggggggttctccgtgccgcggttctgcgccgagaccatcttcccggagctggactacagcagggagccgcccgtgcagtccgtctgcgccaaggacgtgcacggtgtggagtggacgttccggcacatctaccggggcaccccgcgccggcacctgctcaccacggggtggagtcccttcgtcaacaagaagcagctcacggccggcgactccatcgtgttcatgcgtgacgagggcgggaacatccacgtcgggctccgccgcgctaaacgcgggttctgcagcatcggcggcgacgacgagagcctctcctcgattcccgggtgggaccagtacaggggcttgatgcggcgcaatgcgaccgcgaccgcgaccggtgggagaaccccgcccaaggggaaggtcccgccggagaacgtgctcacggcggcgacgagggccaccaccgggcagccgttcgaggtgctgtactacccgcgggcgagcacgcccgagttctgcgtgagggcggccgcggtcaggacggccatggccgtgcagtggtgccccggcatgcggttcaagatggcgttcgagacagaggactcgtcgcggatcagctggttcatgggcactgtcgccggcgtccaggcctccgaccccgtccgttggccgcagtcgccatggcgtctccttcaggtacacctacacggcaccaacatgagacaaccccaactcgatcacgatagagtcgtagagttcttgatcaattggcctcctcgcaggtgacctgggacgagccggagctcctacagaacgtaaagcgcgtgtgcccgtggctggtggagctcgtgtcgagcatgcccaacctccacctgccatccttctcgccgccgcgcaagaagccgcgcaacccgccttacgcggagctccccctcgagggccagatcttcaccggcccggtgttcccgcccaatccaatggcgcacgaccaccaccaccaccatggtttccctttcctccccttcccggacagtagtgctcaacctgcaggcatacagggagccaggcatgcgcagttcgcttcaccgttcccggagttccacatcggcaacctgcagccgaatctgatgctctacgccggcatccgcctcccgcccgccgatcgcgccgcccccgctcctcgcccgccgagaatcatcatcagcaccgacctgacgattggcagcccgggtaaacccgacgacgccgcgtgctctccctcatccggcggcaagaagatcgacgacaccaagccgcgggggtttctcctctttggacaggcaattctaaccgaggagcagatcaagaacggcaactccgatggtcgtccggcctcgccgaactgggacgccgagaaggcgcctaacacctcggaaggctccgactccggcgtcacccagggcagccccaccaagaacaccacgccgtcgtggagcctaccgtattttggaggcaacaacatcagccgcgcatccgagtacgagctgaatcccgggcagtgcaaggtgttcgtcgagtcggaaaccgtcggccggagcctcgatctctcggcgctgagctcgttcgaggagctgtacgcctgcctgtctgatatgttcagcattggcagcgatgaactgaggagccatctggtgtaccgcagccccgccggcgaagtcaagcacgccggcgacgagccattctggtgagcacactagccgttcgcccgttcctcgtcaatactagttgtatttaccactcggttatcaattcttgatctgaaacttagcgacttttctgtcatttgcagcgcgttcgtgaaatcggcgcgtaagcttaggatactgactgatgctggcagtgacaacctgggagattagaagaagtaataaatcagccgaataacttagggcgctactcctagtcttttagaagcaaaaataagccgagagctgcatgcacgtacagctgcatgagctgcggtttctccttgctccagtccagtctagagatttttattcagggtaaagctgatgcagtcttcagttaattaggtgttttttagtcctttttacagctttctcgctaggggtttcaggtaacaactactagcgcaaagtgcagacagaatgtagtctttgcaccttggtcatcaaatcaaatgtactggtacttcttttattctcattcggcggatattgagccttaatttgtttcacgaaattgaatgcttctgccgcaccagaccaaggtgacaggattagtgcaggtgcaggcttacctgtatgcagtaattactatctgccggaatatttactcggcgctggcactgctgattctgaattctgtatagaggctctcagctccaggc

SEQ ID NO: 5920 - DNA, 3026 bp, Oryza sativa
  Predicted polypeptide sequence is orthologous to G1017, G2567
gtactcctcttctcctctctttctctctcctttcccctctctctctctctctatttagttcttttgcccccatgtcagctgcagtctgggggaatctgaggctgctgctcacctgggagactgaaaggaggcagaagcagcagcagcatcagcatcagcagcagagcagatagctgagctgcagagggggaggagagaagatagtagtggtagtagtagctgagctgtgtcaagattgcccttcaaattcatcatcttttgctcttgtgagaaaaggtgagtagtggtttctgggttgcgtctccctttttctgcaagatttctgagccaaaattctctcttttgctcgctttgttcccttttctttcttttctttttttcccttcttcctcctttctgctctgctggttggttggttctttctcctcccccagcctttttcagctatgagctctgattgatgatgacgatgatggcggctgtgcagctgaaaagcttcttcaccttgtggtagtggtaaaagctgtgggaaatttcatccataaagatcgccgtggcgctcgaattccgctgaattttgtttgtgctcgagctgatcggtggaggtgaaagatttttgcgtcgaagagatgataactttcgtggattccgcggcgaaggagcgggagcgggagagtgacaagtgcttggacccgcagctgtggcacgcctgcgccggcggcatggtccagatgccgccggtgagctccaaggtgtactacttcccgcaaggccacgccgagcacgcgcaggggcatggccccgtcgagttcccgggcgggcgcgtcccggcgctcgtgctctgccgcgtcgcgggcgtcaggttcatggccgatccggacaccgacgaggtgttcgccaagatccgcctcgtccccgtccgcgccaacgagcagggctacgccggtgacgccgacgacggcattggcgccgccgcggccgcggcggcgcaggaggagaagcccgcgtcgttcgccaagacgctcacgcagtccgacgccaacaacggcggggggttctccgtgccgcgctactgcgccgagaccatcttcccgcgtctcgactactccgccgatccccccgtccagaccgtcctcgccaaggacgtccatggcgtggtctggaagttccgccacatctaccgcggcacgccgaggcgccacctcctcaccacggggtggagcaccttcgtgaaccagaagaagctcgtcgccggcgactccatcgtgttcatgcgcaccgagaacggggatctctgcgtcggcatccgccgcgccaagaaagggggcgtgggaggcccggagttcctgccgccgccgccgccgccgccgccgacacctgccgccggcggcaattacggcgggttctccatgttcctgaggggcgacgacgacggcaacaagatggcggcggcggccaggggcaaggtcagagcccgtgtccggccagaggaggtcgtcgaggcggccaatctcgccgtgagcgggcaaccattcgaggtcgtctactacccgagggcgagcacgccggagttctgcgtgaaggccggggcggtcagagcggcgatgcggacgcagtggttcgccggcatgaggttcaagatggcattcgagacggaggactcatcaaggatcagctggttcatgggcactgtatcggccgtgcaggttgctgaccccattagatggcctaattcaccatggaggcttcttcaggtttcatgggatgaaccggacttgttacagaatgtgaagagggtgagcccatggttggttgagcttgtgtcaaacatgccggccatccaccttgctccattctcgcctccacggaagaagctttgcgtgccgttgtaccccgagcttcccatcgacggccaatttccgacaccgatgttccatggaaacccgctcgcccgtggggttggtcctatgtgctatttcccggatggcactcctgcaggcatacagggagccaggcatgctcaatttggtatatctttatcagatctccaccttaacaaactgcagtcgagtctatcgccccacggccttcaccagcttgatcacggcatgcagccgaggatcgccgctggtctaattatcggtcatccggctgctcgggatgatatctcatgcttgttgaccattggtagcccccagaacaacaagaaatcagatggcaagaaggcgccagcccagctgatgcttttcggaaaacccatactcacagagcagcagatatccttgggtgatgctgcttcggtggatgttaagaagagctcttctgatggtaatgctgaaaatacggtgaataagagtaactccgatgtttcaagcccgagaagcaatcagaatggcaccacagataatttgtcatgtggaggagttccattgtgccaagacaacaaggtacttgatgttgggctggaaacagggcactgcaaggtattcatgcagtcggaggatgtcgggcgcacacttgatctctctgttgttggttcatatgaggaattataccggcggcttgctgacatgttcggcatcgagaaagctgagctgatgagtcatgttttctaccgtgatgcggctggggcactcaagcacactggagatgaacctttcagcgagttcacgaagacggcgcgtaggctgaatatactaacagatacaagcggcgataacttagcgaggtagggtaaattaaagctattctcaattgtacagctggtggagcacggtggcaattttgaaggcaaaaattgccggtttcctagtactggtgcaatttcaaggaggcaattcagttttctttaattagagctcccagaatgggattgactgtaatccggtacccatatttatcggcagatttaccagactggatctatcctactgtcatgtaaaccgatcatattgcatttgatcgttggtgtgtactcggccatgaaccgttactaaacgaatgcgattacgggaatttttgcgcgc

SEQ ID NO: 5921 - DNA, 2355 bp, Oryza sativa
  Predicted polypeptide sequence is orthologous to G1017, G2567
atgaaggaggtgggggaggtggaggaggtgaggtgcttggacccgcagctatggcacgcgtgcgcgggcgggatggtgcagatgccggcgccgcgttcccgggtgtactacttcgcgcagggccacgccgagcacgccgacggcggaggcggggcggcggcggcggccgcggagctggggccgcgcgcgctcccgccgctcgtgctctgccgcgtcgaaggggtccagttcctggccgatcgggactccgacgaggtgtacgccaagatccgcctcgcgccggtcgcccccggggaggccgagttccgggagcccgacgagctctgcccgctcggcgccgccggcgacgcggcggagccgtcgccggagaagccgacctcgttcgccaagacgctcacgcagtccgacgccaacaacggcggcggcttctcggtgccccgctactgcgccgagaccatcttccccaagctggactacagggccgacccgccggtgcagacggtgctcgccaaggacgtccacggcgtggtctggaagttccgccacatctaccgcggcacgccgcgccggcatttgctcaccaccgggtggagcacgttcgtgaaccagaagaagctcgtcgcgggggactcgatcgtgttcctgcgcaccaggcacggggagctctgcgtcgggatacggcgggcgaagcggatggcgtgcggggggatggagtgcatgtcggggtggaacgcgccgggctatggcggcggcggcttctcggcgttcttaaaggaggaggagagtaagctgatgaagggccatggtggtggtgggtacatgaagggcaaggggaaggtgaggatggccgatgtcgtggaggccgctagcctcgcgtcgagcgggcagccgttcgaggtggcgtactacccgagggctagcaccccggattttgtcgtgaaggctgcgtcggtgcaggccgcaatgaggatccagtggtgctccgggatgaggttcaagatggcttttgagacagaggattcatcaaggattagctggtttatggggacaatatcttctgttcaggttgctgatcccaacagatggccgaattcgccgtggagacttcttcaggtgacatgggatgaaccggacctgttgcagaatgtgaaatgtgtcagcccatggcttgtggagcttgtgtcaagtattccaccaatccatttaggaccattttcgtcacctcgaaagaagttgcgggttcccccacatcctgacttcccatttgagggtcatcttctgaacccaattttccatgggaacccacttggtcctagcaacagcccactatgctgttacccggacaccgctcctgcaggcatacagggagccaggcatgctcaatttggtttaccactaacagaccaccagcttaacaagctgcaccttggtctgttacatagcggcagttttaacagacttgatgctattactccaccttcccggatatcaaagggctttgtggtcagtagtgcaccagcccatgacaatatctcttgtttgttgtcaatcagtacaccacaggtcgcagagaaatctgatgacagaaagacgacaccccatataatgctgtttggaaaggctatatttactgagcagcagataacttcaagcggatcaacagagacactctcccctggagttactggaaatagctcacctaatggcaatgcgcacaagacaggaaatgcatctgatggttctggttcatcaatttgcattggtttctcatctcaaggtcacgaggcttctgaccttggtttagaagctggtcactgcaaggtatttatggaatcggaggacgttggtcgcaccattgatttgtctgtctttgggtcatacgaagaactgtatggtcggctggctgacatgttcggaatcgagaaagaagaaatcataaaccatcttcatttccgtgacgcagctggtgtagtcaagcatccgggtgaggtaccattcagtgacttcatgaaagcggcacggaggcttacaataatagccggcgacagggagagaattgagagacctctcatcgaatgcttagttgagcaggcgtgatagttcaataaactcccgtttgaatttaattctgaaatatgaatcgtagcgtgaaaagacttcctttgttacatgtacttgcgttgggctgttaactaagcagacctgctttgtattgtcagtgttgtggattgctcaagttaaggtgtgtgtgtttttatcttgcctcggttagctgtcagtttctttgttgcaatcagtggtcatgttcttctgttcaagttcgtaaaccaaacacttggatgaatcttagtcaaa

SEQ ID NO: 5922 - DNA, 2046 bp, Oryza sativa
  Predicted polypeptide sequence is orthologous to G1017, G2567
atgatcacgttcgcggacctggcggagccggcgcccggcgccgagcggtgcgtcgaccggcagctgtggctggcgtgcgcggggggcatgtgcaccgtgccgccggtgggcgccgccgtgtactacttcccgcaggggcacgccgagcacgcgctcggcctcgccgcgccggagctctccgcggcgcgcgtcccggcgctcgtgccctgccgcgtcgcgtccgtgcggtacatggccgacccggacaccgacgaggtgttcgccaggatccgcctcgtgccgctccgcgccgcggaggatggggacgtcgaggaggatggcgccgcggcaggcgaggagcacgagaagccggcgtcgttcgccaagacgctgacgcagtcggatgccaacaacggcggggggttctcggtgcccaggtactgcgccgagaccatcttcccgcgcctggactacgccgccgacccgcccgtgcagaccgtcgtcgccaaggacgtccatggagtcgcctggaacttccgccacatctacaggggcacgccgcgccggcacctgctcaccacggggtggagcacgttcgtgaaccagaagaagctcgtggccggcgactccatcgtgttcctccgcggcgacggaggggacctgcacgtcggcatccggcgcgccaagcgcgggttttgcggcggcggaggcggagccgaggaggcctccctgcccgggtgggaccagtacggcggcctgatgcgaggcaatgcgagcccgtgcgcggccgccaaggggcggggcaaggtgcgcgcggaggacctcgtcgaggcggcgaggctggcgaacggcgggcagccgttcgaggtcgtgtactacccgcgcgccagcacgccggagttctgcgtgcgcgcggcggcggtccgcgcggcgatgcgggtgcagtggtgccccgggatgcggttcaagatggcgttcgagaccgaggactcctcccggatcagctggttcatgggcaccgtcgccagcgtccaggtcgccgaccccatccgttggccgcagtcgccgtggcggcttctccaggtgacctgggacgaaccggacctcctccagaacgtgaagcgggtgagcccatggttggtcgagctggtgtcgagcatgccggccatcaacctctcgtctttctcgccgccgcgcaagaagccccggattctggcgtacccggagttccccttcgaggggcagctcctcaacccggcgttcccgccaaacccgctggcacacggccaccaccattaccatcacaaccacccgtccttcttcccgttccccgacgttagtgctcctgcaggcatacagggagccaggcatgcgcaatttggtccatctttatcagatctccaccttacccacctgcagtcgagcctcatgtacccggggctccgccgccccgatcatgtcggtccaacatccatcccgccaccaagaatcagcactgacctgacaatgggcagctcgccgccggcgcgcgctctgtccatgggcgccaagaagcccgacgacgccaagccgccggggctaatgctgttcgggcagaggatactgaccgagcgccagatgagccttagcggcaccacctcgccggcggccaccgggaacagctctctcaactggaacaccgagaaaggtgcctcggagggctcgggctccggcgtcatccagaacagccccaccgacaacacgtcgtcggagaggctccagtggttcagggagaacagcaccgtctccgagctcgggctggagcccgggcagtgcaaggtgttcatcgagtccgacacggtcggccgcaacctcgacctctcgtcgctggcctcgttcgagcagctctacggccggctgtccgagatgttctgcatcgacagcgcggagctgaggagccgtgtgctctaccgtggcgccaccggcgaagtgaggcacgccggcgacgagccattcagcgagttcattaagttggcgaggaggcttaccatactaaccgacgccgggagcgacaacttagggagctag

SEQ ID NO: 5923 - DNA, 628 bp, Oryza sativa
  misc_feature (613)..(613): n is a, c, g, or t
  Predicted polypeptide sequence is orthologous to G1017, G2567
gatgttaccgtgggaacggcagccaaaagccaccaccaccaacctctcgtcttcgcctcctctcccaccccctcacgacgaacactcacacggtcacaccactacccctgcgagatcggttgctggcgctgctgctggtggtgggtgcgtggcgatgatcacgttcgcggacctggcggagccggcgcccggcgccgagcggtgcgtcgaccggcagctgtggctggcgtgcgcggggggcatgtgcaccgtgccgccggtgggcgccgccgtgtactacttcccgcaggggcacgccgagcacgcgctcggcctcgccgcgccggagctctccgcggcgcgcgtcccggcgctcgtgccctgccgcgtcgcgtccgtgcggtacatggccgacccggacaccgacgaggtgttcgccaggatccgcctcgtgccgctccgcgccgcggaggatggggacgtcgaggaggatggcgccgcggcaggcgaggagcacgagaagccggcgtcgttcgccaagacgctgacgcagtcggatgccaacaacggcggggggttctcggtgcccaagtactgcgccgaggaccatcttcccgcgcctggactacgccgncgaaccgcccgtgca

SEQ ID NO: 5924 - DNA, 394 bp, Oryza sativa
  Predicted polypeptide sequence is orthologous to G1020
ttttttttttttcttcatactaatataaaggaatacatcccctccacggtttagtccatctcatcgccggcatgatctgttctaattaacaaatcccaaaatgaatttcgccctcggcaaaaaaactatttacaaggcttttccgtttttcacaggctactaaacgaaaacccagaggaccaaaacttcggagagaaatttccttcaaagaaaaaaataagagagaaactccaaagtcgtcagctaacccatcctgagctagttctttaccggggggggccggttcaaatccaaatcgaaagctgccgccttgttccccgtaaccgttggaggtgacggcccaaaatcaaccaccgacgaggagtcggagtcactttgtgcaaccgccgccacg

SEQ ID NO: 5925 - DNA, 1116 bp, Oryza sativa
  Predicted polypeptide sequence is orthologous to G1020
gcacgagcccaaacccaacctcccaaaacacccacccggtttaccagagatccgcgcccgccacttgtaaacctgctgtacccatggcgcccagagcagctacggtggagaaggttgctgtggcgccacccaccgggcttggtcttggcgtcggcggaggtgtcggagccgggggtcctcactacaggggcgtccgcaagcgcccgtgggggcgttacgcagcggagatccgtgaccctgccaagaagagccgggtgtggctcggtacctacgacacggcagaggaggccgcccgcgcctacgacgccgccgctcgagagttccggggtgccaaggcaaaaacaaactttccgtttgcatcacagtcgatggtcggctgtggcggcagccccagcagcaatagcacggtagacaccggtggcggcggggttcagacgcctatgcgggccatgcctctgccgccgactctggacttggatttgttccaccgcgcggctgctgtgactgcagtcgccggcaccggcgttcgctttcctttcagaggatatcccgttgcacgtccagcaacgcatccatactttttctatgagcaggctgcagcggttgccgcagctgaggctggataccgtatgatgaagcttgcaccgccggtcaccgtggcggcggttgcacaaagtgactccgactcctcgtcggtggttgatctcgcgccgtcacctccagcggttacggcgaacaaggcggcagctttcgatctggatctgaaccggccgccgccggtagagaactagctcaggatgggttagctgacgactttgtagtttctctcttattttcttctttgatggatatttctctccgatgttttggtcctctgtgtttttgtttagtagcctgtgagagacggaagagccttgtaaatagtttttctgccgagggcgaaattcatcttgggatctgttaattagaacagatcatgccggcgatgagatggactaaaccgtggagtgtatgtattcctttatattagtatgaagaaattattcagaaagtcacaaaaatatctgtgcacactgagtttgattgacgtttttaaaaaaaaaaaaaaaaaaaaaa

SEQ ID NO: 5926 - DNA, 1451 bp, Oryza sativa
  Predicted polypeptide sequence is orthologous to G1020
tttttagcaaaacagagtgaaaagattttttcttagaagggtttctacatagtttctcatgactatcaaaataataataatacatatataatcccgctccataacaacgccggcaggatatgtcttaggtgacacacatggtgtgatcttctcttaaactacatcgccggcgaaaaaaactatttacaaaaatgtcttccctcagttaagcaagagggtctaggcataagaggtacacggaatttttctactactaaaaattaaaaagaaagaaatgaactagcggtcatcatgtaaaaactccggctgctagacctccatcggcggcggacagttcagatcaagatcaaaagcgatggctttcttcgccaacgcggcgggcggtgatggtgccagatccacgatcgacgaggagtcggagtcgctctgtgccaaggcggccacggtgaccggcgccggcgcaatcttgagcatgcggcaaccagaggcggcggcggcggcggccgcttgtccaaagaagtagtaagggtgcgatacggggtagccctcgaaagggaaacgcatgccgcctgcgccggcggccgcggccgctgcggcgcggtggaacaggtcgagctcgagcgacggcgggatcggcatggccttcatgggcgcctgcacgtcgctgccgaacgactcgacggtgctgctgttgctgctgccgctgttcacaccggcggcgggcgcgccgttagggtaggggaagttggtcttggccttggcaccgcggtactcgcgcgccgcggcgtcgtaggcgcgcgcggcctcctcggccgtgtcgaacgtgccgagccacacgcggctcttcttggccgggtcgcggatctccgccgcgtaacggccccacggccgcttcctcacgccacggaagtgctggccggtgcccacggcggcggctccggcgacaccgcccacgccaagcgcgagtccggtggccgcggccgccggtgacatagtcttgtccgacgttctcggcgccatggcgatctttcttttctccgtgtttctttcttggtgcgcgctgatggtgcggtgcggatgcgggtgcagctgcggtgttgcggcaggagtatacaagcacatcacaggtggcatgatgggtggtcatgctgccaagttgattggatggggaaccacggatgctggcgaggattacttggctgcttgcaaaccagtggaacagaggatggggcgatgatgggtacttcaagatcataaggggcacaaaccgaatgtggcatcgaagaagatgttgttgctggtatgccctcgacgaagaacatggtgaggaactatgatagcgccttcggagtcggaacggccatagtttgacttaatcaaatttacatgatcccaaccgtattgagccataaccgacgcgtggcgacgcgtggtcgacccggattccgacc

SEQ ID NO: 5927 - DNA, 291 bp, Oryza sativa
  misc_feature (2)..(2): n is a, c, g, or t
  misc_feature (4)..(4): n is a, c, g, or t
  misc_feature (15)..(16): n is a, c, g, or t
  misc_feature (37)..(37): n is a, c, g, or t
  misc_feature (54)..(54): n is a, c, g, or t
  misc_feature (69)..(69): n is a, c, g, or t
  misc_feature (75)..(75): n is a, c, g, or t
  misc_feature (95)..(95): n is a, c, g, or t
  misc_feature (104)..(104): n is a, c, g, or t
  misc_feature (107)..(107): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (127)..(127): n is a, c, g, or t
  misc_feature (130)..(130): n is a, c, g, or t
  misc_feature (189)..(189): n is a, c, g, or t
  misc_feature (200)..(200): n is a, c, g, or t
  misc_feature (206)..(206): n is a, c, g, or t
  misc_feature (217)..(217): n is a, c, g, or t
  misc_feature (220)..(220): n is a, c, g, or t
  misc_feature (237)..(237): n is a, c, g, or t
  Predicted polypeptide sequence is orthologous to G1033
angnacggttcgccnntttataaaccaaattccccancggcggttcgttcttgncgatcccgagggctngagatnaaggcgaggtcgaggtccancaattgcgnctncanggtntnggtgaggaagnccnaggcggagaaggacccgaacaagccgaagaggccaccgagcgcgttcttcgtgttcatngagcagttcangaaggncttcaaggagnagnaccccaacgtcaagcangtcttggtgatttgcaaggcttgtggtgacaagtggaagtccatgacttatgct

SEQ ID NO: 5928 - DNA, 730 bp, Oryza sativa
  Predicted polypeptide sequence is orthologous to G1033
aattcccctctcctcttcgctctcatctccgcttccagccagccactgcaaccctaaccctccgcaaagccctaccccccttccgccaccatgggcaaggccgacgccgacgccgagttcaaggccgccggcaagcgcaagaaggccggaggcgccggcaagcccaagcgcggcctcaccccgttcttcgccttcctggctgagttcaggccgcagtacatggagaagcacccaaacaccaagggcgtcgcagcggtgaccaaggctgccggggagaagtggcgcgctatgtcggacgaggttagcagatgctggcagttgttgtactagcacgctttattatgcttctgtgcggggattcccgcaactgatatttgcacgtccaataagctgattacacttgtcgcatatcatgtgaaaaagcatattatatgcagttttctgagcttttagcagttattattagttatgacctgacgctttataaccacaaattatgccattcttcttcagtacacgtgctgtacagtggctttattgtctgttgcaacatgtatcgatccttagcatgcctgtgcagcaaagctatctagagtgctagctagactcatccatggtccatggatcacatcaagctcttacaggtaatgggtggagattctatacagctgtgaggttctttgagccatgtttttgggagaatgcactataggaaataaaatcacttgac

SEQ ID NO: 5929 - DNA, 957 bp, Oryza sativa
  Predicted polypeptide sequence is orthologous to G1033
atcggccattatggccggggagaagtgggcgctatgtcggacgaggagaaagcgcaatatgggggcaagaagccagatggcgagagcaagccgccggcaagcgcaagaaggccggaggcgccggcaagcccaagcgcggcctcaccccgttcttcgccttcctggctgagttcaggccgcagtacatggagaagcacccaaacaccaagggcgtcgcagcggtgaccaaggctgccggggagaagtggcgcgctatgtcggacgaggagaaagcgcaatatgggggcaagaagccagatggcgagagcaagcccgcggccgctagcaagaagaaggagagcactagctctaagaaggctaaaactgatggtgcggaacaggagggagaaggttctgacaagtcgaagtctgatgttgaggatgatgagaatgatggcagtggcgaggacgagtagtagtaaatagcttagagagctgcagctatgcaaatcggtgttcactgcttagggctttagctttgctatgttactgttatccttgttatgtcctgttgtaaggaaaacgtgcgaatgaaggtactcctgtgacgtggaatgctggaggtgactctgtttaactagtagcgaaaaaatggcgaatatgttgactggtttctttgagaactcggaggtttttaactatttggtataccggcttgtaataagcggaatgggtttacaaacaacctacgctgtaacaagttgcggctggcgagcattacatgcacactctttcggcgaagcacgggaatgccacggggttaccggggcaacggggggtgaggcactaagcggccccgcatacgagtccacggtcgtatggacactaggtcgcgccgcagcacaggtggcggatgtgaccgaggagtacgtgagacgtggacgtgcaagatgtgaagttagtgtggtgatacacacg

SEQ ID NO: 5930 - DNA, 1041 bp, Oryza sativa
  Predicted polypeptide sequence is orthologous to G1033
agagtgtactgggtcggtcggaatcctgggtgaccacgcgtcgccacgcgtcgcacgaacgcttcgccgcttgataaccaaatccccaccaccaccaccgccgcttcgttctcgccgatccggagggctcgagatgaaggcgaggtcgaggtccagcaatggcgactccaggctctcggtgaggaagaccaaggcggagaaggacccgaacaagccgaagaggccaccgagcgcgttcttcgtgttcatggagcagttcaggaaggactacaaggagaagcaccccaacgtcaagcaggtctcggtgattggcaaggctggtggtgacaagtggaagtccatgactgatgctgacaaggctcctttcgtgaccaaggctgagaagctcaaggctgagtacaccaagaagattgacgcctacaacaacaagcaggcaggaggcccggctacctcaggcgactctgacaagtccaagtccgaggtgaacgacgaggacgagggcagcggtgacgagtgatcgatggagctcccgcctccacagggctgcaggtagtagggaaagttctctcgagtcggcctaaccaaagtggacgttgctggttgctgctccttgctagtgttcggatgttgctgcctttagctttttagtcttagaggtctcatcctgtagcttagctctcatgtggtgtcctcgctctcttcggcacttgaccaccatcttgtcgtctgttttgtctcactgtctgtaatctaagtgagtactcgtatctgttgctgttttaaatctcagatctcagtagatggtgccatctgtgttagttgctgaagaggaaacggaacatattaccagtctcttgcttcctgtgtagacaagatagaagataacacaaagaaagagtgagaatacagttaccaaaagacaacaatggggggccggtcaaaaggtcccaggttacgaagcgtttattggaggtatagagcctctaaaggggaccgaaattacgatcaggggcgcggtttaaaaggtgtgatgtgaaaccg

SEQ ID NO: 5931 - DNA, 1124 bp, Oryza sativa
  misc_feature (840)..(840): n is a, c, g, or t
  misc_feature (853)..(853): n is a, c, g, or t
  misc_feature (988)..(989): n is a, c, g, or t
  misc_feature (991)..(991): n is a, c, g, or t
  Predicted polypeptide sequence is orthologous to G1033
ctgaggtacggtcggaatccgggtcgaccacgcgtcgccacgcgtcgcgcctctcctcctccgctgcacccccgcaaaaaccctagcgcaccgacttcgcgatctccgcgccgcagccatgaagggcaagcgcgacgcctccaagaagggcgagggcaggctcaaggccgccggcggcgccgggaagcggaagaaggccgccgctagcggcaagccgaagcgcccgccgtctgctttcttcgtcttcatgtctgagttcaggcaggagtaccaggcagcgcatcctgacaacaagagtgtcgccgccgtgagcaaggctgcaggggagaagtggcgagctatgtctgagcaagagaaggcaccttatgtggacaaggctggccaaaagaagcaggactacgagaagaccaaggccaacttcgataagaaggagagcacaagctcaaagaaagctaagacccatgatgatggagaaggctctgacaagtccaagtctgaggtcgacgatgaccaggatggtggtagcgatgaggaaaatgaggacgatgaagagtaaatagtgtatccgggggcatgaggtagcaaactgtgtcttaggtcccctattagctttactagtttgctatcttcgaccctaagatgttgggaataggcgtgcgtgggtgtgaagggggaccggttagaattatggtactcagaatgttttcttacagtggattagcaaagaaaaagcctgaatgccggctgctgttctggtgctttctttggctaaccctggttccgaacttggtttcttggctaactattaccatcgattaacacaaaaaaggggggcgatcnaggtccactaatnagcggtgaggacctgagctctttagagggccactactacgggccgcgcaacagctgggaacagttcacctttgtggaactctcggctgaaaacagcccacatgggggctctttgttgttgcttctatctctaagnnanagatgaaagagcaaagcgatgaaatgagactactacgatcacgattctataaacgtgtagatcagtcattaacctagctatgagagcatctacacttgctagtcacatcagtatacgatacatcacactcatc

SEQ ID NO: 5932 - DNA, 1221 bp, Oryza sativa
  Predicted polypeptide sequence is orthologous to G1033
cactcagaaaccaatctaatacagtgtgctgaggtacggtcggaatcctgggtcgaccacgcgtacggtgggtagttacctatctcccctacttcctcctctcctttccctcctctcttcccccctctcacaattagagagagagcgccagactctccccaggattccgccatgaagggggccaaatccaatggcgccgccaagcccgacgccaagttggctgtgaagagtaagggcgcggagaagcccgccgccaagggcaggaaggggaaggccggcaaggaccccaacaagcccaagagggctccctccgctttcttcgtttttatggaggagttccgtaaggagttcaaggagaagaaccccaagaataaatctgtcgctgctgtaggaaaagcagccggtgataggtggacatccctgaccgaagcggaccaggctccctatgtagccaaggacaacaagctcaaggccgagtacaacaaggccattgctgcctacaacaagggcgagagcactgccaagaaggcacccgccacagacgaagaggacgacgaccaggaggactctgacacgtacaagtccgaggtcaatgatgacgatgacgacgagggccacgaacaggatgagacgaataccagtgagcctcccatcgccaccatggccaccccacaccctatgccggacggagtcctaaggaccctaccctcaatcacccctcgctcataacatatccgcttcaatcatcttcaataaaactttactcactcaacgaagccccttttacccataattatacaaacaaacatcacaccaaaactaccaaacatacatacaacacaaaacatccataacacacaccacaacacacacaccatcacactacccacactcacaaaaaccaaaccacacaaccaaaacccaacacacaaaaaactaaccacaaaacaaaacaacactcccacacaaaccactcaaaacatatcaaatccttaataaatccatcacctcaacgaaaccacccaagaaacaacaaataaatgaataacatacagacaaagaaacaacacccaaaaaaacaaaccaccacaaccatcacaagatacaataacacacataacatatcactaaacacctacacaaatccaacaacataaattacaataccataaaactatataaaccacacacccctacacgaaagctcaaaacagacgaaca

SEQ ID NO: 5933 - DNA, 2157 bp, Oryza sativa
  Predicted polypeptide sequence is orthologous to G1037
actcaaaacactcatcaatgaaatctgatcagcggtagctttttttttttctttctgaaggaacaaaagtgagcaatagctagcggtacatctctctctgtggcaatggatcaagcgaggatctcgttcttcccggatggtctccgtgtgatgatcatcgacgacgacgcaaaggccgtcagaagggcaacggcgacgttgtcccaactgcagtacgcagtggtggcgacgcactccaccgcaagcgctggtctgcgtgccctctccggcgacaacgtggtagaaatccaagccatcctctgcgatgtccacaaggtggtctcctccggcttcgacttccgccgcgtcgtcgagtccgagcttcgcatccccgtcatctaccttctgtcgaagatggaggaggaggacatggtcgccggcgaggacgcggagttcctgaaccacctcctgctgacggcgacctacatcgtcaggaagccgctcaaccccaccgtgatggcccggctgtggagggtggtggcatggcgcatgtactgcctggaagaaaggattcaggccaatgtcgctgccaatgctggcgctggtggcgaagacgacgacgacgacgacgacgtagttatcgtcgaggagccccaagtgcacttcaaggtggtgagaagaacgtccggtggcagcaggaagaggcagctgacaatcaacgtcgtcgacgacggcaaccgcggcagcggcagcggcggcggcggcggcggcggcgcagatgccaacccaaccaggatactgcagcacatcactagcaacttacaggaattccgcacgaagcaccagaagaaggacatggccatcgagcgtcccctcatctcgtcggactccatgttcctcaaagccatcctcccgacgctcaaaatctcaccatgcaaccccctgaccctcactggcggcatcggttcaagcagtgtcgccgcggaggccttcgctggcggcagctcttcagctgcaccacttcaaattccagttttccagcagcaatccaccggcaatggcaacacggtgattagcttcagcaacaatgcttcaccgatggccatgcgtgcgccaaccgacaatactatgatatcgttcaacaatgtctctgctgcgccggtcgccaatgcggtgatctccttcagcaacatttctaggtctgctgccatgcaggcaccagcggcaagggggcaacatctgtccggtgatgtccagcagctggattttccccagcagaagctgtactttgggcccttctcctaccaagggcctccgccaccttccatgcacaaccacatcaacctactcccgccgacgtcctcccctgtgacctgctccatggacaaaggcaaggttcctattatcgagctcccatatgggatgcctgtggatgacttcctcgtcagtcaaaccacatatggcggtgccggaccatccatcggagccactgacgctgctgccgctgcgtacccttacacagatgcaccgagcaataacgttgcaactggctgtctcatggtgccaccaatggggccagcattcagtatcactgagccaactgtggtggcccaaggtgagggcaccggcaccggtgtcgacgccggcacatcagagaagaacgcgatagtagaagcaccaaacaaccccgcgccattaatggtactggatcaggttgctgctgatgctgcaatggatgttcaagaagacatcatgttctctttggaatctcttctggggccggactatgacctgctacctatggaagacgttagtgctccggacaccgctgcagccggtgatgcagctggtggctcactggacggagaggaaggcggcatggacattggttgggatctcgacctggatgacatcctggtggagaacgttaatgacttcgcgttcctggacaaccttgccgggagcgagtagtcagtagtcatctcatcgcaaatatattatctcaagttaattaagctagagattagagagaggggatgtgtgctcagtatgataaaacaacttttagtctttgttgcaagtactctaaacattgatgatttttcctccgttatcatgccaggaatgtgaacttttaaaactccaaattcctatattgcagatatgatattatgatgc

SEQ ID NO: 5934 - DNA, 3192 bp, Oryza sativa
  Predicted polypeptide sequence is orthologous to G1037
catcagtccactcatccccatgcccccctcattctgatcctttataaatcagccacccagcaagacattcctttccaacctcactcaccttgctctagctcagctagctcttgctgctagtagcttcagctttgctactgctactaccactactactactactactttcacctccaagaaagtatagattgcaagaacaatttctgctgctgttgttctttcttgctgttctttctccttgtgtagttgtgtggtgtggttgagctgaggtgtagttaggacagtggctggctttgcttgcttgattggtcacctgggaaggtcgctgtctctgccttttgttttctttgccatctctttctttctgggctgctttcaccttttgctttccagcctcttcttgccatcaataatgatggaggagtaagatagggcttgttcttgaagtctctccaatctaatctcatttcatcttcatcatctccacccggtccaaatccacctactactgtttttcttttgtcccttctcttttttttcttcctctgatcttttcttttttcaggtgttttgtttttggcagtaggtgcttgctatcttttcattaggctttggattttcctctcgtgttctttagtctcagcctattagaggtttgaggaaagttttccatttcttagctctttttgcttccagcttcttgggattgctctgtttcttgctgagaattggctcgatttgggaggcctcatcttgtgttagctttcaggttttcttgcctgaaattgaaccgattgggtaggtttttaggtgcttcagtttcagttgctagctcgtcaggcttgttcttgggctcctgccttgaattggggtcaaattgggatgcttctgggtgctttgaggatggaggagaggaagggattgatggggagggagagggatcaattccccgtcggcatgcgggtcctcgccgtcgacgatgacccggtgtgcctcaaggttcttgagaccctcctccggcgctgccaataccatgtaacatcaaccaaccaggctattactgcgttgaagctgctcagggagaacagggacatgtttgatcttgtcatcagtgatgtccacatgcccgacatggacggatttaagctccttgagcttgtggggcttgaaatggatctcccagtcatcatgttatcagtaaatggagagacaaagactgtgatgaaggggataactcatggtgcctgtgactatcttctaaaaccggtccgaatcgaagaactaaggaacatatggcagcatgttgttaggaggaagttcggtaatcgtgagcgaaacaatcttgatttctccaaagaatgcaataagccgcaaagcgcggatactgatcatggaccataccaacctacctgtggttcttctgatcaaaatgggaggtccagcaggaaaaggaaagaactacacggcgaggacgacgatgaaggcgatgataatgattatcaagaaaatgatgagccctcagctgcaaagaagcccagagttgtatggtcagttgagctgcaccgaaaatttgttgccgctgtcaaccagcttggaattgacaaagctgtaccaaaaagaattcttgagcttatgaatgtggagaaactcaccagggaaaatgttgcaagtcatctacagaagtacaggctttacctcaagagactaggtgctgtagcatcacaacaagccagcattgttgctgcctttggaggcagagatccctccttcttgcatattggagcatttgaaggactccagagctatcaaccttttgcaccttctgctgctcttccatctttcaatccacatggcctgctaacccgaactagcgccgccgcggctttcggacttcaggagcttgctgccccctccagcacaattcagacttctacaggaaatgtcacagttggccattgcttggaagaaaaccagcaggcaaatctagcacaaggcttgaccgcggcgatcgggcaacctcagcttcaacagaactggattcatcaagaaggtaatggtctgtctgatgttttttctgggagttctctgaccaacactttgtccagcacactccaaagagttccaagcagttcattgccaccacaagaactcttggagtgcaaacaagccaaagttagcatgccgccatcgatacggataccgccttctagttcagcacttcttgagaggactcttggggtttccaccaatttgggagattctagtatatcccagcagggtgctcttccaatagatggtggattttctgctgacaggttaccattgcacagttcatttgatggcgctgttgcaacaaagctagatactagtttggcagcttcacagagagagattggccagcaggggaaattttcagttagcatgcttgtctccccttctgacaatcttgcattagccaaaaatgccaaaactggagctagttcttctggcagtactataattctccctcttgatactgcaagacattcagactacttgcagttcggaggtgcaagcaattctttgcagaaaatggatggacagaaacaagatcatatacagagctcaaacattatatggagttcaatgccaagcactcaactgccaagtgatacccaaattcataatactcaaaaccaaagattggacagcggaagttttaaccataatattggtgcccatttggctgaccaaacaaatgcaagtgcgtcaatacttccgcaaatgaagtttgacacaagaatatcagaagagaaaatgaagcagaagaatacatatgacttgggtagttcaaagctgcagggtggatttaattctagtggctgcaattttgatggccttctcaattccataatcaaagtggagaaggatgatctcccattcatggacaatgaattgggctgtgacctttttccacttggtgcctgcatatgaatccatcatttcggacaccaaagattttgcataatctaaaagagtcagctgtgctgcctgatctgtgctacttcatccaggctttgtgtatactaggatctagggacagtagtggcttgtaatcttgctttatctcttctctagggttggctatggaagtatggttagatcaagataagaagaaaatataatgctgtaatgtcagcgccttttctagtc

SEQ ID NO: 5935 - DNA, 2358 bp, Oryza sativa
  Predicted polypeptide sequence is orthologous to G1037
gctttttggtggtggtgctcgctctcgctcaccctgctttgacctttggatttttatttttaaggatccaagaaagtgctgtttcttgggttgcttggaggtggaggagtttgggagattgtttgtgtttgattgattggttgattgattggaggaagatgacggtggaggagaggcaggggagggtgggaggccatggtgtgagcggcggcggcggcgggagagaccagttcccggtcggcatgcgggtgctcgccgtcgacgacgaccccacctgcctcaagatcctcgagaacctcctgcttcgatgccagtatcacgtgacaacaactggtcaggcggccacggccctgaagctgctcagggagaacaaggaccagtttgacctggtgatcagcgacgtccacatgccggacatggatggcttcaaactccttgagcttgtcggcctcgagatggacctcccagtcattatgttgtctgcgaacggggaaacacaaactgtcatgaagggtataacccatggtgcatgtgactatcttctgaagccagtgcgtcttgagcagctaaggacgatatggcaacatgtgattaggcgtaagaattgtgatgctaagaaccgtggtaacgatgatgacgctggtcagaaggcacagggaatgaacaatgaaggtgagagtattggtgctaaccgcaacaagaggcagtcacggaaaagtagagatgagaatggagatgatggtgatgattctgatgagaacagtaatgagaatggagactcatcaacacagaagaagccaagggtcgtgtggtctgttgagctgcaccgaaagtttgtggctgctgttaaccagcttggcatcgagaaggctgttccaaagaaaatattggatctcatgaatgtagagaacatcaccagggagaatgttgctagtcatttgcagaagtatcggctgtaccttaaacggttgagcactgatgcaagcaggcaggctaaccttgcagctgcatttggaggaaggaaccctgcttacataaacatgaattcatttggaaactacaacgcatatggtagataccgtacagtcccaactgctggccatacccaggcaaacaacattcttactaggatgaactccccttctgcgtttggtgttcatggtttgctgcattcacagccaattcagttaggacatgcccaaaataatctgagcacttcactgaatgatttaggagggcttaataatggtaacatgatcagaggtgcacagatgtcaacaattctaactggtccttctggtaactcctttccaaacatatcgaatggtgcaccgctggcaactgcaaacagatcactgcaacctcttgagtcgagcaatcagcaacaccttagtcgggtgcattcatcttctgcagatccatttagcacacttgttggtgagtctccccagtttcctgatcttggaagaaccaccaatacttggcaaactgcggttccatccaacattcaggatcgtggtcacaatgataacatgtcgcaagccaccctgcatatgaatggccccaaaattgaacctgtctcaagcttcacatcatccaatcagattccgctgctgggaaatgagatgcagggccaagtagcatcactagctagcaatgttccaatagcattcaatcaggacacatcaccattcaactatggaagcagcacaaactcaagagacatgctaaataacagccatgtatttagtaactccagcatcaacacatcgttgcccaaccttagcttagacaatccggctgtaccaaggcagacactggatcgtgggaatacgggcattgtttctcccatgcaagatggaaggattcatcaccaagctgttagcaatcagctaaactataatgacgatcttatgcggacaactgggctgcaaaggggtctcagtggtggtctagatgacattgttgttgacatgtttaggccggaccgcgaagacgacggcgttccttacatcgatggggactgggagctggtctagccagcctccatttcaatcattagtccgcgtacgaggtttttctgcattcgcggtgtcggctgctgattggtccatgctcacttgtcagcacaaagtggtgttcatagtggctagccttcatcacaagtgcatttcacatttggcttcttttttcagcttagtgattattagttggccagtcagtctgtgaaatttatgtggagaaacggctatgtggtgtgtttttatcatgacttatactataataactatgttagttcaggtataaccggttatcctgataatatagtatgcttggtaaaattctcgttaatcatcg

SEQ ID NO: 5936 - DNA, 3142 bp, Oryza sativa
  Predicted polypeptide sequence is orthologous to G1037
ggcggggtagtacatactacagactacagagggatggcgtttcgtctgtagcgatcggttggagcttgtggatgaaatgggccccaatttctgttgccctccaccatttttgaccccttaaaattcagacagatggacagtctacttacattctctccctcatcttcttctcccttgagatgttcttgctgttcttgctccaatctcctcttgttttcttgctgggagttgtggtggctgctgctgctgagctaggagtagttcacatgtgtgtgagctgaagctgaggttggttgcttgcttgcttggccatctggaacagtcagtgtctctgcttttttcctcccatttttttagtttatttttttggctgcagagagagagagagagagagagaactctgctttcttctccaactccctcccttttgctttcccacctctttgcctcaataatgatggggtggtggagatggtggtgggtttggtcctgaagctccatgcccactctctccagctctctcctctccctgtccaaatccaccaccagcttctttctttccattttgcttctccctttctcttttcctgttctagttggggagcagcagcagcagcaggagcagtagtagtaggttgttggttttgtacctttgggctctttgcctttgctttcttgctggggattgggaggcctgccttgaagctgaatcccaatcttcccctgcccacatctgcttcccagcatcctgcaactttggttataaggtggttggtttttgttcttgatttgcttcatcgattgggaggtttcttgctgttcttgggttttgtgctgtgaattggattgggaggttttttgttgccatgagggcggcggaggagaggaagggtgtggtgccggcggcgaggaggagggaccagttccccgtcggtatgcgtgtcctcgccgtcgacgacgacccggtgtgtctcaaggtgctcgagaccctgctgctgcgctgccagtatcatgtgacgacaacaaatcaggctgctatcgcgctgaaaatgctgcgggaaaacagggacatgtttgatctagttatcagcgacgtccatatgccagacatggacggctttaagcttcttgagcttgtggggcttgaaatggacctccctgtcatcatgttatctgtgaatggagagaccaaaactgtattgaaggggataacccatggtgcctgcgactatctcctaaaacctgttcgaatcgaagagctcaggaatatctggcagcatgttatcaggaggaaattcagtactcgcgaccgtgctaatctcgatttctatgaagagtgcaacaagccaccaaatgcggattcagaccatgtgcatggccatgttacatgtggatcacctgatcaaagtgggaggcccagcaagaagaggaaggagtactgtagtgaagaggaggatgagggtgaggtcaatactcaagatattgatgatccctcggctccaaagaagccgagagttgtttggtcagttgaactacaccggaaatttgtcgctgctgtcaaccagcttggaattgacaaggctgtgccaaaaaggatacttgagctcatgaatgttgagaaactcacaagggaaaatgttgcaagtcacctacagaagtacaggctctatctcaaacggctaagcgctgtggcgtcgcaacaagttagcatcgttgctgctttgggaggtagagacccctttctgcacatgggtggatttgaaggactacagggttatcaagcttttacctcttccgcagctctatcatcttttactccacatggattgttaaacagtcctagaaacaatccagcagctcttggaactcagggggtacctgcttcaaaatcgattcagactatgagcggaagccatacattgagccattccattaatgatgcaaataagtaccaccttagcttaccaggaaaccagaaaggaaacttgggacaaggtttggcaacatcgcttgggcagacccaaatgcaacagaagtggatccatgaagaaaccgatgatctgtccaccatcctttctgggaatggcctatctaatggtatgtctggcacactccaaagtgtcacaagcagtcctttgctgcctcaagaactagccgagtgcacacaagccaaaattgtcagtcagccatcaattcgaacttcctctgtaagttcagaacatattgaaggcgccgttggagtttcatctggtctgcttgaatctcgtgtatcccagcagagtactattcctttatcaggattttccgccaacgggttgctaatccatggttcgtttaacaatacctgtgcaaacaaattgggtggtacatcttcatcgtgtgcacctgctcgctcttcaaatgaccttatggtagcaagagacacaaaaggtggagctagctcttttggtggcgcgatgcttttacctccagatacagagcaaaagtacttgaattttggaggtggaaacggtttgaaacagaagttcgatgataggactgcagacagtctgtttgatctcaagttcgtatggagttctgtaccgagctctcaattggcaagcaacattggggctcatcatgctatgagccaaagatggaacaatagcagtagtaacagtaccaatattggtgccagaatgattgggcaagcaacctcaagtggttcaacagttatcccacaaatgaagacagatttcctcgtttcgggagatatggcgatgccgaagaacgcctccgatttgagcatcccgaaacttcagagcgaacttagctctagcagctgcagcttcgacggccttctcaattccatagtcaaagtggagaaggatgatgttaccttcagcgacgcactggggtggtgcgacttctactcccttggagcttgcatatgacagatctctcgtctgcatctgtgtacatgtccccccattgtatgctgtgtactagctagcagtgttagtttgtgatgtaatctagtttaggcctgtgtatttaagtaaaaatatgtattgtagtagtaatttggaggacgagatgggttgtcaactcgacctaaaaaaaaagacattgactggcttgtataaacctgagcttactgctt

SEQ ID NO: 5937 - DNA, 762 bp, Oryza sativa
  Predicted polypeptide sequence is orthologous to G1037
atggcttcaagtggagacacaaatacagtgatgaaatatgttgcaaatggcgcttttgatttcctgctaaaacctgtgaggatcgaagagctgagcaacatttggcagcacatattccgaaagcaaatgcaagatcacaagaacaataacatggttggaaatctcgaaaaacccggtcatcctccatcaatattagccatggctcgtgctactccggctaccacgagatcaacggccaccgaagcttcgctagcgcctctagaaaatgaggtgagagatgacatggtcaactacaatggcgagatcacggacatacgagacctcggaaagtccaggctgacctggaccacgcagttgcaccgtcagttcattgcagcagtgaaccacctcggagaagacaaggcagttccaaagaagatactagggataatgaaggtcaaacatttgacaagagagcaagttgccagtcatctgcagaaatacaggatgcaactgaagaaatcgattccaacaacaagcaaacacggagcgactttgtcatccaccgctctcgacaaaacacaagaccacccttcaagatcgcagtatttcaatcaagacggatgcaaggaaatcatggactactctttaccgagagatgacctctcaagtggctcagagtgcatgcttgaagaactgaacgattactcatccgaaggtttccaagatttccgatgggattcagacaaacaggaatatggaccatgtttttggaatttctag

SEQ ID NO: 5938 - DNA, 759 bp, Oryza sativa
  Predicted polypeptide sequence is orthologous to G1037
atggctcaaagggtaggacactctgctgatggggtttttgtcatgatcgttgatgaagataagtcacatgccaacttcgcaagaggcatgctctccagcctcaattttcatgtgatagtgtactcaagtcctgtgaatgcactcgtttttctggagaataacgcacaagacgtcgctgtagtcttggcagcagtggacatgaaacaattgagtggttttcagttcctcgaagctgcaagagtgaaacgccaggaccttcaagttatcatgatgtcagctgagacaacaatgtccacaatgatgaggtgtgttaaactcggtgcacgttttctagtgaagaagcctcttaacgaagaaactgtaggtaatctgtggcagcatgttgacctgaaagttttgaagatggagaagatcagggaattactgcaagatgaaaataatgaagaggaggaagtgaattcctttgaagctaagaaggctgattcagttaaagttcaatcagatgagaagggacatgacaatgctaaaatctctaacactgctgctgctgaagggtctgatgaaaaagtctctagtggtgatggtcatgtagtgcctaaagcgtataataatgtgaatgttgaagagagcataggtagtaacaatacttcaggtgaacaagtctccgacaagatcaagagtgatgcaagagttggggtgatccttgtggactacccagattttgaggatgatgagaccaagaaacccacaagcacttag

SEQ ID NO: 5939 - DNA, 3142 bp, Oryza sativa
  Predicted polypeptide sequence is orthologous to G1037
gtgcggggtagtacatactacagactacagagggatggcgtttcgtctgtagcgatcggttggagcttgtggatgaaatgggccccaatttctgttgccctccaccatttttgaccccttaaaattcagacagatggacagtctacttacattctctccctcatcttcttctcccttgagatgttcttgctgttcttgctccaatctcctcttgttttcttgctgggagttgtggtggctgctgctgctgagctaggagtagttcacatgtgtgtgagctgaagctgaggttggttgcttgcttgcttggccatctggaacagtcagtgtctctgcttttttcctcccatttttttagtttatttttttggctgcagagagagagagagagagagagagaactctgctttcttctccaactccctcccttttgctttcccacctctttgcctcaataatgatggggtggtggagatggtggtgggtttggtcctgaagctccatgcccactctctccagctctctcctctccctgtccaaatccaccaccagcttctttctttccattttgcttctccctttctcttttcctgttctagttggggagcagcagcagcagcaggagcagtagtagtaggttgttggttttgtacctttgggctctttgcctttgctttcttgctggggattgggaggcctgccttgaagctgaatcccaatcttcccctgcccacatctgcttcccagcatcctgcaactttggttataaggtggttggtttttgttcttgatttgcttcatcgattgggaggtttcttgctgttcttgggttttgtgctgtgaattggattgggaggttttttgttgccatgagggcggcggaggagaggaagggtgtggtgccggcggcgaggaggagggaccagttccccgtcggtatgcgtgtcctcgccgtcgacgacgacccggtgtgtctcaaggtgctcgagaccctgctgctgcgctgccagtatcatgtgacgacaacaaatcaggctgctatcgcgctgaaaatgctgcgggaaaacagggacatgtttgatctagttatcagcgacgtccatatgccagacatggacggctttaagcttcttgagcttgtggggcttgaaatggacctccctgtcatcatgttatctgtgaatggagagaccaaaactgtattgaaggggataacccatggtgcctgcgactatctcctaaaacctgttcgaatcgaagagctcaggaatatctggcagcatgttatcaggaggaaattcagtactcgcgaccgtgctaatctcgatttctatgaagagtgcaacaagccaccaaatgcggattcagaccatgtgcatggccatgttacatgtggatcacctgatcaaagtgggaggcccagcaagaagaggaaggagtactgtagtgaagaggaggatgagggtgaggtcaatactcaagatattgatgatccctcggctccaaagaagccgagagttgtttggtcagttgaactacaccggaaatttgtcgctgctgtcaaccagcttggaattgacaaggctgtgccaaaaaggatacttgagctcatgaatgttgagaaactcacaagggaaaatgttgcaagtcacctacagaagtacaggctctatctcaaacggctaagcgctgtggcgtcgcaacaagttagcatcgttgctgctttgggaggtagagacccctttctgcacatgggtggatttgaaggactacagggttatcaagcttttacctcttccgcagctctatcatcttttactccacatggattgttaaacagtcctagaaacaatccagcagctcttggaactcagggggtacctgcttcaaaatcgattcagactatgagcggaagccatacattgagccattccattaatgatgcaaataagtaccaccttagcttaccaggaaaccagaaaggaaacttgggacaaggtttggcaacatcgcttgggcagacccaaatgcaacagaagtggatccatgaagaaaccgatgatctgtccaccatcctttctgggaatggcctatctaatggtatgtctggcacactccaaagtgtcacaagcagtcctttgctgcctcaagaactagccgagtgcacacaagccaaaattgtcagtcagccatcaattcgaacttcctctgtaagttcagaacatattgaaggcgccgttggagtttcatctggtctgcttgaatctcgtgtatcccagcagagtactattcctttatcaggattttccgccaacgggttgctaatccatggttcgtttaacaatacctgtgcaaacaaattgggtggtacatcttcatcgtgtgcacctgctcgctcttcaaatgaccttatggtagcaagagacacaaaaggtggagctagctcttttggtggcgcgatgcttttacctccagatacagagcaaaagtacttgaattttggaggtggaaacggtttgaaacagaagttcgatgataggactgcagacagtctgtttgatctcaagttcgtatggagttctgtaccgagctctcaattggcaagcaacattggggctcatcatgctatgagccaaagatggaacaatagcagtagtaacagtagcaatattggtgccagaatgattgggcaagcaacctcaagtggttcaacagttatcccacaaatgaagacagatttcctcgtttcgggagatatggcgatgccgaagaacgcctccgatttgagcatcccgaaacttcagagcgaacttagctctagcagctgcagcttcgacggccttctcaattccatagtcaaagtggagaaggatgatgttaccttcagcgacgacctggggtgcggcgatttctactcccttggagcttgcatatgacagatctctcgtctgcatctgtgtacatgtccccccattgtatgctgtgtactagctagcagtgttagtttgtgatgtaatctagtctaggcctgtgtatctatgtcaatatatgtattgtagtagtaatctggaggacgagatgggttgccaactcgacctagaaagagagacattgatggcttgtataaacctgagcttactgt

SEQ ID NO: 5940 - DNA, 1283 bp, Oryza sativa
  Predicted polypeptide sequence is orthologous to G1038
ggacttgatgaatgttcctggcttaacaagagaaaacgttgctagccatctacagaaatatcgcctctacctgagtaggttgcaaaagcagaatgaggaaaggatattaggcgctgctaggcaagatttcagtcacaagggaacatcagaaaaccttaacctccgaagttccttccaagagcaaccaagcaacatagcaaatggatatccgcatgcttctcagaatatacaaactcaggccaacatgctagattctcagctagaggacaccaagagcacagtgcccttgcctgtgccagataaaaaaagaactctagcaagtgatgctgctgactcacagaatgtcaccagtgcttcaagtttaggtggggttctgtctttcaaaagcatgccggtgaatcaggacaggaagccatcagaaacaatgatcttggaatgccaggcctggaccggaggcattccatcgaagcagttcatgcagtatccaaagcataaccatgaacgctgtgacctattaggggattattcatgcctgccaaagccagacttagaacacccagttggccctagtaatctgtatgctccaccacctcttatctcaatgagttgcggtatggagggggatgccagagacttctcagacgtgaagccagctattatggactgcatcaagtccttatcaccggcgttgacatgtacagtggattcagtttctgttcaacttagcgacagtgtggtgacctcgattgacggtgacctgaagtcttccggtgtggacgggttgcccagcattaaagattgttgccttgatcagacgaacagccaaggaagtttgcgtccttcgcaagagccaagtatcataggcagcacagagttggcttctctgcctgaggacttacccagttatccacttcacggtgtctccctcgagaatataggactgagtagcattgacttactaaactacagtgacgcaatgatactatccggactacaaagtaactggtatgatgatctagagtttagcagcgaaatgatggactatccatcgatagatgaatgtctctttgcatcatcctgagctgccgcccttctttcgacaatgctattttgcgaggaaggatgatgttctttggtatgttcccatatagctcctcttgtagggctatagtcagctaacttgatcctacggtggaaggatttaattgtagtatctccacttttgataaatgtctgtattatagactgtgccatggtataagctatataccttttgaatgatc

SEQ ID NO: 5941 - DNA, 1483 bp, Oryza sativa
  Predicted polypeptide sequence is orthologous to G1043
attttgcacggtatatatcccagtctgtgtgtgagtgtgtgtggtctgtggagtgtatggttgatttggttggtaattggctaagctagctatagcatggcgttctcgtcggagggcggcgtgccggcggagagggtggcggcggcggtgaacgacctggtggaggtgcgcgacggattggtgaggctgaggggcttcttgccgccgccgccgcaggccgagcaatcgtcgtcgcggccgccgtgcgcggcggagctgatggacgcgacgatgagcaagctgatgagcgcgatggccacgttgggcggcagcggcgacatcgccggggaggtggacgctcctctaacaagagagtcgccgcaacactagaagacggtcacgtgtggcggaaatatgggcagaaagatatccaaaactcaccttatccaaggagctactacaggtgcacgcacaagctagaccaaggctgcggtgccaggaggcaaacccagcgctgcgaggccgacccgtcgaattacgacatcacctactacggcgagcacacctgcagggacccttccacgattatcccgacggccatcgccaacgccgccggcgcggcgagcgacgggccaaacaacaacatcatcagcttcgccacaggcggcgtcgttgttgctaattcgtctcggctggcgagggaagggacgacggcgacgacgacgagcgcggccacgcagctgtcctcctcgtggggcacgagcggcggtggcggcggcggcgacgacgtgttcagctcgtcgggggagcggttcatgcagtgggacgagctcgcggcggccgtcgggcacgtgagctcggtgggggtgacgtcgtcgacggtgggctccgcgccggcggcggagaacgacggcggaaacggtgacacggctgcgggaggaggaggagacggcggcggcgcgggcagcttcccgtcgtctccgagcgccggcagcctcggttttgtggtcggcccgctcgggagcatcgaggacgtcgatgacttcttcccgttcgatccctgagatgagatcggcgccgtcgattgaaccagcagtttgcagcggacggatttacacaacgttcgtagtatactaccagtacatagtagcaaacgcatcaaggctttagtattaagttgcataatggcatctctgtggaaatcaaataagcaaatatagaaccatctagtacattaagtaggttgcttatctacagactagactacagtgactcacacagcttctagctgtgcaagttggttaaggtgatgttttagattgaaatccaagccacgcatgttgatgagccggaattgggctcactaaaatgtggcttaagtttttgtttttttgtttggattgcttgttggcggcccaatggtaaacggtcactcttttcttctcagtttgcaagcctagcccactataccgacaaggaaaaacccatgtaatctgctaggctc

SEQ ID NO: 5942 - DNA, 1453 bp, Oryza sativa
  Predicted polypeptide sequence is orthologous to G1043
gggtgctttgagctccatcaccagctgagctgcgaggaagagagagtgcgagagtgcgcggcagcggcagtgtagtgtcagtcactgggtgtgcgcttgcttgcttggattgaggatgacgtcatcgatgtcgccggcgccggcgccggcgtacgcgcaggtgatggaggacatggagaaggggaaggagctggcggcgcagctgcaggggctcctccgcgactcgccggaggccggccgcttcgtcgaccagattctccacaccttctcccgggcgatgcgggcgctcgacaaggcggcggtctccgccgccggaggagaagggtcggaggtgcagagcgaggtcacctgcgggggcggggccagcgccggcgggaagaggaaagcccccgccgccgaccggaaggccaactgccgcaggaggacgcagcaatcgtccgggaattcggtggtcgtcaagaacctcgacgacggccaggcatggcgcaagtacgggcagaaggagatccaaaactccaagcacccaaaggcctacttccggtgcacgcacaagtacgaccagctgtgcacggcgcagcggcaggtgcagcgctgcgacgacgacccggcgagctacagggtcacctacatcggcgagcacacctgccgggacccggccaccgcccccatcatcgcggcgcacgtcatccaccaggtcgccgccggcgacaacgacgacggctgcggcggcctccaagcggggtcccgcctcatcagcttcgtcgccgcgccggcggcgccagtagacgctgccgcggcgccgacgaccagcacgatcaccacggtcaccgcgccgggcccgctgctgcagccgctcaaggtggagggcggcgtcggctcgtccgaccaggaggaggtgctgagcagcctcacgcccggcagctccgcggcgcgcggcggcggcggcggcggcggagtcgcgggtcccttcgggccggaccagggcgatgtcacgtcctccctgcactggagctacgacgccgtcgccggcatggagttcttcaagaacgacgaggttgtcttcgatctggacgacattatgggtttgagcttttgatcaccgaagaatcatggatggacacgggccgggtaaaacgatcgaaagaagatggattccacgcgtgtgtacagaaataattagcggcagcgcggatcttaatttggaacttgcaaagatactcctaattagcctggctagattagtttgtaaattccttgttgatgtgtcgtctcagctttaagctgcagacatgctagcaagtaacaacacgattagtacgtagtaatgtggttcttgattatgagctgggggtcttaaccttttttgtgtgacaagcaagagaagaggatttgggtacaatgtaatcctgttcttccgctttcgaaaaaaaaaaacatatagcttcacgtgcct

SEQ ID NO: 5943 - DNA, 540 bp, Oryza sativa
  Predicted polypeptide sequence is orthologous to G1043
gagctactacagatgcacctacaggcaggaagagaagtgcaaggctacaaagacggtgcagcagcgagaagacctgcaccacgccaacagctacaatggcgatcaccccatcatgtacacggttgtctactacggccagcatacctgctgcaagggccctgcggcattagctgatgatcatgtcgtcgtcgaagcatcacagattagcaccgacagccattgccagagtccgagcagcagcagcgatctgcaggctgcggaagtacacgccggtaacagcagccagtgcagcaacatctccgtcacatgttcaccatcagtcgtcgttgaggattgcaataagcttcttgacatgatgccagctgctgatgaactgaccgctgatgtcttgttgttcgacatgactgcatatgcacctttagatttggatatcaactgggaaatggatacaatgctctgtgggtttgaaaaggttttgtaattaaactgatctatctgtaacacgtcaacaaccgagttaaattatctatacccttttgc

SEQ ID NO: 5944 - DNA, 269 bp, Oryza sativa
  misc_feature (246)..(246): n is a, c, g, or t
  Predicted polypeptide sequence is orthologous to G1048
gagcagccggagggatgctctgtcatgtgatcgaacagctgccgtacgtgcctcggaaatcggaataattaaacgcgttaattacttatgtctggtagtggtatttttttcttaattaaatcatgtaattttattaattgtctatattactacacatgtaatttgttgtgtgtatacagtatatacatgtatgtaatttgttgtctatatatttgacatgtatatatattttgctcaacgcagttnccagctaaaaaaaaaaaaaaaaa

SEQ ID NO: 5945 - DNA, 1128 bp, Oryza sativa
  Predicted polypeptide sequence is orthologous to G1048
gagagacaaaaatatctccatcgcgatctccatggatgtagagttcttcgccgacctcgacctcgacgcgctcctcgcctccttctcctcctccgccgccgccgccggctccggcgtctcgggcctcttcgccccgtcaccgccgcacgatgcggaggcggggtcgccggagtcggtgagctcccggcggcccagcccttcccgggaggcggcgctgtcggaggtcgagaggttcctgatggaggagggccccgcggcggaggagggggtcggcgcggaggatttcttcgacgcgctgctcgtcgacggcggggaggaggaggaggaagaagaggggaaggggagtgaggcggggggaagcacggatggggattccgggaaggagaatgaggtggctaccccggacgcggagaaggaggatgtggaggcggaggtggatggcgatgatcccatgagcaagaagaagaggaggcagatgagaaatagggattctgccatgaaatcgagggagaggaagaagatgtatgttaaggacctagagactaagagcaagtatctagaggccgagtgtcgtcgcctcagctacgcgcttcagtgctgcgcagctgagaacatggcgctgcgccagagcttgttgaaggataggcctgtcggtgccgccacagccatgcaggagtctgccgtactcacggaaaccctgccgctggtttccctgctttggctcgtgagcatcgtgtgcctactcccggtgcccggtctacccaaccgaaacccggtggctcgaagcagcgccggaagagatctcgcgacggtaaccggaaagaagacaagcagtgaacaacagctagaagaaacattactactccatgggaggcgttggaagggctcgagggcgaggatcaagctagataccggaccgttccgtttagcagcagctgcttgctaggctgccgcttccttgcaaagttgtttccagtctgtattgtagctagcaaatcaaattggcgtgtctatcgcctgtcgtgctgccgcttatccatggactatctttttccttttttggttccctccccccttgtttttataatatcctcctatgcataatgcattatccaggtagttttgaag

SEQ ID NO: 5946 - DNA, 885 bp, Oryza sativa
  misc_feature (697)..(697): n is a, c, g, or t
  misc_feature (720)..(720): n is a, c, g, or t
  misc_feature (724)..(724): n is a, c, g, or t
  misc_feature (775)..(775): n is a, c, g, or t
  misc_feature (780)..(780): n is a, c, g, or t
  misc_feature (812)..(812): n is a, c, g, or t
  misc_feature (880)..(880): n is a, c, g, or t
  misc_feature (884)..(884): n is a, c, g, or t
  Predicted polypeptide sequence is orthologous to G1049
ggattcattcagagcacccaactccttgaaactaaaatccaccgcctctttcctcctccacattgcaaaccttccaaaatccccctccctatcaaacatgcagcatgatgccatatccaacattgcataccatcctagcatggatttcacaagctttttcctgccgcaaaccgacgcttactcgcatgatctcagtgcattgctggacatggctgtggttgatccatacatcagctgcaatggcagcagcatcaccatgattccagtgactgaagatgaagcaaatgctcagccgatgaaccatggcaatgacgagaggaagaagagaaggctggtgtcaaaccgtgagtctgcaaggaggtcccgggtgaggaagcagaggcgcctggatgagctctcatctcaggtttcagagcttcgagacaccaaccagaggcttcttgttgagctgaatcacatgatctccaagcatgctcgcattgtcagggagaattcccagctcagagaagaagcttctgacctgcagagaaagctcagtgagatggaaatggaagatgctgaagtggccgctgctgctgctgcagcaccacgaacattagaagtagcttaattaattatttaagctagttctaatgttcactaattaattgcagcatatcatggctagtagccttgggagtgttgcatactgcatagntgtactactaattaattataggngaanattctttttatattatttttatttttccctttgggcaaagagagcatatangtagntcgagactactacctttggattttggactaanatcgattgaattgagaatggctgaattctctttaaaaaaaaaaaaaaaaaggaaaaaaagcggcgccnccgng

SEQ ID NO: 5947 - DNA, 912 bp, Oryza sativa
  Predicted polypeptide sequence is orthologous to G1049
cgcatcgtgttggtaccgggaattcggccattatggccggggagagcaatcttcagtaagcagaatcaagcagattaccctcatctacttctggccctctaagagttctccactaagcaagcgaaaacagccatgctgcaccaccattaccatggcgaggtggccagcctgcactgcctctcacctccaagcctaccattcagttcccactaccacagcaacatgatcaccatggcaccctcgcccttccacttcccagcagctacctgtgaacctatccaggaattgctccctgtggtagcgggcaatcgaccagccggctctggcagcacagatgacgcctaccagatggcagcggaggaggagcggaggcggcggaggatgatctccaaccgggagtcggcacggcggtcgcgcatgcgcaagcagcggcagctcagcgagctgacggggcaggttgtccacctccgtgacgccaaccgacgactccttgatgagctcaaccaagcactgaggggctgcagtgatgtccactgcgagaacgcccggctcaggaaggagagggccgagctccagaacaagctcgagcacctcatgcaagcacgcaaacacacaaacacaccgaccccaaccaacatgtcggccgcctcggcaccgccgactctaaaaacgagcacagataagcatgcggcccaaatcgagcaaactggaaaaacgccataaatacgcgaatacaatcacggcccagataacacgtccgactggaaacctgcgttacacataacagctgaaagatccccttagcaagtggataaacaaagccgcagggccgtcaaatggcccgatggacggactgcagcaaaggaacacacataggcgaagcttacgagcacacaccctacaacaccgcgg

SEQ ID NO: 5948 - DNA, 713 bp, Oryza sativa
  Predicted polypeptide sequence is orthologous to G1050
ttttttttttttttttttttaaatccccaaaatgaactgatgattctaattaaaacatcggtacagattcaggcaaatttgatattacagaagcccacatgggtgtcagttcacccaaacttttagcaaaataactgtagcacaacactcagtaataggtgaattatctattggttcggctgtctaagcgaattcatgtttgaatctgcagtatagtttgacattcccctttcaaaagtttcctctcatcagaaatcaccctaaagcttcaaactttgttatggctgatatccctggatttgtgatggtccagcctgtgtttctggctccagcagttcgatcaaccgagcgaccgtttcttcgtgtgtaccatttggcatgacgaactcaccatcaacaacaacttgaagtgactcataacctattgatttgaatatagcttctttcatctggcgttccctacccgtttcttgtatcttgattttcagctcattgttttgagctaaaagctcattaaatgttctctgagccgtcgccaatttttcagacaacttctcaatctctatcttcaacaccagcaccttactttcaagctcaagcttatagttcaacctgcgctccttggacctcgcagcagatctcctattgcatagaaccctcttgaccttcttcggatcactcaacacgagctgcgagaggtactcactcgccat

SEQ ID NO: 5949 - DNA, 709 bp, Oryza sativa
  Predicted polypeptide sequence is orthologous to G1050
gggtgcagatcggacggcgatgacttcgccttgtacgacctcgtcaactcctacatggacctcgacgggatggaggctctcaactcctccgaggagcggcacgaggaccgcgacagccgcgccagcggcacgcgcaccgggagcgtggccgacagcagcgagaacgaggccgagagccactcgactccagtggagaggaaggacggaggaggcaaatcccggcattgccgcagcttatcggtggacagcttcatcgagaagctcaacttcgacgagtcaccgaagctgccactgccgtctcccagcggtggcctatccagaagcgggagcgggtccttggatggcggcgctgcatctctgtttggtgctgagtttgccaatggggagttcactgaagctgagaagaagaagatcatggcaaatgagcgccttgccgagatcgctttgactgatcctaagagggttaaaagaattttggcaaatcggcagtctgcggcaaggtcaaaggagcgtaagatgaggtacattcaagagcttgagcacaaggttcaggtgttgcagacagaggctaccacactctcagcacagttgacaatgctgcagagggactccactggactagccactcagaacaatgagttgaaaatcaggctgcaagccatggagcaacaagcacagctaagagatgccctgaatgaagcattaactg

SEQ ID NO: 5950 - DNA, 1505 bp, Oryza sativa
  Predicted polypeptide sequence is orthologous to G1050
gcgtcgatcgtgctcgtccgtgcgcgcagcaaaacgccaccaccaccaccaccgcatccccaacacctcacctcacctccttacaccataggcgtgcgtgcgtgatgaacaccacgtccgcgaacgagctgatgatgcaccgccacgtccaggccgcgccctacgcggcggcgccgcagcagcaaggaggcaagcagcgtgcgccggggctgccaccgacgcctccacctccacctgcggcggcgagctcccactcctctcacggcgacgtgtgcatggacgacacggcgcgcggcgggctgctgccgccgcgcaaggcgcaccggaggtcacgcagcgacgtgccgttcgggtacttccagccgctgccaccgccgtcgcccaagatggaggccggcggcggctgggcactccccgggtgcggcggcgccggcgacgtcgacctgctcaatgcgtacatgagcttggagggaatgggcggcgccgacgggctgaacaactccgacggggacagccgcgggagcagcatgcggacgaacggcgccgacagcagcgagaacgagtccgaggactacgtcggcgccgacagccaggccctcctctggggcggcgccggcggcggcgaggctgcgggcaagaagagacggaataacgctgccggcgagaaggcggcccggcacgcgaggagcctttccatggacagcctcatggggaagctcagcttcgccgccaatggtgagccggccaagttcagcctggagttcggcagcggcgagttcacccccgccgagatgaagcggaacatggccgacgagaagctcgccgagatggcactcgccgacccaaagcgcgtaaagagggtgctcgccaataggcagtcggcggcgaggtccaaggagcggcggatgcggtacattgcagagctggagcagaaagtgcagatcctgcagacggaggccacaaccctctccgctcagctgactcttttgcagcgcgactcgtcgggaatggccacgcagaacaacgagctcaagttcaggctgcagtccatggagcagcaggcgcagctacgcgatgcattgaacgaggcactgacagctgaggtgcagcgcctgaaactcgcggcgaatgaggtctgcgacacgagctcgtccagcaacctagcacaccaaatccagctccgccgtcagaaccagatgcttgatctgcacaagcagcagcagcagcaggttgagcagataccattctatcaactggaactgccagagcagcagaatggcgcggcgaggaatcacgagtccaaatgattgttcgcggggactgcgtctaggtgctcatcagggccatacagaaaaaatgtcactagtagaaatttagacgatctgaagaaattccttttcctaacccatttgttttcagcattgatgtctccgtaaatttgcttgtgtaacttgtatgtccgggcaaacacccagtaatattctgaatgttcttcgttctttcac

SEQ ID NO: 5951 - DNA, 1281 bp, Oryza sativa
  Predicted polypeptide sequence is orthologous to G1050
atgaacggtggcattggcgacgcgctgatgcagccgcagcacgtgcaggtcatgtcgtcgtcgttgccgatggtggcgtcgacgttcgtggcggagccggcggcggcggccaacaagccgagggccgcggggctgccgcccacgccgccgcaggtgttcgccgcccagcgcgcggcggcggcggcgggcggcgacgtgtgcatggaggagtcggcgcaggggggtggtggcgggctgccgccgcgcaaggcgcaccgccgctccagcagcgacgtgccgttcgggtacctggccgggcagcaccagctcctgccgcccaaggtggaggccgggtggggccacctcggcgccggcgccggcggcgcggcggccgccgatgacctgttcaacgcgtacctgaacctggaggggctggacgggctcaactcctccgacgaccgccacgacgaaggggacagccgcgggagcagcatcaagaccaacggcgccgacagcagcgagaacgagtcggaggagtgcgccgacgacacccgcggcgggatccgcctctggtccgccgacggcggcgagaggagggagggcgtcaagaggaacgccgcgggggagccggccaccgcgccgctggcccgtcacgccaggagcctctccatggacagcctcatcgggaagttcaacttcacggcggggacggcggcggctgcggggaacggtgtcgcgttggggccgaacaggttcagcctggaattcggcagcggcgagttcaccccctccgagatgaagaagatcatggccgacgagaagctggccgagatggcgctcgccgacccaaagcgcgtcaagagggtgctggcgaacaggcagtcggcggcgaggtccaaggagaggaagatgaggtacattgcggagctggagcagaaggtgcagatcctgcagtcggaggcgaccaatctgtccgcgcagctcacgatgatgcagcgcgactcggcggggctcgcgacgcagaacaacgagctcaagttcaggctgcatgccatggagcagcaggcgcagctgcgcgacgcgctgaatgaggccctgacaaccgaagtccaacgcctaaaactcgccaccgctgagctcggcgattcttgctcgtccagcagtctagctcagcagatccaactcaatgctcagaatcagatgtttcaactgcagcagcagcaggctacgcagataccattctatcaactgcagcagtcacaacagaacggtgcagcgaagaacaatgaatcaaaagaatga

SEQ ID NO: 5952 - DNA, 634 bp, Oryza sativa
  Predicted polypeptide sequence is orthologous to G1050
tgcaggaattcggcacgaggattttcgccatctcctccgcctcgtggtcggcgctccacactctaccctcgccgaagccttctagaagatccgccgccatggacgaccccggtgcggccgatccgggggcgcgcccccaccacgtgtcgccggggcagccgccggtggtgccgcgctccccgaccccgctcgacctgtcgagcgccgcggcggcggcggccgcggcgtcgtacaggaggctctcgccgtcgctccgaccgcccgcgcacccgcaggcgcgtctcccttcgccgtacccccagatcccctcctcgtcgtcgtcggcggcggcgggctcgtcggggcaccacgcgcggtcgctctcgcagccgctcttcttctcgctcgactcgctcccgccgctgccgtacgccgatctggccgcgccgcccgccatcccgccctccccgccttcctcgagctccgacccgccgccgccagggctgccgccgcggaagggcgggcaccggcggtcgcagagcgatatccccttcgggttctcgcacctgagcccgcccctgccgcctcccgcgcccgtgaagcgggaggccgccacggcggcggaggggtgcagatcggacggcgatgacttcgc

SEQ ID NO: 5953 - DNA, 1111 bp, Oryza sativa
  Predicted polypeptide sequence is orthologous to G1051, G1052
gcgccgtccaacgcgcgcgccagagctaggtggttagcccaagctcgcgagatcgatcgctactataggctaaggacacgtacatggcgcagctcccgcccaagatcccggtggcggcgccggggcaccaccagcactgggcctcggccgggggcgccggcgacgcggcgtgggcggatgagttcgccgagttcgcggcgtcgcggcggggcgcgcaccgccggtcgctgagcgactccgtggcgttcgtcgaggtggcgccggcggggtgcggggcgggcggcgagttcgacaggctcgacgacgaccagctcatgtctatgttccccgacgagggcgggtcgtcggccccggggtccgacaacggcggcagcgacagcgacggcggcggcgacaagcacgccgcggcgcagagcgacgacgggcagcacgccgccggggagccgacgcaggagcaggcggcggccacctcgccgacggagctgatccgggaccccaagagggtcaagaggatactggctaatcggcagtcggcccagaggtcgcgagtgaggaagcttcaatacatctccgagctcgagcgcagcgtcacaaccctgcagaacgaggtatccgtgctgtcccctcgggtggcgtttctggatcagtagcggacgatcctgaccgtcggcaacagccacctcaagcagcggatcgcggctctagcacaggacaagattttcaaggatgctcatcaggaggcgttgaggaaggagatcgagaggctgaggcaggtataccagcagcagaacaccaagttgtccggtggtctggccgctgaccacgcacatgtccatggcggcccgccgcctgtgcgagcagagaaggagctcatgagctagctgatcaatttgcctactgtcccctgtgcagtctgccttagcattaactttggagggaacattgcatcatgaacctgtggatgttttcttcttcttcttctttttgtttttttattcttttacattgacttgtgtattcttgattcggatgttgattggagttctggtttacaatgggaattgtgggagatgtcaataagaaaatgtgaactgcaataagattaactgtg

SEQ ID NO: 5954 - DNA, 1484 bp, Oryza sativa
  Predicted polypeptide sequence is orthologous to G1051, G1052
gaggtttcgggcgtcgcgccatcgatcgcgggcgcgcatttgcgttgattccgggccaggctccctccccggccatggcgcagctgccgcccaagatcccagccatggcgacagcttggccggagttcgggggcgggcaccatcaccatgctgcccacggccaccatcaccagcgcagcccctccatgggggcgttcctcgcggcgccattgccgcccttcccgctcccgccgccggcgccggcgaacggcggggcgcagcagcagcagcagcagcagcagcatcagccgtcctgggtcgacgagttcctcgacttctcggcgaccaagcgcggcgcgcaccgtcgctctgtgagcgactccgtggccttcctcgaccccgtttccgacgacaatgccggcgtcggggcgcacgacttcgaccgcctcgacgacgaccagctcatgtccatgttctccgacgacctgcagccgcctccaccgcagcaacagcctgccgcgcccgcggcgagcgcgtcgtcgccgtcggaccacaacagcatgaatgacgagaagcaagacaagggcgagacagatgaggcgcagagcgagtgcgacggcgccacgcccgggcagccggcctcccccgccaccgtcgatcccaagcgcgtcaagaggatcttggcgaaccggcagtccgcgcagcggtcgcgcgtacggaagctgcagtacatctcggagctggagcgcagcgtcacgtcgctccagacggaggtgtcggcgttgtcaccgcgcgtcgcgttcctcgaccaccagcgctcgctgctgacgctgggcaacagccacctcaagcagcgcatcgccgccctcgcgcaggacaagatcttcaaagatggaggcactgaagaaggagatagagaggctgcggcaaatctaccaccagcaaagcctcaagaacgcggaatcccaaccggcggacgcggccccggtccgcggccgcgacaatgccgacctgatcggcagcgagggggccgccgcggccgcgccatgcccgcactcgtgatcggccgagatccggacgctctctagacctctagcgaggtggcgccggcccgtcgcgacaaccacgagcgttgccgcgggggtgggccggcgccgtgttaggattggtgcattgttaatttgggttttgcattctttggggtgtaatgtaacatgatttgttcattcgggttgcttttgttcattcttgtgcatcctctgctgctgctgctgctgctgctgctgctcctgattcttctctacttccctgatttgtaattttattccggcattttgggcgaaggttgtagctaagaattgtaattcagattgggtgaggtcaagtgttttgtttggctggtttttttttctctttttcttttttgtatctgataaaatcaaatgtaatgttccttcatttttcctgtatgatccactgtatgtatttacagctatccatcagtc

SEQ ID NO: 5955 - DNA, 1170 bp, Oryza sativa
  Predicted polypeptide sequence is orthologous to G1051, G1052
atggcgcagctcccgcccaagatcccggtggcggcgccggggcaccaccagcactgggcctcggccgggggcgccggcgacgcggcgtgggcggatgagttcgccgagttcgcggcgtcgcggcggggcgcgcaccgccggtcgctgagcgactccgtggcgttcgtcgaggtggcgccggcggggtgcggggcgggcggcgagttcgacaggctcgacgacgaccagctcatgtctatgttccccgacgagggcgggtcgtcggccccggggtccgacaacggcggcagcgacagcgacggcggcggcgacaagcacgccgcggcgcagagcgacgacgggcagcacgccgccggggagccgacgcaggagcaggcggcggccacctcgccgacggagctgatccgggaccccaagagggtcaagaggatactggctaatcggcagtcggcccagaggtcgcgagtgaggaagcttcagtacatctccgagctcgagcgcagcgtcacaaccctgcagctaggaaaccgaacaccctacctcaactctacaaactcacgtcagatcaaccgttcgtggctgtgcaatctgcattctgtgcgatgtagtaagcgacccgtcgatgagtttcacggacagaagtggcgccagtttgagaccgaccgatggacacagccacactggttggctggcaatagcacacaatgtggcgaggagatgagcgagagcgtgagcccccaccctcgtgcatatgcacgcctgcggatgtcttacttcacctcaccccccgtacggcaccaaccagcccacgtagacgtagtggcaatggcatgtcatgccatgatccagacgcacatggttctgcttctgcatggatggattggccagtgggcagtgaacgaggtatccgtgctgtcccctcgggtggcgtttctggatcagcagcggacgatcctgaccgtcggcaacagccacctcaagcagcggatcgcggctctagcacaggacaagattttcaaggatgaaaccaccggaggcgaaaaacctgcgcagcatatcgttatcgtggaacaccgttactgctccagtttcaaggacaagtcgcacagcgtgcaatacaacatctgcattattcagaatttgcagtatatggatctggatcagcgatga

SEQ ID NO: 5956 - DNA, 2373 bp, Oryza sativa
  Predicted polypeptide sequence is orthologous to G1051, G1052
atgaggcccaagcaaacggaagggagcagcatacaagcagtagcatcggcaacaccagggggcatcgaaagatcatttggacttggcggagctgaagctcccggcggcagcggtgacttgggcggccgcatggagttgataggagagtactgcagcaatgccccatgcaagtggttgttggatttgggcaagggtggtgctcatgacaccaacgcccacaacctgttcgatggaatgcctagccaatctgagatacccaaggaagatcagaggacatctaagcctgtccccatcaattctaccatgaacaaagaggagaaatggctagacaaagctctagatcggatattggagaagtttgaacaaatggaggccaagcgcatgcaagaggagaagatcaatcagatatttcaaaagttggaggacatagaggttcttaggagcaaggcttccgaggaaataattgaagccatcagggcaaccaccgctgttctcaaggctaagtcacctatagcacccatcgcaccacctactccagcgcctaccaagtgtttgacagaatgccccaacaacaactttacttgggcaacgacgagttcaagtcacattggtgaggatactgctccaacagctacctgggagctaggagacaacaaggacaagggccacgccccctgcatcgtcgccaaggactcacccgaggtcacgcccaccatgtgttcaacgaaatactccggtcctaccatcaagcccgatctcactatggctgtagtggttacgtccgccaccactgctatggcctctatggagttggtagctgctgggaatgcaatcggtgccactgacatcaacaatcttgaccaccccaaggtgacgcatgctaagtgttcgatgtctagctccggcgtcaaacggggcactgaacaagttgtgcttgcgtttccgcttatggctagccctatggagttcatgacatcattggtagaaccatctccacccacagggctgaagcttggtgatgccatttgcgtgggagatcaggtgcctatgaagtgttcgatgaaatgtactgagagtgacaataagccactgatggaacaccccaagagaaacccatggccacctgcctggtcaggatggaagaagtggtatatgacctggactacaatcaatcatcaaaggatgagattatatttcgtcccaccctggcctccaccaagtctagtaagttctttggcatgggtgcatttttgtattggagctcttatatttcaaagggtggttttatcaaatgaaatggttgagttggagccctggcctccaccacatgaagcaagtttcagaattttgcctttccaaactagtagcaggaaatgttgcaattatgtcactgctttgagtataattgcatgggatgagaagaggacaaggagtagtagaattattgacactagttttgaggaagggacacaggaatgttggaatccatatctagccttgccaatcctcagctattttaggaccagattgcaatggatgccaccttggctgccattagttggtttgctggaagctagagtagggaagggttgcactactgattttgctgcaagtataattccttggaatgagcaaaagaaaatgattactattgaaacttccacttgctttgagcagaaaatgcaccaaattcgggctttgattttccacgtcagtttgacatcacttgctagcaaggaaagcaatctagttatttgtgatcctgaatcattatctatttggttatcatatgttgatctctgggggatgttgctcaactactacccaactatagtggagaaatggaatatgagaataatttgcatggtgatatcagaatctgaatcatgtttggaatcaaattacattggtttgaatgttgaaagagatttgctatatatgattgctgaagaaaaaggttgcaaaagggtttcacgtaaacagaagtataccactgcggcattggcattaggggatgttaatcacgagattcggcggccattgatttcctacgttgcttgcatatggaaagcaaatacatgcttgcatggaaacctaggaaatcaaaaggcaaggcagctcaggatgaaaatttcttgccatgagcagtgcgcacacgcgggaggagcaaggtatgtcgagcgccacacttcgctataccgagccctccgcccctggttgtcggaccccagggccgacaacccgccctcgacgaacgccacagagtctctcaacgaacggcggtgcgcaccccgctacaacaccgcaaactcggcgaactcatccgcccatgccgcgtccccaacgccggccttcgacttcaacggcatctga

SEQ ID NO: 5957 - DNA, 810 bp, Oryza sativa
  Predicted polypeptide sequence is orthologous to G1051, G1052
atggcgcagttgccgccgagggcgccgagcgcggcggcggcggcggggcaggagtggtcggcgatggcggcggcgggggagtttcttgggttcgcggcggcgaggaggggggcgcacaggaggtcggcgagcgactcggcggcgttcctgatggaggcggcggtgccgatggacgacgtcatcgtcggcgtcggcggcggcggcgagttcgaccggctcgacgacgaacagctcatgtccatgttctccgacgtcgaggcgccggcggtgtccgacggcggcggcgagagggggccggccggggaggcgcacctcatggacatgggtgacggggacgacgggatgggggcgacctcgccggccggcgctggcgcaatggcggcggcggcggccgccgccgccgcggacggcattgccgaccccaagagagtcaagaggattttggcaaacaggcagtcggcgcagcggtcaagggtgagaaagttgcagtacatctctgagcttgagcgcagcgtcaccactctccagatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggaggcgccgacatcgccacggcggcctcaatgcaggccaagcatgagctgctggcgtgcgagggagcggcgatgcgatag

SEQ ID NO: 5958 - DNA, 550 bp, Oryza sativa
  Predicted polypeptide sequence is orthologous to G1051, G1052
agatggaggtgtcagcactgtcacctcgtgtggccttccttgatcatcagcggtcgctgctcaccgtcggcaacagccatctcaagcaaagaatcgccgccctcgcacaagacaagatcttcaaagatgctcaccaggaggctctgaagaaggagattgagcggctacgccaagtgtaccaccagcagcagatcaaggccaccggaggcgccgacatcgccacggcggcctcaatgcaggccaagcatgagctgctggcgtgcgagggagcggcgatgcgatagcggaaggccaccggtgaccggtgaccgtcggccggtggggattttttttttttttttggcaatttgccatgtgtaagatgacacagcttggtcagtagttttgtgcagcttgttaaaaagttggttgattttgttgtttctttataatgttatgtttcgttttgctcatcctagcaaaaaaattgtgctgggatgggagaattgatgtggatgtattgtttggaccccaattacatttgtccagaaaaggtggttgctttcaaaaa

SEQ ID NO: 5959 - DNA, 1656 bp, Oryza sativa
  Predicted polypeptide sequence is orthologous to G1053
atccgatcacacacacaccatagccaaaaaaaacacaatcactcgaccaaaccacacctagctactacaaagctagtgatcataagctaaccttaattagctttaattagccaagaagagacaaagagcaagatcgatcatgtaccaccaccaccatggcggccatggcgaggtggcgagcctccacctcctctcgcctccaaaccctcccttcttcggcgccgccgcgcaccaccaccaccaccaccacggcctcatcaacatggcgctgccgcctcaggcctacttcgtccccgccgcgccgccgccgccgttccaagaagccactgctgcgctcgccgccggcgacgacgccaccgccgcgttggcggtgtttgagctggagcgcatcctggaagaagcggccgccgcgggcggcggcggcggcaatggctcaccgagctcgggctccgacgggtgctgctacggcctgcagggcgtggctccggcggcggaggaggagcggcggcggcggcggatggtgtcgaaccgggagtcggcgcggcggtcgcggatgcgcaagcagcggcagctcagcgagctgtgggcgcaggtcgagcacctccgcggcgccaaccgccgcctcctcgacgagctcaaccacgcattgaggggctgcgccgacgtccgccgcgagaactcccgcctccgggacgagaaggccgagctcgccggcaagctccagctgctgctcccgcggcagccggcgccggagaagaacgccgccgacgaccagagtagctgctcctcggagccatgcaagaacagcactacgactaccgctgctgaatgaattatattattcattattattattattatccaccaaattttcacttgagaggataataatattaacaataatatgtttatcaataagaaaacgtgtataactaaacaaggataattactggggatggaggcatgcatgcatgcatgcgccatgagatcgatttttctgtttcgaggaggtttttgctgtgtatttttacaactaattatatacttatacctgcggttaaattaacatggatcaatggatcatatatattatttctatttacaagttgcaaaactgcagttaatagaacactagtaagacaaaatgatggggtagaagaggcatgtacaactctaaaagtagtagactacttgtcaaaacgttgtgcaactatgaagttaaaaaaaatagtgcctttcatgtaatgatgtcacggggttcaactaacttgtaatggattatgctttgggattgctaatggatggcatactttcttgatgttaagttacccataataacccaactgctgctgctctgttctgtagttcattagctattttacctagttgtatcaaacaaggttctggatgtgtatcaaacaattttggtactcctatatgaatgttcccatcaagatctgaaccacatattcctattcattgagatgcttatcgaataggattccaaagaatcttaaggacgagcccggcaacatgtgccacgaaacaaatctaggcttttgtcaatacataaacgtgagtgttcatcaaaacaaacgagcaaattcaaaaacatagcatatatatatatatataagacaaaaaaaaaataaatat

SEQ ID NO: 5960 - DNA, 1961 bp, Oryza sativa
  Predicted polypeptide sequence is orthologous to G1062
gcacctctgcatctctgccatctccttccccaccccaccgccattgccgccgcggcgatgctgccgcggtttcacggcgccatgtggatgcaggacgacggcggcggcgaccaagaacacgggcaggcggcgccgcctgggcaggagcagcaccaccacgaccagcatctcatggcgttggcggccgcggccgcgggcggcgccgggttcggcgcggcgcaggcgccggcgccgctgctcgatgaggactggtacttcgacgcggcgggtggtggtggtggtggcgcgcatgggtccatgatgctgggtttgtcgtccgtccatggcgggattggggcggggacgtctggtggtgggcatgggcagcagttctcgctgctcaacatgggcgccgcggccgcgccgttcgacgtctccgggttcgacctcgggatcgcctgcggcggcgttggcggcggcggcgacgtggtgtcgtttcttggcggcgggaacgcgtcgaacaccgcgctgctccccgtcgggaacgcggggttcctcggcacgttcggcgggttcggcaccgcggcgtcccaaacgccggagttcggcgggctcgccgggttcgacatgttcgacgcgggcgccgtgaacaccgggggcagctcctcctcctcgtcggcggcggcggcggcggcgtccgcctcggcgcacgtgagcaacaccgcgccgttctccgggcgcggcaaggcggcggtgctgcggccgctggatatcgtcccgcccgtgggcgcgcagccgacgctgttccagaagcgcgcgctccgccgcaacgccggcgaggacgacgacgacaagaagcgcaaggccgccgcgggcgcgggcgcgggcgcgctgtccgccgacggcgccgacatggtgctcgacgacggcgacgacgacggcctcagcatcgacgcgtcgggcggcctcaactacgactccgaggacgccaggggcggcgaggacagcggcgccaagaaggagtcgaacgccaacagcacggtcaccggcgacgggaaggggaagaagaaggggatgccggccaagaacctcatggcggagcgccgccgccggaagaagctcaacgaccgcctctacatgctccgctccgtcgtgcccaagatcagcaagatggacagggcttccattctcggcgacgcgattgagtacctgaaggagctgctgcagaagatcaatgatcttcagaatgagctcgagtcgtcccccgcgacgtcgtcattgcctccaacacccacaagcttccatcccctgacaccgacgctgcccacattgccgtcccgcatcaaggaagagatctgcccaagtgcattgccaagccccactggacaacagccaagggttgaggttaggctgagggaaggccgggctgtcaatatccacatgttctgtgctcggaggcccggtctactgctctctgccatgagggccgtcgaaggccttggtctcgatgtccagcaagctgtaatcagttgcttcaatggctttacgttggatatttttaaggctgagcaatgcaaggacggccctgggctgttgcctgaagaaatcaaggccgttctgatgcaatccgccgggctccataccatgatctaggacaggagagctcaatcaaactccaaaggacagagtagctcaggaattgacaaagtaccggtgtttcctggtcatgtggcattttcgacagaaggaagttcctctttttagtagttttagacctgctcagggcttgctgaaccagtttatcttctagtatttagagtccccaaaaaaaataatgtcagtagtctcttggtgctttaacattgtgttttgaaaccttctgcctgttttttttacttcccggtacatgttttcgtcttgtgtaagtctgaagatgaattcctatcaattaacaggcaaagaaacaggatcattccaagaac

SEQ ID NO: 5961 - DNA, 1493 bp, Oryza sativa
  Predicted polypeptide sequence is orthologous to G1062
gggactcctcttctcttctcttctcttctcagagcgctgcgaggttgccatggacgaggcggaggcggcggcggcggcggcgaagatggacgagctggcgggaggaggaggaggaggcggcggcgactggtcgtacctcgcggcggacgcgctggcggcggcgtcgttcacggcgttcccgttccaccaccaccaccaccaccaccaccgcgacgtgctctcggcgtcgaccccgtcgtcgctgctcctcaacatggacgcggccaccgccgcggccatgttcgacttccaggcggccttcccgtcgtcctccgtcccgccgccgccgcccacgacgacggcggcgctcccgccgttccacgacttcgcctcctccaacccgttcgacgacgcgccgcccccgttcctcgcgccgccggggcagaagctcgggttcctggggccccccggcggcgcgttcggcggcgggatggggtgggacgacgacgacgagatcgagcagagcgtggacgcctcgtccatgggtgtctcggcctcgctggagaatgccgcgcccgtggcggccggaggaggcggcggcggtggcggcggcggtgggaggggcaagaagaaggggatgccggccaagaacctcatggcggagcggcggcgcaggaagaagctcaacgaccgcctctacatgctgcgctccgtggtgcccaagatcagcaagatggacagagcttctatccttggtgatgcaattgagtacttgaaggagctcctgcagaggattaacgatcttcacaatgaacttgagtctgctcctagctcttcgcttactggaccatcatcggctagcttccacccatcaacacccacattgcagacgtttcctggccgcgttaaggaggaactttgcccaacctcatttccaagccctagtggtcaacaagccacggtcgaagttaggatgagggaaggtcatgcagtcaatatccacatgttctgcgcacgcaggcccggcattctgatgtccacattgagggctctcgacagccttggcctcgggatcgagcaggcggtcatcagctgtttcaatgggtttgcaatggatgttttccgcgccgagcaatgcagggatggtcctggactcgggcctgaagaaattaagaccgtgctcctgcactctgctggccttcagaacgcaatgtaatcagcaagtcagaaagcagtcaagaccaatgcactgggatttgatcagtgatcatttgcatcagatgatctggtttatcaaaaagttatagtaagtatggcatatatgctgtttatctaggagaactgatgagatgaggctcgccatctagagacatgtgtgatgatgatgatgtaactgggtttctttctttctgttgtcgtttttttttctgaatgttgtttgtgatgtaataggatctttgtccattgaaaccatgtccattatcatgatgagaatatgaacccagtgtcttttg

SEQ ID NO: 5962 - DNA, 1263 bp, Oryza sativa
  Predicted polypeptide sequence is orthologous to G1063, G2143
gagcacataccattgcaagaaacccttcacatcttactgaaacagctactactcctgctagctagctcaagctcaagctcaatctcaagctctttccactaagctccgtgtgtctagctcatcaatacctggctagctagctagttgcttgatcgatatatatcctagctaagtgatggacttcgacttgttcaattcctacccggaatcgcagcttgacctgatgagcacgatgcttcagctggagcagctcactgcgctcagtgaccagtcgctgttcatggcggcgccgacgtcgccgccggtatcacccatggggaccccttctccccagttctcaccaccgccgcagatgtcggtcaccaccaccaccgccggtggcggttaccaggatcagtataactccatgccggcaacgtacggcgccggtgcgggcgtgcaccagctggacttcgcgatgtcgtcaccgggctccgactccggcgcgccgcagggctcgtcgtcgtcgtcctcgtcggaggcgatgcgggagatgatcttccacatcgcggcgctgcagccggtggagatcgacccggaggccgtgcggccgccgaagcggcgcaacgtgcgcatctccaaggacccgcagagcgtggcggcgcggctgcggcgggagcgcatcagcgagcgcatccgcatcctgcagcggctcgtcccgggcggcaccaagatggacaccgcctccatgctcgacgaggccatccactacgtcaagttcctcaagtcccaggtgcagtccctcgagcgcgccgccgccgccaccggcgccgccgcccaccgcgccgccgcattcggcgccgcctacccagctgccttacccatgcagcaccacgctccgtggtagctgcacgctactagctcccacatggatagatggtgatgagacaatcgtttcccattactatcgcgtctcacatgcttgtcgccgtcgtcgtcgtcgatcgatcaatcaccactgctgctgctgcagcatgcatgatcacatgcatgtgcaaattagtagtacaagatgtaggagactacctgattactagtaccatttattattgctgttgtacgttaccgcatgctagctcgtacgtacgtggctgctccgagcttttgttggactcgcagcccgtacgtgcatgcgcgtttcattcgaccgtaggcttgtactgtactgtacacatttccttctattctacccccctgttcaatgcagtacgtttcccgtacctc

SEQ ID NO: 5963 - DNA, 2228 bp, Oryza sativa
  Predicted polypeptide sequence is orthologous to G1064
gattcacccatctctctctcctcctcctccatgccctacaaactacaaagtacacttcctcttcctcctccaccctctccctctcccactccagtggctggcctggctacctagccacctagggtcatctgctcctactctctagctctctctctctctctaagatcacccggccggccaccagctggggatgaacctgaccaaaacaccataaaatagtgtgtgatctccccacacgcacacagaagctagcagcaacaagcttcattcgcctcaccctctcccatcatatcatatgaggaagcaggattctttccaacctacaatatatcttttccctgatggctagctagctctttctcggactttctttctttctctctctctatccgtctctaccacatcgcaccacctaaccttctcgagctagacccacccacaacgagagggaggcaggcaggccgcccggagacatcaaattcattctcctcttctcttccaaacaaccacctcacttaccagcctaaaaaatccaatcaaagagaggtatagttggtttatatctgtgtatatataccatggcctaattgatgaccatggacgtcgccggagacgcaggaggtggccgccgcccaaacttccccttgcagcttcttgagaagaaggaggagcagccgtgctccagctcggctgcaggaggtggtactgggccatcatcggcgggtggcaacgggaacaatggatcgggaccgggcggtgccggaggggagatgcagctgcggaaggcggcgccgaagcggagctccaccaaggaccggcacaccaaggtggaagggagggggcggcgcatccggatgccggcgctgtgcgcggcgagggtgttccagctgacgcgggagctggggcacaagacggacggcgaggccatcgagtggctgctgcagcaggcggagccggcggtgatcgcggccaccggcaccggcaccatcccggccaacttcacctcgctcaatatctccctccgctcctccggatcgtcgctgtccgccccggcgcacctccgcgcgttacctagccccgccgccgccgcccggttcggatcccgtgcggacgcgtgggaccgggttgtcagcctcgggttcccgtccgagggccccgcctcgtcgtcctcgtcgccgtccccgcttctgttgaacttccactcgggcagcgtcggtctcgatgtgcaaccttcgccttccgccgctgccgccgccgccgacctctccaggaagcggcgctgggagcaggaaatgcagcagcagcaacagcaacaacagcagcagcagcagcagcagcagcaacagtaccagcagcagatggccgggtacacgcagagccaaatgccgggcaccgtgtggatggtgccgagcaacagcacgcaaggaggtgggccgtccggtggtggcggtggcggcggaggaggcagcggggagtccatttggacgttcccgcagatgagcagcgccgccgcggccgccgccgtgtaccgggggagcgttccgagcgggctacatttcatgaacttccctgcaccgatggcgctcctaccgggacagcagctggggctcggcccagttggaggcggcggtggcggtggaggaggcggggaggggcacatggggatccttgccgccctcaatgcttaccggacacaggcggcgacggatgccgccggtcagcaaggcggaggaggaggtggaggaggatctagccagcagcaacacggaggcggcggcggcggcggcgagcggcatcagagcataagcaccagcgactcgtagggctctgaagatcgcgtcgcgtcgcatgcattggcccggtcggtgtgactttgatctgttctttgtcttggtttcattctttcttcttttgttggtttccttccactctctccctaggcaagagcttgcaaggactcacacacttagctgcattccatggcattcttacgtacgtatgctaggctagctagctacctgaacttgtgcttatgggtgagagcgaggtgatgatgcctgggaggatcaagaggagggaaacgcacgcagctgcatgcggagagattgttctttttgttcatttagctctagagtttgatcgagtgcgagcagaagagaaatttttttttatcaagcatggcaatccattatctgcatgccatgacgatggttcatttttttttctcc

SEQ ID NO: 5964 - DNA, 1582 bp, Oryza sativa
  Predicted polypeptide sequence is orthologous to G1064
tacatcataccagaagaaaaaccaattcgattttgccaaattacctagctatagcatataggtaggtagctaggtagcttggttttccctaatagctctagcttgatctctttctagctctaccggcggcgtggcggcggcggcggcggccgcaccactctacatcatcacgtacacctgaccagcttagcgggaagccccacaagaagagtttgtaggtcaccaatcagatcatcagttcatctttgtggttgtgtgggtgtgtgtgtatatatatgccatggcgtgagagtagccatggatgtcaccggagacggcggaggaggagggcaacggcccaatttccccctgcagctcctcgggaagaaggaggagcagacgtgctcgacgtcgcagactgccggggcgggcggcggcggcgtcgtgggcgcgaatgggtcggcggcggcggcgccgccgaagcggacgtcgacgaaggaccggcacacgaaggtggacgggcgggggcggcgcatccggatgccggcgatctgcgccgcgcgggtgttccagctgacgcgggagctcgggcacaagaccgacggcgagaccatcgagtggctgctgcagcaggcggagccggcggtgatcgcggcgaccgggacgggcaccatcccggccaacttcacctccctcaacatctccctccgctcctccggctcgtcgctctccatcccttctcacctccgccttgccggcttggctggccctcgcttcggcggcggcgcgcgggcggcggacgcgtgggaccgcgtcgtcggcctcgggttcggcggtgcggccgacgccccgtcctccgccacctcctcctcctcgtcgccgcttctgctgagcttccactccggtagcgtcggccttgacgtgtcgccgccgtcggcgtcgacctccccggccgccgccgacctctcccggaagcggcggtgggagcaagaaatgcagcagcagcagcagtaccagcagcagatggccgggtacacgcagagccaaattcctgcgggcacggtgtggatggtgccgagcagcaacgcgcaggccgccggtggcggcgctccgccgggaggcggcggcgagtcgatttggacgttcccgcagtcagggagcggcggcggcggcggcgcggcgacagtgtaccgtggcgtgccaagcggactacatttcatgaacttcccggcgacaccaatggcgctgctccccggcgggcagcagctcggcctcgccggcgccggcgggggtggcgaggggcacccggggatcctcgccgcgctcaatgcctaccgcgcacaggccgcgcagccggacgccggcgcggcggcgcagaatggagcgcaaggctcaagtcagcatcgtcagcatcagcatcacggcggcggcggcggcggcggcgacgagcggcatgagagcatgagcgccagcgactcgtagggcttccgttccgtccggtgtgtgccccgcattttctctggttttgatctgttcttctttaattttctccgtttttgtttgagttgttgtctactaatgtctatggctttcttcctcgacc

SEQ ID NO: 5965 - DNA, 1398 bp, Oryza sativa
  Predicted polypeptide sequence is orthologous to G1069, G2153
agcttgagatagagatcgaggtcgatccctccagatcaggccttcaaatcatctactcttccatcaatcctcgactgaaaccccaaggtggcgcagcgagcaagaagcactagctagccagaagctaatcaattgaagggatctatcgatcgatcggaagccgagaagaagaagaagaagaagttaaaccctagcctagcctggatatataggccgcaggtagaagctggcgagccggtggtgggacgaggggcggctcagcctgccggtgacagccgccgacccatccctcggccttggcaacaacgacaccaccggcgccggtgacgacgacatggcgtccaaggagccaagcggcgaccacgaccacgagatgaacgggaccagcgccgggggcggcgagcccaaggacggcgcggtggtgaccggccgcaaccggcgcccccgcggacggccgccgggctccaagaacaagcccaagccgcccatcttcgtgacgcgggacagcccgaacgcgctgcgcagccacgtcatggaggtggccggcggcgccgatgtcgccgagtccatcgcgcacttcgcgcggcggcggcagcgcggcgtctgcgtgctcagcggggccggcaccgtgaccgacgtggccctgcgccagccggccgcgccgagcgccgtggtggcgctccgtgggcggttcgagatcctgtccctgacggggacgttcctgccggggccggcgccgccgggctccaccgggctgaccgtgtacctcgccggcgggcaggggcaggtggtgggcggcagcgtggtggggacgctcaccgcggcggggccggtcatggtgatcgcctccaccttcgccaacgccacctacgagaggctgccgctggatcaggaggaggaggaagcagcggcaggcggcatgatggcgccgccgccactcatggccggcgccgccgatccactacttttcggcgggggaatgcacgacgccgggcttgctgcatggcaccatgcccgccctccgccgccgccgccctactagctctctagctagattaattaattaagcttcatgaattaaatccttgcttaattaattggcatatatatatactcacatgatatatatgatcaacaagctatatatagctagccagctcgagctaattaattaacaaaaggtgagccaatataatgcaagatcgatccaagctatataagtacgtttatacaggtaaattttagtggttcaagtgccagggccatatatatttctctttctttagcatttgtgtgtagtatagcagcaatagcttaatcaaacatcaccaagtaattgctgtgttgtgtgtttggtttacttcacatatctatatatgagtgctaattaaacagatt

SEQ ID NO: 5966 - DNA, 735 bp, Oryza sativa
  Predicted polypeptide sequence is orthologous to G1069
atgtcgccgccggtggcggaggaatcagaggggggtggcagtcgaatgcctgagtcgatgggtcatcctcctccccttctcggcttttcgctcactcccgacctctctccactctccccgacgccgccgcttccccaagaccggcggcgagcagcgagctggggatgcgctctctctgctgccggaaaatctggattcggccgtcatcggcgacggcgacggccgggcggcgggaaacttcaccagcatggccaaatcgacggcgccgtcgacgtggagtggagagcaggtatgccatgcacctctactcctagccctaggtcgctctgcgtgctgttcttctcgccgctggttcccgccgccgtcgcactcatcagaggagcccagcgtggtggcgcgccgcagcgacgggagcggacggagctccgggctcgggatgccacgttagcgaaacaacccacatatactgccaagggacctccgggaaatcgttcggagatgtactgcggtggagtatacatcgccgaacaatctgaaaagcagcgtcttttcttcttctctttttccaattgcaaacggccgcatttggacataaaagttgccattgcaactcatttcggcaattgcaacgagaataaccgtttgttagaaaaggctgcatacacgctagatcaatcaatggagaacaagcccttggaagcacagatgccacctcttcaggacccgagcaggtga

SEQ ID NO: 5967 - DNA, 3213 bp, Oryza sativa
  Predicted polypeptide sequence is orthologous to G1069, G2153
gagtggctggccatgcagggaggtgtgttgggcgtggagaaagctaccgtcaccgccgtcgctgctggtggtggaggcatgggtgtaaaggaggaaatcgtgaaactgtttgtggggtaggtgcccggccaagcaaatgatggaggcgaagctactcaccacattctaggaggtggccatcgtcgacgagatcactgacatgaaggacaaggcctctcgaggtgtggatccgtatgacagatttgggctcatgaccccaaagcactcatgttggctttgttttggtgtttgatttggggctttttacatattctatgggtgtttttatagctatggcaacttttttctataattgatttattttgtcggtttttattgacctctctcttgataaatatatgatttttttgttcttattgcgatgatactttagtggcatcatgatattttggtacctataggtatcagacatggtactcatgtactacggctggtacatatatgtcttgtactgggtccttataggtacaagacttggtgctcacgtattatgtttggtactattaagtatactacatggtaccacataccgacatacgtatacattgacatcatcattgacgtgatagatatagtatattagacctgatactcgggtatcatgttttgtaccaataaatatcatacatgatattccctccgtttcaggttacaagacattttgactttggtcaaagtcaaattgttttaagtttgaccaagtttatgggaaaaagtagtaacattttgaacccaagagaaatttattatgaaaatatattcaattattgatttgataaaactaatttagcattataaatattattatatttgtaacttagtcaaatttgaaaagttaaaacgttagggagtaccacgtaagtataaggtgacgtcaattttaacatgaatatgacgtcattacttaagtatcccgtccgaacggggtatcatttccgagctgctctctttttctaaaaggatagagttattacatagtaatagtaatgatacaatattgaaatattttacgtcaaatataaaatgataaaaaatataatttaatttaaaattaagctctaaagtccccaattctttttttttcaacgtggcgatgttattttctatgttccttaacaacttttatactactctaaacaaattagcaaacataagggattaatgaacaactgggccggcttgtgcggttgtgcctgagtggaatggccgacgctgcccaggaagaaggaaaaagtacaccgaaggtccctcaacttgtcgtggagttacaaaatcgtcccccaaccacaaaaccagacatatgacatccctcaacttacaaaaccgttaactttagatccttcggtggttttgaacccggttttgtccaacgtgacggctgagtcggcgtgggacccacgtgtcaggtgtccacgttagcatctctttcctctcttctctttctctgtttctctcttctcttctccacccttacgtccatagcgcacttcgcgcggcggcagcggcgcggcatctgcgtgctcagtagggccgacgccgtgaccgacgtggccctgcgccagccggccgcgcctggcgccgtggtggcactccgtgggcggttcgagatcctgtccctgacggggacgttcctgccggggccggggccgcccggctccaccagactgaccgtgtacctcgctggcgggcaggggcaggtggtggggacgctcaccgcagctgggccggtcatggttatcgcgtccaccttcgccaacgccacctacgagaggctgccgctcgatcaggaggaggaggaagctgcggcaggcggcggaggacacatgatggcgccgccgccactcatggccggcgccgccgatcctgtactgttcggtgggggaatgcacgacgccgggcttgctacacctgcatggcaccatgcccgccctccgccgccgccgccctactagctctagctagagcttcatgaattccttgcttaatgggcacatatactcacatgatatatatgatcaacaagctatagctagccagcttgagctaattaattaattaacaaaaggtgagccaatataatgcaagatcgatccaagctataactacgtttatacaggtaaattttagaggttcaagtgccagggccatatatatttctctttctctagcagttgtgtgtagtatatcagcaatagcttaatcaaacatcatcaagtaattggtgtgttgtgtgtttggtttacttcacatatctatatatgagtgctaaacagattaattctgaatgcctctctcgaagtcaagtcgcatatgcatgcatagatcgattaatgcatatctatcgcagtcaagtcgcagtgctcatttgctctcttctctcgcacggggcatggggatgccgacgctagggcgcccacggcgcgaggtgacggcgcgagctcactggcctccccgcccccctcgtgcgggccggccggtggggcgaggcaggaaagggaggccggggacgggcggcggggtggcgtagcgacgcggcggcgccgggccgggcgacgcgacggcggcctccacgcgctcctcctcgcggacgcggactgccgactccgcgtcgactccttcccgcgccccctctgctccgtcgccctccgccgttgcgacgctggttgccgtcctgcaccgcgccgtccatcgccggccccgcggcgacacccttcccaggccgccgctcctcccccgctctccgccgctggcgcgccggggcgagcgccgccgccaggatgccgaccccgcacagtaatccttccctaatctcactctaatgtctcacaaacatgcgggccccaccatgcctagtttctctgttaaatccacccatttacctttgattcacttatatatgggacccactgtgccggtccgaccatgcgcccggtcaggagaggaagtaagaggttggctgccgacgtgtatcctgacatatggggcccacgtgggtcccacgctgactcagccgccacgtcaggcaaatccgggtcaaaaccgccgaggcatctagtttgcaccggttttgtaaatttggggatgcgttgtatccggttttgcggttgggggacgattttgtaactcgatgataagttgagagaccttcggtgc

SEQ ID NO: 5968 - DNA, 801 bp, Oryza sativa
  Predicted polypeptide sequence is orthologous to G1069, G2153
atgggcttgccggagcagccgtccggctcgtcgggccccaaggcggagctcccggtggccaaggagccggaggcgagcccgacggggggcgcggcggcggaccacgccgacgagaacaacgaatccggcggcggcgagccgcgggagggcgccgtggtggcggcgcccaaccggcgcccccgcggccgcccgccgggctccaagaacaagccgaagccgcccatcttcgtgacgcgcgacagccccaacgcgctgcgcagccacgtcatggaggtggccggcggcgccgacgtcgccgacgccatcgcgcagttctcgcgccgccgccagcgcggcgtctgcgtgctcagcggcgccgggacggtcgccaacgtcgcgctgcgccagccgtcggcgcccggcgccgtcgtcgccctgcacggccgcttcgagatcctctccctcaccggcaccttcctccccggcccggcgcctccgggctccacggggctcaccgtctacctcgccggcggccagggccaggttgtcggcggcagcgtcgtggggtcgctcatcgccgcgggcccggtcatggtgatcgcgtccacgttcgccaacgccacctacgagcgcctgccattggaggaagaagaggagggctcaggcccgcccatgcccggcggcgccgagcccctcatggccggcggccacggcatcgccgacccttcggcgctgccaatgttcaacctgccgccgagcaacgggctcggcggcggcggcgacggtttcccatgggcggcgcacccccgcccaccgtactga

SEQ ID NO: 5969 - DNA, 1291 bp, Oryza sativa
  Predicted polypeptide sequence is orthologous to G1075, G1076
cacacaaaccctaaacaaacacacacacacacacacacacacacacactctctctctcttctcctctcttctcctattatcatcatcatcatcatcatcatcatcacttgcatatcgaattattaataatatcgatggcaggccttgatttgggcaccagctacctccaccaccaccaatcactgcatctccgccacgacgatggcggcgccggctccgacgacggcggccacgacgacctctcgccggggagcggcggtggcggcgggcccagcagcacggccggtggcgccgggatcggcggcggcgaggtcgtcgctcgccgcccccgcggccgcccgccgggctccaagaacaagcccaagccgccggtgatcatcaccagggagagcgccaacgcgctcagggcgcatatcctcgaggtagccgccggttgcgatgtgttcgaggcgctgacggcgtacgcgtgccgccggcagcgcggggtgtgcgtgctctcggcggcggggacagtggcgaacgtcacgctccggcagccgcagtcggcgcagcccgggccggcctcgccggcggtggcgacgctgcacggcaggttcgagatactctccctcgcgggctccttcctgcccccgcccgcgccgccgggcgccaccagcctcgccgcgttcctcgccggcgggcaggggcaggtcgtcggtggcagcgtcgccggcgcgctcatcgcggcggggcccgtcgtcgtcgtcgccgcgtcgttcagcaacgtggcgtacgagaggctgccgctcgaggacggcgacgaggtggtccccccggcgccggcagggagcgaccagggcggcggcggcagcggcggcatgccaccattaggcgttgatccgtcgggcggcgccgccaccggtgggctcccgttcttcaacatgccgttcgggatgccgccaatgccggtggacggccacgccggctggcctggcgccggcgtcgggaggccaccgttctcatgatggatggatccccatattccggcgagcggccggcggcgaggtggtcggcaagattgaagacatggacatggacatgtacaacaacaagtagcctttcttatctctgaatctttttctcctcttgttcgatctctgtgatgtctgtctttgtgatcttttcgtgatgttttttgtgttaacctgtatgagagtacttgtgttaattgtttcagtcaggtgtctttgctgcttcgaatgtgttgtgaggacatgcactcataaattgatcaaatcaattattattgtct

SEQ ID NO: 5970 - DNA, 918 bp, Oryza sativa; identical to SEQ ID NO: 5144
  Predicted polypeptide sequence is orthologous to G1075, G1076

SEQ ID NO: 5971 - DNA, 916 bp, Oryza sativa
  Predicted polypeptide sequence is orthologous to G1076
ctcacttagcagaaatcctccgcctccatccctcatcgaagttggctccctcttccccgcctccatgactgccgccaccacgacgactaccgcgaccacgacgcgaggacaacgacgacgactgtcgcgaggatgacaacgacacgacgacggtgccgatgcctgtgggggtggcggcggacggaggagagctgtcatcggcatgagagagaggccggcggcagcggtgtggaacttggcacctgacacagggctgcatctgtttagttcgattttcggcgaagaggtaagtcctacgtttcgccggccctggtgaatctatcggctacgttggcgttgttcaaggctacatctgtatattcgacctcttggattgctctggttcggttgatatttttgcctaccaatttatcatgtctctgttaatctagtcttagcatatcgatttagctctatccgctgcttctcgctttagggtttctgccagtatcggctaaatcgtcttgctagattagattatcttggacatctaccaccctaaaaatcagtcaatggcttgattgtatagatattatgtttcttttcatacttagtgctgcatcagttaagtttgatatactaagccgtgcttagagccatgatccctagcctgcttcttgattacctagtgctgcatcagttaagtttgatctactaagccgtgcttagagtcatgatccctagcctgcttctttgattgcaaataagggtttcattggggtttcagccgataaggtatctggatgttgtatcagcttacaaggattacatatagattagatttagccgatgacaataaagattttattatttatctaatattgtggattttatgacatcggatcttcatcttcagccgatgaatactttaaccttc

SEQ ID NO: 5972 - DNA, 456 bp, Oryza sativa
  misc_feature (388)..(388): n is a, c, g, or t
  Predicted polypeptide sequence is orthologous to G1076
ttaatttctctctctgtttgcttctctgtgcatccaaaaattttaaaaacaaggaggagtataaacaactcccccactttaaaaatcattgcttccttttccaacaccgccttttaaccctaaaaacaaaacaccacccctgttccaattcggtttttttcctctcttttttctccactttttttttagattttaaattttttttgctagagctagagaggcgctctgctgctgctacatcagtacatgagctagtggagaagcatggcaggtctcgacctcggcaccgccgcgacgcgctacgtccaccagctccaccacctccaccccgacctccagctgcagcacagctacgccaagcagcacgagccgtccgacgacgaccccnacggcagcggcggcggcggcaacagcaacggcgggccgtacggggaccatgacggcgggtcctcgtcg

SEQ ID NO: 5973 - DNA, 2575 bp, Oryza sativa
  Predicted polypeptide sequence is orthologous to G1078
atggggtgcacggcgtcgaaggtggagcaggaggacacggtgcggcggtgcaaggagcggcggcggcacatgaaggaggcggtggcgtcgcggcagcagctggcgtcggcgcacgccgactacctccgctccctccgcctcaccgccgccgcgctctcccgcttcgcgcagggccacccgtcgctcgccgtgtcgcaccacaccgcgccggtgctcctcaccacggccgcgcccgcgctggcgccgacgccgacgccgccgccgccgtcatccacggcgtcgtcctcgctcccgccaccgacgccgctgctccccaagcaccagcaggcgccgccgccgccaccgcccacgcagtcgcatcagccgcctcctcccgtggcggtgagggctccccgcggcgggccgcgtcgcctcaaggtgccgcacatcctgtccgactccagcgtcgccagcccggcgcggtcgtcgttccggaagccggtggtggggacgccgtcgtcgtcgtcggcgtgggactgggagaacttctacccgccgtcgccgccggactccgagttcttcgaccgccgcaaggccgacctcgaggaggccaaccgcctccgcgagctcgaggaggaggagaaggcccggggctacctccacccccaccacctcaaggaagaggacgaggtcgacgacgacgacgacgagagggaggaggagatgcattgcggcggatgggaggacgacgacgaccactacgcgtcgacgaccacctcggagaccagatcggaggagggggaaatggggaacagatcggagtgcggcttcgcggccagatcggagtacggcggcacggcgccgtcggagtacgccgccgcgccgctgccactgccgctgaggaggagggacgagaggtcggaggccggggactcctcctccacggtcacggcggccgccgagatgcggatggtgatccgccaccgcacgctggcggagatcgtggccgccatcgaggagtactttgtcaaggcggccgaggccggcaatggcgtctcggagctcctggaggctagccgcgcgcagctggaccgcaacttccggcagctcaaaaagacggtgtaccactcgaacagcttgctatcgtcgctgtcgtcgacatggacttcaaagccaccattggctgttcgctacaagttggacaccaatgcgttagagatggagtcaatggaagggaagagccatgggtcgacactggagcgtcttttggcctgggagaaaaagctctatcaggaggtcaaggctagagagagcgttaagattgagcacgagaagaagctttctactctgcagagcctggagtacagagggagggatagtaccaagctggataagaccaaggcctccataaacaagctgcaatcgttgatcatcgtgacttcacaggccgcaactaccacatcctcagccattgtcagggtgcgtgacaatgagcttgcaccacagcttgtcgagctttgcttcgcgctgttgagcatgtggagatcaatgaaccatttccatgagatccagaatgaaattgttcagcaagtccgtggtctggtagacaattccatggctgagtcaacatctgatcttcaccggcttgccacccgtgatcttgaggctgctgtctcagcatggcactcaaacttcaaccgtctcatcaagtatcaacgtgattatatacgtgccctctatggctggctgaagctcacactcttccaagtggacagtaatatcccacaagaggcttacacctcgctgatctctcgtgaactcaccaccttctgtgatgagtggaagcaagcactggaccggcttccagatgcttcggcttcggaggctatcaagagcttcgtgaatgttgtccatgtcatctacactaagcaggcagaggagatgaaaataaaaaagcggacagagacatattcaaaggagctggaaaagaagaccaactcacttcgagccattgagaagaagtactaccaatcctattcaatggttggccttggccttcctggcagtgggcgcgatggcattgaaagccattcgttcgatgcccgcgatcctcttgcagagaagaaaaccgagattgcccaatgtcggcggaaggtggaggacgaaatgacaaggcatgctaaggcagtggaggtaactagatcaatgacactgaacaacatccaaacaggcctgccaggaatgttccaagccatagctggtttctcaggaacagttgttgaagcccttgacgttgtctgcaggcgagctggatcggtgcggtagaagcttgcgctgccagactttccaagaaaccgttcgttaagtctttttgggtggttcagtaatttatatagggaaaatgcaatatatatagctaaaattagtgatgagaatatgggggagaaggctcccttgatgttttgccttgttgggagttggtcattttggttgtagataaatgattttactcaggattgttgatgttcttttgcttgtcctgtgaagtgcaagggaagattacattgtacaaaaaaaaaaaaaaaaaaaaaaaaaa

SEQ ID NO: 5974 - DNA, 336 bp, Oryza sativa
  Predicted polypeptide sequence is orthologous to G1078
atgacagaggcacggcggaggaaaggggacaatcaggacggcggcggcgcggggacaccatgcaacgacgcccacgcccgaagcgatgacattagcggtgacagttgtggcgtagatcaagtgaggcgcgagaggtggaagcggggagcaccgacggcagcatgcggtgcacaggccgaagttggcggtagcgtcactagttcacggggggcgacgggatgcacggcatccaaggtgcagcaggaggacacggtgcgggagtgcaaggagcagtggcgacacatgaagggtgcggtagcattgtggcagcaactcgcctcggcccacgctgactaa

SEQ ID NO: 5975 - DNA, 1767 bp, Oryza sativa
  Predicted polypeptide sequence is orthologous to G1078
atgaagcggtgcagggagaggcggcggctgatgcgggaggcggtgcggctgcggcgccacctcgcggcctcgcacgccgcgtacctccggtcgctcacccacgccgcgtccgcgctctcccgcttcgcggtcggcgagccgctcccggtgtccgaccacgccccgcccgccgtgatcgtccaccgccccgtcgtcgcgccctccacgccgccgccgctcctccgctccatcgagcagcagcagcagctgcggcggcgcgcgcaggagttggaggaggaggtcggcgctgctgttgatgatcatcttgttggcggcggggccggggtgccgtcggtcacgcgagaggaaggcggcggtgatgaggagctgaggatggtggtgaggcaccgtagcctcgcggaggtcgcggcggggttggaggagtacttcctcaaggccagcgtcgccggcgacgccgtgtcgagccacctcgaggccagcaacgacgagttcaagcgtaagccactagcaactctacttaattcgcacattcacatttactgtacatgtggccactgcctcactggccaatacaaaggtggaccgcacagcatcttgggcgcgctttgctgcctgtcggcgccgtcggttgcgcacgaccgcgtcgacagcatcaatggcgagcagaggcatagctccaacttgcagcagctgctggcctgggagaagaagctgtatcgagaggtcaaggcgagagagcggctgcaggtccagcacgacaagaagaaggcggagctgagtgaccaggagtacagcaggaagatcgacgtggacgtcctgaagctcaaggccgcgtgggagaaggcgcgcgcgcagctcacgacggcctcgcaggccgtggccgcgacctccgcgtccatcgcggagctccgcgacacgcacctggcgcgccagctgctggggctctgccacgccacgctcgacatgtggagggcgatgcggcagcaccacgaggcgcagggcctgatcgcgcagcagctgcgcgggctcagcagccggacgtccatggaccccacgacggagatccactacgagaccacgcgggcgctcgaggtcgccatgtcgtcatggtgcgccgccctgggccacctggccaagcaccagcgcgactacgtccacgcgctgcacggctggctcaagctgacgctgcaggaggcgccggccgtcgtcgacggcgccgaggcggtggcctcccccgtcgccgccgagctcgccgccttcgtcgagcggtgggggcaggcgctcgaccgcgtgcactgcgccgacgtgctcaagtcgatcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtag

SEQ ID NO: 5976 - DNA, 617 bp, Oryza sativa
  misc_feature (517)..(517): n is a, c, g, or t
  Predicted polypeptide sequence is orthologous to G1078
tcaagagcttcgccggcgccgtccggtcgctgtacggtctccagagcgacgagctgcgggtagcgcggcgcgtcagccagtactcccgcgagctcgaccgcaagtcgcggatgctgcggcaggtggagaagagctactacgactcgtacgtgccgccgatgggcctctcgctgtggcaccgggggatgaggcattggggggacgacggcatgcacgcgcgcgacgcgagcaacgaggtggcgcagcggagggacgagatagcggcgtgccggaggacggtggaggacgagatgcggaagcacgccaaggccatcgacgcgacgaggtccgcggcggtgacctgtgtgcaggggaagctgcccgccgtgttccagtcgatggccgtgttctcggcgtcgctcgcgcacgcgctggaggccgtgtgccggcatggcacccatgtgcagtagttagctacacatagacacagttcattcgtttgagtcggccatctccatttcctttttccattttactnatctatacgaccatacagtatacactatacaccaaagatatactccgtatacacgaaaccctgctaggatgtaggaatgtataaagactaaataaaaatc

SEQ ID NO: 5977 - DNA, 559 bp, Oryza sativa
  Predicted polypeptide sequence is orthologous to G1078
ttattgagaccaagcttctggagcacagacctgagcaggacgcgaagcagcgcatggagcacctgtcggagaagaaggaaatgctgaatgtgctgaggaagagggtcgaggccgagaaagcgaagcaccacgcctgtatgcgcgatacgcacgatgttactctcaacgggttcaagatcggcctggccagcatattcgagtcgctgaccgaattctccaaggattccgtcaaactctacgaagaccttctaacgcatgccgaacccaaaggttcggaggacgctaccgagaaacggccctgcgtggaggggccatactctcagatttcagtggatgctacgtgactgtctcagtgcccccacattcagtaggagcttgttgcatttgccccagtttttggacccctagaatgtgcgtgctgatgttaacctgtagagtagtgtagtagtaccatgttggttgtgtgtggtggggcggtagggtcattcttgtgggcatctacttactgcttgtaattattcgttttagtttgatatcagagaggattgattcaaaaaaa

SEQ ID NO: 5978 - DNA, 3145 bp, Oryza sativa
  Predicted polypeptide sequence is orthologous to G1079
gaccaccatcctcaacctcaatccccatccattccattccatcctgcacgagttctccactggagtggagatccgtactatacttttttttattattaccacctgcccgcaaaaccaaatccccgcaccttcctctttccccttctttctcctcccaaaaccgctctctttcttctcccaattgcccacctaccggaagagaggaagagagagagagagagatgggttcttgcggattgaggagggtcagatgatgccattaccaatttaacatcttctgcatcttttttttgcctttcttggcatattcttctcttctggatgtgtagatccttctttccccagtcctgcttagctttcaagcagaccaacaggtccgagattggtgacctgggagcggtttcttgaggtgtggtgccgttctgggtaagatcgactctgttgccctgcaagaattcgatgcaggagtaagggcggcggcagtatgtaatttggtgggcggttgttggagaagaggagcaattttgcccatcggtttcttgggtgcaaattgagggcaaatttcggtgaatttcgtcggaaattgaggaagcccgtttggcaatcggtcctgtccatgtcccatgcctagaagctggggcattttgggtgtgaattgtgacgaattccagccaatttgggttgggccaggaaagtaccctttgggggtttcagtttgtggtgtgatctgcaatctttccaagattggtggggagttctttgtgtgtgctggtggcaaatgggttgcacacactccaaggtggaggatgaggaggccgtcaggaggtgcaaggataggaggaagctgatgaagcagctaatgcggcgccgagttgagcttgcggctgcacaaaccgcctacctgcagtcactccgaaacacaggagccacacttcgacaattcgccgaggtggagtctgcattgtcacagcagccccctgcaggtattgcagtgcatccatcaccaccaccacctccacctccacctccaccgccaccaccggtgccagtacctcctgcatactcagtgacatcctcagtgccaccgtactcgatgacatcctcattgccaccctcaccacgccctccaccaccgctaccgtttagtccaatagtgataaggaggaaaaagagagacggtgaacttgatgaggatgattctacagacgacgacgacgacactgacagctgctcgactcctctaccacctcccccgccaccaggggttgagtgggagtacttggaaccttttgcaatgcgtcccttaaattttccatcttcattggctgataggattgataaagaagcggcctcacaggtgaccatggatgatgataactgggtggagactaacacagaatttgatggatatgacgatgaaagtgtgtctggtaatgttgaaggcattgtgagcagtgtccagttgaatcaagccaagagtagggctctaggtgatgacaattcatcaatggttagctgggtgacaaaggactcagacacttcagcgatggcctggaggagtaagaagtcgctggcaggaattgccaaggagattgatgaatacttcttgaaagcagcggcgagtgggagtgacatcgtcatacttttggactcttctggtgggcagccagatccctcagagttagaggcaaacagaggaaaaaattccaaatccgccaaggttttttccacaatttcttggagctggtcattcaaatctgcgcaagctaatagacaatcctcaatgcattcaagtgatgcctctggatatggttaccatggcaaaacactagagaaactttatgaagaggagcaaaaactctacaagttagtcaaggatgaagaatttgcaaggctccagtacagaaagaacacctcgttgctacaaagactagaatcaggtgaccatgataaattgcatgcagagaaagtgcgagataatatagaggaattgcaagctcggataatctctttggaggaagctgttggtttgacatgtttgtccatatcaaagctcagagatgaggagttatatcctcagattattgaattatctgcagggcttgtgcatatgtggagaaacatgtatgagtgccatcaggttcagaaccacattgcccagcaagccaatcttctaggcaatttaccagggaatgaaccaacaactgacactcattgtcaggcaacatctcagctggaagttgaagtttctgcatggcatagttcattctgcaatctcatcaccttacagcgtgactacgtaaccatccttaaccagtggattaaactcactgattgcctgcctgataacgatggctttatgaaaagttcgtcaggaattcgtagtctctgtgcagaactccagcgagctcttacaggattacctgagaaggtagctgcagaagcaataaagacttttctgtcagttatacacactatagttgtacagcagactgaggagcgtcaactgaagaaaaagtccgaccaaatcgagagcaagttccatacccagttagagaaacacagcaacaatgcaacccaaaattcgggccagcctacacttgcaaagctggacacgttcaaaaagcaggttgaagaggagaaggctaggtatctgaactccgtgaggactagtcgagccatgacactgaacaatcttcagacgagccttccaaatgtgttccatgctctgatggggttttccggagtatgcgtgcaggcgttcgaaggtatcagtagatgcagtgagattgtcgccagccactcgggagcagtttcacctgccatttcttcgtgactgcatccggcatggttcgttgtgattgttcattgtaagtaggcaaagaaactggttctacgtgaatacacttctcttccaaaacttaaaaagggaaagaatttagcgacgattttaagtcagtacaggcatagtagtcttttgaatagatcaacatagtctcgatttgggaagaggtggatgtctatgaggttactgggaaatgattcatgtgtaactagatacttgaacagttgaacagtagtctgttgctgcatgttctcaacttctcaattctcattatatgatgctattttctatttctcaact

SEQ ID NO: 5979 - DNA, 4052 bp, Oryza sativa
  Predicted polypeptide sequence is orthologous to G1082
gactaacctagttagccactctattactactacctccgttgccaacgccggaatccatccatccatccccgcgccgcgctgtgccgccgcgagagctttgcggcgggcatgcgggtggggattcaccgcggggtggaagaagctgaagcagcagctggtggcgcaacgccacgaggcgcaccccgctggcacccacaccaacaaaaggagaagattctcgccaccaccactcccactgatcccctcttcttcctcctcgttcgcctgccatctccggagccggaggaggaggaggagtagccgccgcccagatctgcgccgccatgctgccgctgctgcggaggcggcggctgtgaatagctaggtcgtttttattgttgtttttgggttggtttggtttgattccgatggggtgcgggcagtcgaagatggaggaggagtacgcggtgcggcactgcagggagaggtcggagctgctcgccctcgccatccgccaccgctacgcgctcgccgacacccaccgtgcctacgccgaatccctcgccgccgtcggcgccgtgctccacgacttcctccgcggcgtccagtcgctgcccccgccgccgctcgagcccacgctccgccttcccgcccaccgcaagggcgacaacctccccaccgcctcccccgtcccggccaaccccgccatcgcctcctcctccgccgcccagccgctgccgcccgtcgccaagcaggtacgaatcgccgccgcccccgatgacggcggcggcggcggccacatccacttctcggacgacgactccgattccgagggcggcgggcacatcaagttccactccgacgacgagggcgacgcgcccgctcaccgccgcccagagatcgtccgctccgccgcgccgccggtggctccgccgccgcagatggggccaccaccaccgtatggctccggatatgctcctcctccgccttatggttcgggatacgggtatggatacggccccgcccccgattacggcggcggcatggccgttgccaacggcggctatgacccagggtatggtggtatgggcggagccagtggcggcggcggcggcggcggctatgcgcctggatatggaggcatgggagttggggatggcggcagcggtggcggctatgagccagcctatggcggcatgggcagctatggccaaagcttcttcaacatcagctatgcgcgcagccagccgcctccgccgtccgtctcatacgagcaccggctgcaggccaccgatgccagggtccactactacgccggagaaggcaaccctcaagcacccccactcgggtatggcggtgggtatggttatccgccgcagggctcgagctcttacaaccagtatgcgtacggtggttactatggtggtgcttctcctccgcctccggccgatataccttctacctcccgcggggaggttacgccaccggcacctccatctccgccgagggtgtctacttgggacttcctgaacccatttgaaacctatgagagctactatgagcagccaactgctgctcaagcgtcatacactcccagcagaagttccaaggatgtgcgtgaggaggaaggcataccagatttggaggatgaggatatggaggtggttaaggaagcttatggtgatgagaagcacgccgccaatgggtacagtggcaaggggaagatggcaaaagaggaaggtggtaggagcagcaccggggatgaactgccccatgaatccaagttatcggaagcgagcagtagcgggagcaaccaggagcatgatgtccatgtagtggagaagagtgttgtgggagaacaggtgcagcggtcagagcctcgtcagcatgtcgcaggcctgccgcccataggatcggagaagacgtactttgatgatgctgaggtggtgctggagatcaggactcaattcgagcgtgcctcaaaatctgccattgaggtgtccaagatgcttgaggttgggaagatgccttactacccgaagagttcaggtttcaaagtgtctgcgatgatgatttgcgggataccaacaatggaggaagagttcctgcggtttgaagaagacaaggcgatggggtgtggcaatctttcctcaacactgcagaaactgtacatgtgggaaaaaaagcttcttgaggaagtcaaggctgaggagaagatgcgggcgttgtatgacaggcaacgtgaggagctgaaaatattagatgagaaaggtgcagaagctgataagcttgaggctactgaaagatccatcaggaagctatcaacaaagataagcatagcaattcaggttgtcaacactatctcagacaagataagtaagctgagggatgaagagttatggccgcaaacatgtgagctcatccaagggttgatgcggatgtggagcactatgttagaatgccatcagatccaattgcatgccatatcccatgctaaaaacatagattccatgataaacggtgcaaagtttggtgaagctcacatggacttgatcaagcgcctagagcttcagcatttggattggatagcctcttttgcctcatgggtgaatgctcaaaaaagctacgttggtactttaaatgactggttgaggaaaggagtcacatatgaacctgaggtaactgatgatggtgtgcctcctttttctcctggacggctaggagcgccacctatttttgtcatatataacaattgggcagttggtgtggggaggatatctgagaaggaagtagttgaggcaatgcaggcctttgcatctaatgttcttggcctctgggaaaggcacaggtcagagcaaagacaaggtcttatggctaataaaggtatggacaaggaccttagggtgatggaaagggatgaacagtcgatgcgcaaggctctggaagcacaaaataagaagctggtgctcatttctaatcagagcggtgtatccttatcagcacaagcacaggccttacaagatggaggttcccatggtgatactggtagtttgcaactaagtctgaagaatatttttgaagcaatggagaacttcaccgccaactctgcaaacacctacaaggatctccacctgcgtgctgaagaagagaaagctcgcgttgcccaagagagttgcagagtttcctagttcctttcgtggtttccatgttacatgagggcatgagccctttttaacgcaaaggagctgactgcagtggttcagatgagcactatagtttgcatggcagcgtcacaattcaagtggcaagtgatgcaccttgcatgaaatagcttctacccagggctgcgggctgccagacaaacctgtggcgtaaatggagacttgctagattgtgtttttttgaattggagcaacactcctcatgccatacagcccaggaactcaattttgctaatagctgaatcacaagacattgccgataggggaagaaaaatctgaagtggcgagtgacaagattcactcaatgttgggaaatcccagtaaatagttggaagatgtaagctgcataaacgaaatgcatggtctaagcatggagcagtaaaatgttccgatcatgagtccaagattcatgaagttgtatccatccatatgaaatagtcaaatgtgatcatgctgccaggttcagggaaagagtcactggaagagtgcaacaatgctagcatgccagtgtacatagttgaaggcaatgcgatatgggatgaaccaaagctgatgctgtgggagatgcttccctcccagctgggaggctgcagcctagctagttcacctgttaggggagtgatggatgatgatgagcttgtaggatagagaaaaaaagtggatgccctgaccccgttctgcagttcactaactgttggatttttttgttccgttatttattatacatataattcatttgtatccctgtacagccggtggctaactcataaacccccccttttttgtgtcatgtttattctatttctcccccatcgactttgcctgtttctgcttctctctcttttaatcgcg

SEQ ID NO: 5980 - DNA, 1661 bp, Oryza sativa
  Predicted polypeptide sequence is orthologous to G1082
taacgtcgccgcgtccgttccgactccccggagagccgccgatggtgcagacgttgccggcgagatcaaggcgcagtttgtccgagcggcggacgcggtcagggcgctcgcgccgattcttgaagtcgggaggcggagctaccatccccggagctcagtgtaccatgtttcatctcggatggtgtcagtgattgcgctgccgcattcaggatacggaggcagcgacctgttggatgtcggaggaggggagaaggtggtgggagcaaggaacttgtctttgactctgcaaaagctctatatctgggagaagaagctgtacgacgaggtgaaggctgaagagaaaatgcggctcctgcttgccaagaactctaagaggctgaaattcttggatcaaaaaggcgctgaagctcccaagattgatgcaactcgtaatttggttaggaagctatcaacaaaaatacggatagctgtgcgagttattgctaaggtgtcgaaaaagataaacagagtaagggacgaggagttatggccacaagttaataccttaatccaagggtttgtgaaaatgtggcaagataagctgaactgctaccacatccagtgtcaagcaatatcagaggcaaaaaacttggattcaataatttctggtggaaccagtcgagatctggcaatggagcttgaactagagttgattaaatggatcgtcaatttttcctcctgggtgaatgagcagaggagcttcatcaaggcactgaatggatggctggcactctgtcttaactatcagcaggaggagacggctgatggagttcctccgtattctcctggaagagtgggcgcaccccttgtgtttgtcatctgtaatagctggtcccaagctatggatcggatttctgagaaggaggtgattaccagcatgcaagctcttgtgtctagtgtacggagcctatgggagaaacaaaatgttgagcaaactgaacagctgattgcaatccgggaaagagaaaaatggaacaagatattggaaaggaagaccctggagattaacaaggaggccgacacactcaacagaaagctagctctagtaccgggccggcaaagccttcttccaacagcacaaacgtaccaggtccattttcttgaggcaaacagtgtgcaggttagtttgaagcgtgttcttgaagccctagaaagttactcttccaattccctgcgagctttggatgagaccctgaggcatgccgaagaggaaaggttgtctagagaaagagccaaagtttcataggcattggcatagaggttccatctgacactacagtgaacacagcttgtaaaatacaagggtctcctctccaggtggttataatttatcagatcaatgcagaatgttctgggcaaatgctgcttgcagatcaaatttttgtggggaagttctgactttggagttttgctaactgaccgttgtttgtcgatgcagttcaggcaaatgtcctgtgttgatccatcataatagatatagttgtgttgaagtagcaggtacattaggtacatataggtgaagtgctcgtttcggtgctagtatgcaatgtactgatcttctgtgttgcctttttcttggcctccatacaattgaatgaatgagcaagagtgcacttggaatg

SEQ ID NO: 5981 - DNA, 2814 bp, Oryza sativa
  Predicted polypeptide sequence is orthologous to G1082
atgttatctcgccggcggcgtgggaggagaccacgagccgacgacgacagcgaccagctgatccacccgctgttcaagcgcagctggacctcggcgtccgggacttcgagagcgggacgttgcattgcaccatcgatccttggcgacgtgtgcctttttcaccgccgcccacgtacggctgtcccccccgcttttgctcatctccgctcgccgccggcaaccgccaacccgcgctgtccagtccgtgacgttttcaccgtgcgccggcccgctcgactcgaggacgaagccgaaaagcgcgaagattctcgcgtcgccatcgcccatcgcccatcgccactgtacatggggtgcggccagtccaagactgacgggggcgggggcgggggcggcgcggctgtggcgctgtgccgggaccgcgccgcgctgctggccgacgccatccgccaccgctacgcgctcgccgacgcccaccgcgcctacgccgcctcgctgcgggacgccgccgccgcgctgcacgacttcctccgcggcgtccaggcgctgccgccgccgtcgtcgtccgacgtcgaccacgccgcgccgctgcgcctccccgacctgaggaagggggaccactcgctccccgccgccgtggttcccctccccgtcgacgcggtggtcatcaaacaggttgacgacgacggcggcggccacatacatttcccctccgacgacgacgacgacgagggcggttctgatggtagtggtggccacatccatttcccgtccgacgacgacgacgacgctgagccgcctcccccacgccccgccgcggctccggcgccgcacgccgccacgctatacacctacgctccgccgtacggctacggccccggcgccgggcagtatgaatacggcgtcgacatgggcggctacggccagagcttcttcagcatcagctacgcccggagccagccgccgccgccgtcgtccgttgtgtcctacgagcaccgcccccaaacggtcaatgcgactgttcactactacccgggggacggcgccgccgggccaccgcttcccggctcctactacggcagcgccgcgccgccgccatcgccgccgcgggtgtccgcctgggacttcttcaacccgttcgagtcattcgagagctactaccaccaggaccagccatctcctgctccaccggcctacacgccaagccggagctccaatggcgcgcgggaggaagatgacaatggcatccccgaggtggagcacgacgaggtcgacaaggttgacaaccaccaggatgccaatggcatgccattgccggcgaaggatgtcagtgaggagcagcacaggaagtccaagtcctcggaggccagcagtagtaccagcagcagcatgatcagtgatctccatgtagttcagaagagtgtgattgaagaacagctgcggcattcggatgccgcggggcctcccgcgatccccaggaaggtttacaatgacgatgtcgaggtggtggaggagatcagatcacaattcgagcatgccgcaaagtccgcattcgatgtatccaaggtgcttgaggttgggaagatgccttactaccagaagagttcaggattaaaagtatcctcgatgatgatttgtgggctatcttcggtgggggaggagttcctgcaatttgaggaggacaaggctatggaatgtggtaacctttcttcaacattgcagaagctgtacatgtgggagaaaaagcttcttgaggaagtcaagtgttgggttatactcaagcaactttgtttatcacagactgaggagaagatgagggtgctgtataaccaaaagcgtgaggagctgaaagttttgtatggaaggggtgccgaagcacacaagcttgaggcaactgaaactcatatcaggaagctatcaacaaagataagcattgccattcagattgtcaatactatctcaaaaaacatcaataatctgagagatgacgaactatggccgcaaacatgtgaactgattcaagggttaatgcaaatgtggcatgccatgtcaaaatgccatcagatccaatgccacgccatatcccaagctagaaacttggactctaagctagattctgcaaggttcagtgaagctcacatggacttaatcaagcggctagagcttcagttactggagttgatttctagttttgctacatgggtcaatgctcaaaagagctttgttggcactttaaatgagtggctcaagaggggaattgactatgtgcccgaagttaccgatgacgggactccccccttttctccaggacgcttaggagcgccccccattttcatcatctgtaataattgggcaatcggcacgggaagaatatcggagaaggaagtagtagacaaaatgcaggcttttgcctcaagtgtcctgcacctctgggagaagcacaggttagaatggaggcaaggtatgatggctaacaaagatatggacagggaccttagagtgatggagagggatgaactctcaatgcgcaaggctctcgatgcgcaaagcaagaagcttgtgcttgtttccaatcagagtggcgtgtcgttatctgcgcaggtggttcacgatagtggtccaactgctgaagttggtttgcaatcttgtatgaataaggtctttgaagcaatggagagcttcactgccgcttgtgcgaatgcatacagtgatctccatcttcgctctgaagaagagaagactcgactcggccaaaacaatggcagagttcctagcttcatttcagacttagctggtaagtacatagcaagtaactga

SEQ ID NO: 5982 - DNA, 2289 bp, Oryza sativa
  Predicted polypeptide sequence is orthologous to G1089
atggggtgcgggcagtccaagatcgaccaggaggaggcggtgtgccggtgccgggaccggaggaagctgatggccgacgccgtccaggcgcgcaacgccttcgccgccgcccactccgcctacaccgttctcctcaaaagcaccggcggcgcgctctctgacttcgcccaaggcgagacgcccgacctggtggcctctcacgcccacctcgccgcccccacccaggcggccgcttccgtctccgcgcctcctcccccgtccaccgccgccgtgctcatcgcgccctccccgccgcccccgcccttcctcgacttctcccacgccacactccagcgctcctcttctactccaaacatcccgatgcccgaccctaaggccgccaccaagacccaactcgccgctggcgcatccatccgggaagaggacgaggtggaggatgatgctgacggccatatcagaacagaaagcgaagatgatgatgacgacgacgaagacgacgatagcgatgatgaccaccatgagcacgatgatgtcctcgtggaagaaatggtacacggacagccgcagaagcgggttatgatgggcagcgtggggtcttctccagtaacgccgccacccccaccacggccgaacccatccccgccagccaccaggacaacaccaccacccccaatgcctgagcctcagatggctactacctgggattacttcttcggtccaaccaccacaccgccgcccaccctggagcaacctcctgaggagtcttggatggataagcgggagaaggagtcagtgccggagatgaaggcaccgattatgaaaccagctgttgatggatcagctgctcctatgcatgttgcggaggagcaaccaccacagacagcactggagaaggaaaaggccattgaacagcttgcggcaaaccttcctccatcgaagccacttattagaaagccgcccaaagcggcacctggccctccagcagaagttcgctaccagcatgcctcatctatgggtgcggttgaaactcggaaggggaagacgatgtcaggtactgccagtttgctgcaaattgttgctcagcttgatgattctttcctcaaggcttcagagagtgcacatgacgtgtcaaagaagcttgaggccacccgaatgcattaccactccaaccacgccgacagtcgaggcaagtttgaaactcatgccacagtacttgataggatgcttgcatgggagaagaaattgtatgatgaagtgaaggcaggggaacttatgaaaattgattatcagaagaaggtagccctacttcataaacaaaagaaacgtggtgtgaaactcgaaacccttgagaagactaaggctgctgttagccacttgcacacaaggtacatagtggatatgcaatccatggattcaaccgtctcagaaataaaccgactacgtgataaacagttatacccgaagttagtggaccttgttgatggaatggcaaacatgtggagttctatgcatcatcatcataagtggcagttggttatcatatcaggaataagaaattttgaggctccaccggttccaagagagacaactgatcagcattacaagcagacttgtgacctgcgtgacattgtcagggagtggcacatgcagtttgagaaactcatggaccatcagaaagggtacattagagcactaaatgcatggctcaagcttaacctcatccccatcgaaagcaacttgaaggagaaagtttcgtccccgcctaggctggtggaaccacctataaaagatctgctatatgcctggcatgaccagcttgaaaggcttccaattgaacttgcaaaaactgccatcaaaagttttgctgaagtcataagcaatattgtactacttcaggaagaagaagtcaatctaaggaggaggtgtgaggaaactcgcagggatctcaaccgaaaaaaagcacagtttgaagaatggcaccaaaggtacatggagagaaaggcatcacaaggcgaggatgctaataacagtgaagtggctgaagctgtgaactcagatcctgtcgccgacaggaagacggccatcgaggaagtagagattaggctgagggaagaaatggggcatcacaataggattgccaggcaggttagggagaaatcacttgccaaccttcggatgcacctgccagagctcttcagaaacatgactgattttgctggcttctgctatgaaatgtacagcaatttgagaaaatctgctgtactgcccaaagatgaagtgcaaggctga

SEQ ID NO: 5983 - DNA, 630 bp, Oryza sativa
  Predicted polypeptide sequence is orthologous to G1089
atgaagttaagcatgaaacgacccccgtacaaccgcacttctcgtatggaaacatggacgcctagagtgcatgaggatttaagttcatggatcgggtactgccaatgcgaggttatcgaaaagctttgccgtgacgcgtctcatgtgttgggacgaggctcatgtgttgggcagtcgcggagtgcgggtaaagtgtacatccactgcagtttgttggcctacctggccctaataggggagggtgccgccggctgccggctcccgcccccctcccatccgtccactgccatgctccctgccaccctccgcgcggccacgccgccagccgctgcccgccgacagccaccagcagccaccagccaccagcggcgccctccgcgccggccgccgccgtcccgcccggcctcggccgcctgggcttgctcgggtataggaggaggaggagatggggagggggaggagaggggaaggggagaaggtcggatcggatctgaggaggaggctgagagggagttgtttaatgagagggaggagagagaggaagggggagggataagatcgatactggcacgcgcgcggctcggggtggttttatttttggtccctgttgtttataccaaccgggactga

SEQ ID NO: 5984 - DNA, 2214 bp, Oryza sativa
  Predicted polypeptide sequence is orthologous to G1089
atggggtgcgcgcagtccaatgaggacggcgagggccccgtggcgcggtgccgcgagcggaagcacctcctgcgcgacgccgtcgccgcccgccacgcgctggcgggcgcgcacgcgggccacgccgccgcgctcaagaacgtcggcgccgcgctctccgactacgcctccggcgagggcgaggcccacgccggcggggctctgcggtcggggtcggctgactcttcggccgcggcggcggcgctcgtcacggcgtcctccgatggcaagcccgtgctggctatcctgccgccgccgccgcccgagcttcccccgcctcccccgcccccgccgctgcctccgcatggcgacgttgaggcggcgccgctcgcgaggtcgatgagcgcgccggacctgcacctgcagcagccgatcaagaagaagccgtccggcgaggcgcccatcatggaggaggaggacgacgagggcggcgacggcggcgacgcgggaggacggcgaggtgacgacgacgccgaactgaagccacccccgccgctcccctcgcagcgcccccctccctcccgctccccgcctcccctcccgccggagaatgaccacaaggtggacacccccggcgggttcatcagctccttgttcgactccatgccgccgcccactctggacaccgccgccgccgagccatcgtcttcggcgtcggccgagcggagagaaccaccaccccccgcgccggacgaacaccagccatcggcggcggcgagagaggtggcggagggcaagaggccggccgcggcagaggcggcgacgacgcggcgggcgatgacgcagaaggcggcgaggaaggggaaggcgaaggcggtgatgctggtggcgccgccgcagccgcagccggccaagctgggcgtcggcgacatcctccgcgccctggacgaacacttcctcaaggcgtcgcagagcgcgcacgaggtgtccaagctgctcgaggccgccaggatgcactaccactccaacttcgctgagacgcgaggatttgtggaccattctgccagagtgatgcaagtaatcacttggaatcgctcgtttaaagggatacctcaaccggaaaatgtgaggaatgaaatggacgatgacgaatgggagacacatgctaccactcttgataagctgcttgcatgggagaaaaaactataccatgaagtcaaggattttgaggttatcaggagggaatatcaacaaaagctagctgttctcaacaaaaagaagcagcgtggtgtcacttcttcctcacttgagaagaccaagtcggttgttagtcacttgcacacaaaatatgtagttgatctgcaaacaatggagtcaacagttgcagagatcaaccgtctcagagatcaacaattatacccaaaacttcttgaacttgtgaagggaatgtggcacatgtgggatgcaatgtaccttcatcacaaaacacagctcaagatcatcttggagctcaagtcgttggacatctcggtcgccccgcgggaaacaagcgagcaacaccatgaccggaccgtgcagctgtggaatgttgtacatgagtggcacactcagttcgacaagttcatgacataccagaagcagtatgtgggatccctctacacctggatcaagctgaatgtgatccccatcgacaccaacttgaagccaaattcatcacagccacatgagaccacacctcccatcaagagggtgctgcatgcttggcatgaaatcctcggaaagctccccgatgaggctgccaagaaggcgataaacacgtttgcagagatcgtaaagacaatcctggttcatcaggaagacgaactgaagctccggatgaagatcgaggataccaggagggattatgggaagaagaggaggcaattcgatgactgggcacaaaagtacatccaccaaactgcgggtatccttcctgaggacaggaaccctgacggtgcacgccccgatccgatggcggaacggaaggctgccatggaaaagttggagctttctatgaaggagctggaggagatgtatgtcaagcagtgcagggtggtcagggagaagtccctcagccttctcaggacgaatttgccggagctgttcagagttgtgtcggatttctcacttcagtcagctgggatgttcaagggcgtgtggtcgattgcacacaccaatgaccaactggatgaataa

SEQ ID NO: 5985 - DNA, 1144 bp, Oryza sativa
  Predicted polypeptide sequence is orthologous to G1095
gtgttgcgatggatgcggcggggatggcaggtgcgcccatggcgtcgcccccgccgtacgacaacccgacggctgggttccccatcgcgatcgtgatcgccatcgggttcatggtcacctcgctcatcctcgccagctactacttcctcgtcgtccgctgctggctccgtggcacgggcggcggaggcgccgccggggccgggctgctgcaccgctcgcgccgcgagagcgcggcggagcgcgtcgccgcggtgttcttcaccgactacgaggccgaggttggaggcgggctcgacccggacgtcgtggcggcgctccccgtcgtcaagtaccgccgcgccgcctccgggaagtcggcgtcgccgcaggagtgcgccgtgtgcctgtcggagttcgtccgggacgagcggctcaagctgctgccgagctgctcccacgcgttccacatcgactgcatcgacacgtggctccaccacaacgtcagctgcccgctctgccgcacggtggtcaccggcggcgcgatcggcctcctcgtccgcgacgaccagtatgacgcgtccagccgggaactggccgccggcgagaggcgcatcgacgccgccgcgaggatgggccacgggatcagctcgtgcaggttccccaagaccggggccgagcaggagccgatccggcgatccttctccatggattgcttcctaggcgatctcggccggaagccaccgccgccgccgccgaaggatcccgcaggctcggaggccgggccgagccaccccgacgcggccggtagcagcagtatcgtcggcaccgccggcgccggcgagaccagcggccggtttcggcggttgctgtcgtcgttcgggctcggccggagctcgcggagcacggtgttgcccatccacctcgacccatgaaccacctcgggttcgtgcaacctaattaactcgctcttaccgcttaattaattgagagttactagccatttgtgccacttgtgtgcgtgcaatgtgtacagcagatagcagaattggggttggaattttgccgttccattgattacttcttggctccttgcatctcaagtgttcccgcccggacatgtcaatctttcgtacgtgatcgatcgatattaattagttggtacatc

SEQ ID NO: 5986 - DNA, 1175 bp, Oryza sativa
  Predicted polypeptide sequence is orthologous to G1095
gtctatctagctcagtagctcacctgcttgtgtgcttaagctcgtgtttgcagcaaaccatggatgcagacagggaccccatcttcccggtgcaacagatgccatcactgctgttcccgccaccgccgccacggccattggcactcgactccacttcttcagcatcttcttcttttgtgcctcaccatccatccatcacgagcttcccaatactggtgctcaccgtcctgggcatcctcaccacctccgtcctcctgctcacctactacatctttgtcatccgctgctgcctcaactggaacagcagcagctcctccgacacgcggacggctggcctcatctcccgccgtcgacgcggtgccgcctccagcagcctcccggcagtggccgagccgcgtgggctggaggaggcggccatccaatcattgccggcgttcaggtacaggaaggccatcaaggacactactgctgattccagcaagtgtgcagtgtgtatcagtgagttccaagaagaggagagggtcaggctcctgcccagctgcctccatgtcttccatgttgactgcatcgacacttggctccagggcaacgccaactgtccactctgcagggcagccatagccaccaacgacagccagcttccattggatcagttcgtgagacctgaggtggtagtcattcaggtgatcactggcgcggaagaagaaggtgcacaagcaccacagcaggaggccaatacggcagcttctgatcctgcagtagatgctactagtacaaatcaacaggtcagtagtaagaagacgaagaaccagaatgcatggcatgtcagcatcagtaagggagatgagtgcattgcagtgaggagggacagaaatgttcttccattgaggaggtccttctccatggactcactgggtggtgctggagaggtgcatttgcagattcagaatattctgcagaggagcacccacttccacagggatatcagtgacagcagcagcagcagcactggaacattgtagggattactatgcctgcacattctatggccatgttctatgcgaattcttttggtggtcttgttcaccaatttttcttttctttttctgcaaaatgcaatattacatgtcaatttttctctaatggacacctataacatggtttgtgtgtgtccg

SEQ ID NO: 5987 - DNA, 556 bp, Oryza sativa
  Predicted polypeptide sequence is orthologous to G1100
gcagcactcaacatgcccgttttgtagaatttcattgtgtgactaccctgatagcaagcagacaatgtctcctctaccaagtgaagtgataatacctccatgttcgcctgaaccatcaaggtcagatcaatgcaattgcctgtttgtcggcacggggcattcaccaaggacatctcaggttcttataaatgaacctgaccagtcgaatcggacattatatagtccatcagtggaaggggataacaacttgccatcatctgaagttaatcctcctggtgaaattaacaaccaaacaatgaaaaagcatgtggagaatcatcgtattcaagacagatcatgatctacctagctaagatcctgcaagtgactgttgtgcagtctgctgtcttcagggtaaactacatgtaaaattataagcagcaatacaggtggattcatggatggctgttataggacataggttactttgaaggatgtaaatatgagaaaattgttcaggtttcttgttagaaaacacatttatttgttaatcatattcaagggctcattgcattaa

SEQ ID NO: 5988 - DNA, 2106 bp, Oryza sativa
  Predicted polypeptide sequence is orthologous to G1108, G2394
gggggagaagaaagcgtaagaaaaataaaaggagaaaaaggaatagagaaattggggaagagagctacctcgaatcgaagctgcgatctccacctggtgaaataggagaattgatgaattgctgagatttggtgattagagggacctttgctgctgaggcattgaggtacactaaaagcaagggtgtgaaaaaggcaacttcaattgaaaacatctacatatctaggaatgtcctgaaactaatgtgtggagtaaacttctagtttattgctgtccgtcctgttgggccacagtgcgaaggtcaggcagatagtcatccattactgatgggggactctggaaatgccagtcatcgtgatcacacgatcgacatactgagaaatgatgcaactttcccatcaacatctcatcaggataatcataataacttggatgagttgcaccaaactagagggcctctaaatgatgttcctcatgtcccagaaagttctgctagtgcaactcctgcatctatctcccgaaacgcttcttttgcaagaagagatcaaggacaccgtcaaccaaatcctttgaattctggcttctggatctcaattgagcttattgtaagtttaagccagattatagcagctattactgtcctgtcagtatcaaggaacgagcatcctcatgctcctttggctcagtggcttattggttatacgataggttgtgttgctactcttcctcacctttattggcgatttctccaccgcaatcggcagaacacagagcaagaatcaacaaatcaggtttcatctgaaagggacgtatatgagcctaattcttatgtagtagtttcgtctgctcatggatcagaagttgtggacagtggtaataatggtggagtagcaaggattgcaagtccaagggtctacgcattggttgcgtgcttcaaattggctctggattgtttctttgctgtgtggtttgttgttgggaatgtgtggatattcgggggccgtacttctctccatgacgctcctaacttgtacaggctgtgcatagtattccttgcattcggcttcatcggctatgccctgcctttcatcctatgtacaatgatatgctgctgcctaccctgcattatctccatgatgggcatccacgaggatttggattttaacagaggcgctactgcagaagcaatcgatgccttggtggcatacaagttccaatcgaaaaagtttcaagatggagaagcgggagaagataatggtggagtattggcagctggaacagacaaagagcgaactatttctgcagaagacgctgtatgctgcatctgcttgtcaaagttctcaaacaacgaagatctacgggagcttccctgcaatcatgttttccacttggaatgcgtcgataaatggctcaagataaacgcactgtgccctctttgcaaggctgacttaggcggctcgacgaatgctccggactcgagctccaggagcagccatgacagcaacaacagcagagtcaggaacgacgtcgagtcacaacagtagctgctctcatgccctttcccatgagcatggggatggaacacattcttgacaatctacaaattggcatgcaacttctcaagtcccttttttttcagacagacttgaatagagcatttgcctacactgctctctggtgttaacccagaaactcctatgaggctgaggctatggctatgagttgctgcctgcagtttgttctgaactgaagttgcctgtaaggctgtaacagattatagatggtgttggaatagttatcatgatgatcacctgagttgagcatattaggttgttgaggttaaccttcaaccggggaggttcaatgtaattatctccttgtttaggaaaaaatcccctcccctttgtatctgctcccttgtatagaaaacaaccatctccattgtatatcagatcaattttgcctgcattttgtaaattcagttagtaggcagagatctcccagcactcatcaagtgcttgagcaagtacagattagcagttgagtttattctactgtaatgcaacacttatagatgatattaccatgacataatcatttgagccc

SEQ ID NO: 5989 - DNA, 1869 bp, Oryza sativa
  Predicted polypeptide sequence is orthologous to G1108, G2394
gaggagtcaagtcgccgacttttggagttctcctcgccccagctcggtaaattccttcgctttttctccgctggttcggagatttccatgttcacttttgtttttttttttaattaagggctttgctttgatggaagggttgggtactggttccttccctccggatcaatcttgcttcttgcgctcacccaacctagtaattttttcctctcccgatttgtttaatgctaatctaggtggttgatgatgcttgcgagccaggcattgattcggctttaagcttgcctgcttgcttcgccgtcttgttctttgagttcttggttttcatggatccttgatccgatttaggggttgctgctgctagccgtggttggtgagacggttcttggagaagggggatttcttgaggtgcttttctgggaggtgtaaccaactaaattcctatgctaccttctggttgatggccgtccctcctgttgaatcagaaacaagaagtgaagaaacagataatttccctttacttgcagaccacatggaaaatactggacatcatgcacatgcagttgatatcccatgggattcttcaccatcgacatctcgccgagataatcataatggatttgatcaattacctcgtatcttagaaggttctcctgggacatctactccatctaactctcagaatggtcctctagcaagaagagatgataatcgtggtcgtcgtcagcctagtcccttgaattctggttgctggatctcagttgagctagttgtaaatgttagccagatcatagcagctatttgtgttctgtcagtatcaaggaatgagcatccacactctccgttatttgagtgggtcattggttatacagtaggttgtactgccacgctgcctcatctttactggcgctatctccatcgcaacctcccaaccactgggcaagagccaacagttcagaatatccctccaaacaacacccctgaagctaattcatatggagtaaccggcacaaatggagtctcaagaaacaatgaggcaacagtaaatccaaggttccaagcttttgctgatcacttcaaaatggctctggactgtttctttgctgtgtggttcgttgtgggaaatgtatgggtatttggtggacattcttctgctcacgacgcgcccaacttgtacaggttgtgtattgccttcctcacattcagctgcatcggctatgctatgcctttcatcctctgcgcattgatatgttgctgcctaccctgcataatctctatcttgggatttcgggaagatctaaaccaaaacagaggagctagtgcggaaacaatcaatgccttgggaacatgcaagttcaagtcaaagaaaactcgtgatggagatggaaacgaagttggtgtcggtgttgtggctgctggaacaaacaaggagcgagtcatttctgcagaagatgctgtctgctgcatctgcttggccagatatgtcgataacgatgatctccgagagctcccttgtgcgcacttcttccacaaggattgtgtggacaaatggctcaagataaacgcgctgtgccccctttgcaaggctgagatagatggtgtctccacaagtgctccagccattggctttgggcgtcgccacagcgacaacagggtaggaaacgacattgaatcacaactataactctcttcccacttcgttggcagcgtggatcacgcctttgatgaggccttccacacatcaacctgtaaattatagaggtagacatcaagatgtaaagggtcctcttacgatccaacaaagttcttttctgaatgactactgcctccactgtcagtatatattgcttccagcatttgtttcttctc

SEQ ID NO: 5990 - DNA, 2001 bp, Oryza sativa
  Predicted polypeptide sequence is orthologous to G1108, G2394
ggctttcgcgagagagggacacctgctctgcttccgcttccgcttccccctctcgagtctctcgcctctcccccgtggccaacccacacaccgcgggttggaggaggaggaggaggaggtaggggaaatccccgtcggccgtcggctcggcgccgaatcgatccgcttaggcttcttctgctgggctcttccatgaagcaaatgaagtttataatgcacatactaatgttcagtatattatactgagaatcaactttattctcagctgtatatacactagtatgccagccattggtagctacttgaaaggatggtgaaacgcatatgattacccatgatgagcatgtgtgttccctttttttattagtgctaagctggaaatcaataaatccaagatattcatggagcatgctacctgtgatgatgtgcatgagcatgctataaatgtatcacatggagaaactgcatcaacatcaaccagtcatcaagatttgcacagtgattcagatgattcacatcaggatgataggccttcaacaagcacacaaaccccatcaccacagtcttcagcatcaacttcgcccactgcatataacaccagaaatttatcctttcctagaagagatagtatgtatggtcatggaagaagtatttggaattctggtttgtggatctcgtttgaactggtcatatatgtagtacagattgtagctgctattttcgtccttgtcttttcaagagacgaacatccgcatgcccctttatttgcatggataattggttacacaattggctgcattgcaagcattcctcttatttgttggcgctgtgcccatcgaaacagaccttcggaacaagaacctgaacaaccacccgcagcctatcctaatttgacttcctctcaatcatcagaaggacgcaatcagcgtagcagtggtactgttttgcattttggatgtatcacaatttcgtgtccaaggcctagcatattggcttatcatttcaagacagctgtagactgtttctttgctgtatggtttgttgttggcaatgtgtggatttttggtgggcacagcactttgtcagattctcaggaagctcccaatatgtataggctatgcttagcattccttgcacttagttgtgttgggtatgctattcccttcgtcatgtgtgcagccatatgctgctgctttccatgcttaatttctcttctgcgccttcaagaggatttgggtcatactagaggagctactcaagaactaattgatgcactgccaacctacaaattcaagccaaaacgaagcaaaatgtgggttgaccatgcttcaagctcagagaatcttagcgagggtggcatcctgggcccaggaactaaaaaggaaaggattgtttcagctgaagatgctgtgtgctgcatctgtcttactaagtacggagatgatgatgagctccgtgagcttccttgcacccacttctttcatgtgcaatgtgtcgataaatggctcaagataaatgcagtgtgcccactctgcaagaccgagattgggggtgtggttcgatcattttttagcttgccctttggtcgccgacgtgttgataggatggcaggaagaggtatagctagctcgagattcactgtatagaacacgtcttcttctctagcatgtttgcttgtttcatctgctcatatgcacataaaagacgtgctcatggattgtagtttgttgatttgcaatgaaagcgataatctgctttcatcacccttgagttcaccaaagtgatgacagaaaagtggagacctgatgcttgcagtgacaagtttctgcagtacagtagaaacataagtatattctgatgtaacatttgatgtcaagattgtaaataaagagcacaaagttcacttcgggggtgtatatctgcatgtgtatgggaaaggaaagcctaattagttagtaactttgtaggcattttattgtgtgcaatcattgatcttgtttt

SEQ ID NO: 5991 - DNA, 1504 bp, Oryza sativa
  Predicted polypeptide sequence is orthologous to G1108, G2394
gtagaatcgtagataattcctgcactcagttttgagaaaactggaggtctcagaaatttagcagcttgcttctttctttgttgcatctaagaattgatgacctcagccttcaacgttacttgaaattcaaggtcataccgatatgcacgcttcgaggatggaacaaactacaggtgttagtggccatgagcacataattgatattccaagggacagtggtccatctacttcgacttcccatagtgttgctagagaaaaccatggagaaccaaatcctgttgatagatctgcaaccagagcgctagtacctgctttgcaggcaccatcagcagttggtgcacctatgttcgccggcacagaagccctttgaattctggactctggatttcaatagaagttcttgtcaatgtgagccaaattgtagctgctattgttgtgctttctctttcaagaaaggaacatccgcaagctccattatttgagtgggtcataggttatacagttggttgttttgctacactaccccatctttattggcgctatatacaccgcaatattgtcaatggtgaaaatgagccagcacatacacttcaaggctcctctcagaacaattcaactgagccttctgctagtgcatcagagcgtcgaaggaatgctgcacgaaatgcagtgctcgctaatccaaggattaatgctctttttgaccacttcaagatggccttggattgtttctttgctgtgtggtttgtcgtaggaaatgtgtggatatttggcgggcgttcttctgctgccgatgctccaaacttgtacaggttatgtattgtgttccttacctttagttgtattgggtatgccatgcctttcatcctctgtgcaatgatatgctgctgcctgccctgcatcatatctgttatgggatttagagaagatacaaacaatacaagaggggctacctcagaatccatcaattctcttccaacatacaaattcaaaaccaagaaacgccgtcatagttcaggaaatgaagctgaaggccaagatggtgggatagtagctgcagggactgacaaggagcggtcactatctgctgaggatgctgtttgttgcatctgtcttgcaaagtatgcacacaatgatgagcttcgtgaacttccctgcacacattgtttccacaaggaatgtgttgataaatggctgaagattaatgcactttgcccattgtgcaaatctgagatagcgagctcatctggaacatctgatactcgtcgctctgaccacacagatattcctgtgcaggagattgaaatgcattagggtgatctgctttctgaggtaatacggcagaatacagttacttgtggtgaccgtgtgcttgtataaagttcaagctttgatatgtggattgtaatgatgcatggggttatttttgttgctgttattttggagaagacagttctcactgtcaacatacacgaggaaatatacaatatctactcgttccatc

SEQ ID NO: 5992 - DNA, 1109 bp, Oryza sativa
  Predicted polypeptide sequence is orthologous to G1128
gggccgccaccacgccttccgtcctgcgctcttgccgctgccgctgttgacccggttgctgccgccgtatttgcgccgccgccatggccatacccggaggccgcagccgtcgtcatccatcacaaccggcgttttctttccgttttccttcttcccgagagaagggtaccgagagggtgtacaggaggaagaaggaaaggaaaagcagagcaacgttgaggaatttcagcgatttcgcaaattagggaaatttgtcgcaagctatgccgcctcggatagccaatcgaggccgtgggagaggcggtggtagaggtcgtggtaggggccaccataatgaagaagttgagaataatcatgataatgaagacgttgggaacaattcgattgctgaatccactattcctaatcgtggaggttgttggcggttgttaaatgccgattctataccgccaacatctgcataagttcggataataaaacatccaacatagtgataggtgcttaatctcacatattccacaagtgttggtgtatatttgtatgcagatgataaaccctgaagttgggaggaaaatcagacaaagtgaggagaattatgtatccatgcaaggaggggttatgaacttcatcgaaacatcagcaaggaggggttatgaacttcatcgaaacatcagtgaatcaactcaaaactccgagaaatggataaaggaggtccaggggagaagatgggccaagggctagaccaggagggcctagcctaggttcggccgaacccccctgatcaccgttgatcctggggtttggcgtggacgctccagatcactccccaatgacggttgcggggcagttcagacattaccccttcgccaaccgtcatacctaactctatataaaggcttcactccctcatttcacacacacactttcaagcttgacctgaattataagaggctctattgtactatattgtatattagaataggaagagagtagagtaggagtcagaagaattccggagttgtcggtaatcttctcctatttcttttattttgtttattactctgaattcaatataatattcttcttgagtaatttagatttgtcttgtg

SEQ ID NO: 5993 - DNA, 2512 bp, Oryza sativa
  Predicted polypeptide sequence is orthologous to G1133, G1137
gatttccgtccgagggggccgataagagaagccgcgccgcggcgcacgctctcgctgtctctctctctctctctctctctcgtcctcgtctcggtctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttg

SEQ ID NO: 5994 - DNA, 2423 bp, Oryza sativa
  Predicted polypeptide sequence is orthologous to G1133, G1137
ctcgccgtgcggctctctctcgtgagcaacagcacgcgccgcggtcggcctccccttcaattccttcggctttggcccgggcgggtgtgtgagtgctcagctcctatcgccgattcgtcgtcctcctcctcctcatcctgctcgatctggtaattctagtgttgagggtctgaggagctgaaactagcacgggtaccctggcagcatgcggtggctggctctctcggtagacatcttccgcaaagggatctccttgaacctgtactgccgggttattctgtaaattgcctccattattgctctactccaatcctgatcttctagtctctgaagtttgggattgaagatctggttgctggcattgctgtttgggtttctgtggttgcctggcaattctttcaaggagaacgggcaggagtactaatggtgtggcaaccggtggctcagacgagattccgcgtgtttaaacatgagaatggaatcgctgtgagagttatagcttgcttccagccatcccaagattgccaggccgagtacttccgccatcttcttaagcccgtgacgtagttcgactccctcccttccatttgctgttgaatagaacctgtgctgctctaagtttttctgaagcaaaagtaaagcaggagaatttcctgttcatctcaattttctggtgaagatcctgtttgctggttgtttcttgatgggggagaaggttaatccctggtgccattggtctaatcccccatggaccgagagctctgcaaacaatctccacccacccgatgttagcctcgacaacacaaattcagtggcgttgccaacatatctgaacagcgatggctacatttattctggagttgctgcatctatgccgtctattgcagcatcagttactgacagacctgtttcattctcttctagatttgtcacaacattggtacccagtgtaggcttatcaacagctgagacactgagaaagagacctctggttttctttcataatgtgaataataccttcactgtaggtcctctcctgagcaaggggacattggatacagttccagagctccaaggtagcaatgagaccaatgtaactgatgttggagcacaaaatactgagtgtatgcatgagaatactgaggagattgatgcactcctgtgttccgactcagatgaagggtgcttgaaagtgcaagaactcaacaacagagtcaggaaatacccaatgcagaatgacaccatgagtgtggagtcggtagcaagcgctggtgcttcccaaccagcaaagaaaagaagactaagctctggtaccgacagatctgtggttgacacagccagctcagcaaggcctgaccactccgttgatcagaaacatctcagccatgacgacgacgcacagtcgtgttgtattggtgaagtggaaagcgatcaccagtttgctctgagggaaggtgaagaagcagaaggtgatgatggccccgatgatcggaagcggagaagagagaggatccaagagactgttgctgcactcagaaagatagttcctggaggcattgccaaagatgccacagccgttcttgatgaagcgatatgctatctcaagtatctaaagctcaaggtcaagacactgggagctgtttccctctagctcctcgatcgatgacggttctgttctggttcctgaacccaatacctatccctctctccatatatacaagtaatgagctaaaactatagcagcaataaggtgaaatgaaactcagtcagttccattcggtgattctgaggactactggagtgaaagctcaatggtgctttgcttacaagggtccaatgatttgagtggttacaatgaagattcagtattgcagtatattactagtgaatcaccgaccactgcaccttcatccatccatccactgatggagagtactacctagcagcaagccggtgtcacatctttcttctgggtcagttcagtgcagtgcctcttggtaggcacctcctccctctcataaaaaaaggctctcatggcgttgatggcgcaataagtaaaacagggaggctaagctataaagatcttttttctcccctccattgtggtgtgatccaaagcaaaggaaggaaggaggaatgaatgaatgaagtccatgcaaagtgcagtgctggtggcctggtgctgcatgcgtcgatggctttttgacccccaaaggttgagagatgagatggcggggccgcgcccgaggttagttcgggctccttgtgtgtgtttgtatggtggcgtgtgtagctagcagagtgtgcgtgatggcgtcgtccctcgcgctttttctgcctttctactagtactatacatatatgctactgtatactgtactcctatgtatgaatactgcatgtgtttgtgtttgtgtttgatc

SEQ ID NO: 5995 - DNA, 653 bp, Oryza sativa
  misc_feature (644)..(644): n is a, c, g, or t
  Predicted polypeptide sequence is orthologous to G1142
gggacaaagctgggtaccgggccccccctcgagtttttttctttttttttttttttgggcttaattagttgggtaagtctgcaaaccttgcatatattggggatgctgacattgttattcagtggctgggtttgcattggctttggaacagcttttggtgaaagctcaagcaaaccctaatggtaatatatatcctacttaatcatatatggcatatcaattggcaatattggtatcaccatgaagagccatatatatatggagatggcaactaattagcacacaaaaactaagtaaaacatggcaagcaaaatacgtagtatagtataccaagcaaactgatagctatgttgagctatggccgccggctaggctgcagcttgcatgttcatgtcggagacgacgcgcctcctcttcggccggtcgccggcggcggcgcccggccgctccacaagagccctcagggcttcctttaggaagtcgccgccgtcgttggagacggccgaataaccggcgcggtcgtcgtcgccgtcgccgccctcgccggcgccgccggcgtcgcgcgccaggacgagcacgttgcggacgcggccgccgagggtggccatctccgcgcggagcgtgcggaggcggaacgcgcgcancgtctcgat

SEQ ID NO: 5996 - DNA, 837 bp, Oryza sativa
  Predicted polypeptide sequence is orthologous to G1142
atgtggctaaactgtctaccgtcactgctgaaacgatcgcatccctgcgtgtttcgtccgcgtcatccaaacgcatccgtttccatctaccgtctagattccgaccctcgggcgcattgtttcatgaatccaagtactccacgatcattagcatcaccggtctccacgccaccaacgatgcatgtagtttatcgcatatattcaactggttcatggaaatgcagttggaaggcctataacccttatgtgacctacaagcacccttatgcaggacatgtcaacttatttcttaagcaacgtatatcatggattctagatgaacatatgcttaaccatcagggccggccctggggggtcagccgtgcgcaggcccgaggccctcaaaatccaggggcccacatggctgatgggccatggcccatggcgaagacggaagacgaagaggagcgaaggaaaggctggaaagcgaagcgatttgactcctgttcccatcgccttgatcacgcctcctgcgtagcctcgatcacgccactggtcaatcactcatcgctgcaaacgctgcgtcgcaaggatcaatctgagttgcaaaaacccagcaggcaagatcgaccggacgagatcctccgcctcgcggattatcacgctgctgggttgagctctcgcctagtcgcctctcggcgtctggcgtcgcaaggagtcgagccgtcgaggccatcaggccaaccgcccggcggcggcggcgcggcgcgccctcatcggccaatcgacggctcggcggcgccaggtgcctataggctgcagcctgctgccctgctcctcgagatcaaaaattattag

SEQ ID NO: 5997 - DNA, 1307 bp, Oryza sativa
  Predicted polypeptide sequence is orthologous to G1142
ctcgccctcgccttcctcctcctcgccgttgatcgatcgatctcctgctcgatctcttgtgccctagctacgatcaccaactagcttcaagcttcctctcccagcagctgcagcggcagctagccagcgatcgatcgatcgatcgagctacacgtgagatcgagtgcgtgcagtagtgtgtggtgtgcatgtttccggtggaggtggcggcggcggcggcggcggcggggaggatgcaaggggaggcggtggtgccgatgatgctgccgcccttcttcatggactcggggatctggccggcggcggcgggggtcgtggatgtcgccgcgtcggcggaggaagaggcggcggcggcggcggcggcggcgcaggaccgcgcgctggcggcgtcgcgcaaccaccgcgaggccgagaagcgccgccgcgagcggatcaagtcgcacctcgaccgcctccgcgccgtcctcgcatgcgaccccaagatagacaaggcgtcgctgctggcgaaggcggtggagagggtgcgcgacctgaagcagcggatggccggcatcggcgaggcggcgccggcgcacctgttcccgacggagcacgacgagatcgtggtgctcgcgtcgggcggcggcggcgtcggcggcgccggcggcgcggcggcggtgttcgaggcctccgtctgctgcgacgaccgctgcgacctcctcccggagctcatcgagacgctgcgcgcgctccgcctccgcacgctccgcgccgagatggccaccctcggcggccgcgtccgcaacgtgctcgtcctggcgcgcgacgccggcggcgccggcgagggcggcgacggcgacgacgaccgcgccggttactcggccgtctccaacgacggcggcgacttcctaaaggaagccctgagggctcttgtggagcggccgggcgccgccgccggcgaccggccgaagaggaggcgcgtcgtctccgacatgaacatgcaagctgcagcctagccggcggccatagctcaacatagctatcagtttgcttggtatactatactacgtattttgcttgccatgttttacttagtttttgtgtgctaattagttgccatctccatatatatatggctcttcatggtgataccaatattgccaattgatatgccatatatgattaagtaggatatatattaccattagggtttgcttgagctttcaccaaaagctgttccaaagccaatgcaaacccagccactgaataacaatgtcagcatccccaatatatgcaaggtttgcagacttacccaactaattaagcac

SEQ ID NO: 5998 - DNA, 1258 bp, Oryza sativa
  Predicted polypeptide sequence is orthologous to G1145
atcagctagcaaagcaaagcattttctcagctcaagttgcttgctcctcttctttctttcttcctcctccccttccctttcaggactcctccccccacatcagtagctttcactgcccaaaccctctttgtgggtggcaaccctagattattaatgtcctcctcctcatcatcaccatctcctcctcttcttcctcccctgcttctctctccagattctcttcatctggtcccttccttcccctgctttgcttgctcagctagctgatcgcacgtgggtagggtgagtgtgtgtgcgtgtgtggatgggagtccacgcaatgtcgtgccacggcggcggcggcggtggcggcgaaggggcactgtcgcggcaggggtcggtgtacagcctgacgctgaacgaggtggagagccacctgggcgagccgctgcggagcatgaacctggacgacctcctgcgcacggtgctccccgccgcggcggcggcggcggagacggcggggaggaagacggtggacgaggtgtggcgcgacatccagggcgccagcaccggccggcaccacgcgacgcccatgggcgagatgacgctcgaggacttcctctcgcgcgccggcgtcgccgtcgacggtgccgcctccgccgccggcgcgcattggctgcgtgggcactacccgccgccgccgccgccgacgacgacgacgctgcagtacgtgggcggctccggggcggtggtggacggcgtgtataaccgcgtggacgggcacggcgtcgcggggttcctctcgcaggtgggcgtggcggggcggaagcgcggcggcggcgtggacggcgtggtggagaagacggtggagcggaggcagaagcgcatgatcaagaaccgcgagtcggcggcgcggtcccgagcacggaagcaggcatacacgaacgagctcgagaacaagatctcgcggttggaggaggagaaccagcgcctcagggagcacaaggctgttgctgatttctcaacattccctagctgcgtcgatttcctgaaagcattcttgacgcagaagctggaaccagtaatgcagattgtgccccagccggagccgaagcagcagctgcgacgaactacttcggcctctttctaatcaaccaaccacaatgttcatagcgaaatgatttaaactcgatctctgtaggaaaatcaatgggggtttgtacttggggatgctggctgttgtgaacaagagctgaaacgacgaactcttttcttaact

SEQ ID NO: 5999 - DNA, 1593 bp, Oryza sativa
  Predicted polypeptide sequence is orthologous to G1145
acgtagcagtagctactactcgatcgatctatcgatccgattaatagtgccatgaaatatctctccatttgtggcagtaaattaagtactagctaagttagctaatgacactgttggtacttaaaggcttaaaagctagcagctgttgagctagctgtctcatgaagctagcttaattaagtctgatttatatatatatatatatgtagacatccagagagagagagagagagagagagagagagccagagacaagcttagcaacaacaaccaaaagcaaggagcactaactgcagctgttggcgatcgaattaaggatcctgcagctacaagcaagaaggtgcaggtgcagggtgcggccatggcgaactaccaccaccaggagtactaccagatggcggcggcggcagcggtggcgtggccgagggagccggacagcccgcagctgagcatcatgagcggctgcagctccctcttctccatctccaccctgagggacgacgacgacggcggcggcgtccgcctcgccggcgccgcgctgcccgccacgccggtgtcgctcgccgggatcgccggcggcgccagtacccccggcggcgacggggtggacatggaggtgcggcagcagagcggcggcagcggcgacgaccggaggaccatccggatgatgaggaaccgggagtccgcgcttcgctccagggcgcgcaagagggcgtacgttgaagagctagagaaagaggttcgccggctggtggatgacaacttgaatctcaagaagcagtgcaaagagctgaaacaagaggttgctgcactggtgatgcctacaaagagctcactgcgacgaacttcatcaactcaattctgaaggtcgaccaaaacaagcaagattatctgacgatacaaaatcattagaaagatctaaattatgtgtatttgcaatccggtgtgcgtttgtgcaggggtcaggcatgagagaggatattgtgtgtaggtgatcgatggatgctatgaactacctctgcagttagaaatgtgttagatcttgtctctgcaaagatgaacaccttttcttacttgttcaactcgatcagcatgcagtatcctgttcaatttttttccccttcagccattcagaaattcagaagtggctatcatgctttaattttgtttcaatcagtagtagtatttgttatctttgagggacagatgggcttgtctcttgtcagcattcaccttagctttacctcttactagtatattttatcactgagtgcgtttatgctcatagggcatatatatcttatgttggatataagtttttttttttttgtcttgtttagttaaactgaagatgcatggccgactgaacatgagaaaaatatcatttcgtttggaatgtcatggaaagcactttctgaatggctaacaggatataataaatatcagctctcacctttgtccactattgatagaaaaggaaaggcaagaagattgccttaattaacctaattgtcatcaaatcaaagtggccggcttatcgagaacctagctttgtctagaaactttgccttgaaatgaattgaaaaatcatgc

SEQ ID NO: 6000 - DNA, 1730 bp, Oryza sativa
  Predicted polypeptide sequence is orthologous to G1145
acatgccccatttccacccctcctatttcctctctttcacgcatctcgactccatctcactctcccccctccctcctctctcgctcgctgcgatctgcactgctactccggtaggtctcctcccccccccccttcctcgcgcggccgcggccaccgccggcgagaagcccgccgcggcggcgctgaccccctccgcctcttcccgcgcgcggccccgccagccggccaccgtctcgggtcaaatcgaatcgaatcgaatccaaagaggaaaatctggggttcagttgaaccctaatgcccccaggttaggtcagcctcgctgggtatcgcggctgctgaggttacttggagaggggtagggtggaatcctcgggggctgatttggtgtaattgagagcgccgattcatgattcaggcaatggcttcgcatgctggaggtagtggcggcggcggcggtggaagtggccgggatgctggctcggcgcagcgcgggccgatgcaggggttggcgaggcaagggtcgctgtatgggcttacactcaatgaggttcagagccagttgggggagccgttgcttagtatgaaccttgatgagctgcttaaaagcgtgtttcctgatggcgcggaccttgacggtggcggtggcggtggcggcatcgcgggccagtctcagccggccctggggctgcagcgccaggggagcatcacgatgcctccggagctgagcaagaagacggtggatgaggtgtggaagggcatccaggatgtgccgaagaggggtgctgaggagggtggccggtggaggcgggagaggcagccgaccctgggggagatgacgcttgaggatttcctggtcaaagctggggttgtcacggatccgaacgatttgccaggaaacatggatgtggtagggggcgctgctgcggctgcagctggtacgtctgatttgaatgccggagcacagtggctacagcagtatcaccagcaggctttggagccccagcatccaagcataggtgctccttacatggcaactcacctggcacctcagccattagctgttgctacaggtgctgttttggatccaatttactccgatggccagatcacttcgccaatgctcggggctctttctgatcctcagacacctgggcgcaaacgctgtgccacaggggagattgcagataagctagtagaaagaaggcagaagaggatgataaaaaacagggaatcagctgccaggtcaagagcgaggaagcaggcttacactaatgagcttgaaaacaaagttcttcgtctagaagaggagaatgagaggctaaagaagcagaaggagttggatgagatactgaactccgcgcctcccccggaacccaagtatcaactcaggcgaacaagctcggccgccttctgatggtgacgatgtccatagtaaattttgtagattatatggggtctgcccacatatttcgcatcctttggcggtaggaacaatcgatatagcttgagattccatcttccccctccagccggtggtggtttagagcttgtaaacaccagcaccagcagagccctagccatgtcgccccagctgctgatctcttcggaggctttgtcacttgtcagtatgtaaattctccaaggcacgtgtcgctgttaagttctcagagctccttggttatacatgattgggccctttgcctgtttcttgtggttggttgatacttagt

SEQ ID NO: 6001 - DNA, 933 bp, Oryza sativa
  Predicted polypeptide sequence is orthologous to G1145
atggcgtcgaaggccggaggcgggggcgtcgcgcggcgcggaggagggcggatgcggagtctggggaggcagggatccatgtacagcctcaccctcgacgaggtgcagagccagctgggcgagccgctgcacagcatgaacctcgacgagctgctccggagcgtgttccctgacggcctggccatcgccgacggtgccggtgccaccaccagtagccagcagcatcagccgggctcgggcctcctgcggcaggggagcatcacgatgccgcctgagctcagcaagaagacggtggacgaggtgtggaaggggatccaggctgctccgaagaggaatgccgaaacgggcggcggcggcggcggaggtcgacggcggcgagagaggcagccgacgcttggggaggtgacgctcgaggatttcctggtcaaagctggggttgtcacccaaggatctctcaaggagcttagtgatgtaggcaatgtggatccggttggaagaggtgttacagcaaccgggactgtggatctggcacctggatcacactggatagagcagtataagcagcagattgcatctactgatgctcatcaccatgggcagcaaggtgtgcagggtgcttattttccgaatcgattggtccctcagccacttaatgttggccccggtgctattctggagccatcctactctgatggccagacttcttcaggaatgatcggcggaatgtccgattcgcagacgcctggaaggaagcgaggcatgtcaggggatgtggcagataagttgatggagagaaggcagaagaggatgatcaagaacagggagtcagctgcccgttcaagagccaggaagcaggcctacactaatgaacttgaaaacaaggtttctcgtttagaagaggagaatgtgaggctaaagaggcaaaaggagtga

SEQ ID NO: 6002 - DNA, 804 bp, Oryza sativa
  Predicted polypeptide sequence is orthologous to G1146
gggaaaaggttgtgctggtgcaagatgcgactctccagggtgtctttgatgctctgaagaaggcttgtgcttctgcatgatgtatgttaaatgtgcatatgtgaaaactactcacttaactgaatagaaagagtgtcaacttaactagtgcccttttatctgtacaactctgtcctgcaatgaaccctgtaaacggttaattaaaaaaaaaaaaaaaaaactcgaggaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaggagggcaactggacagaaaccccagaggattatattttacagggatggtgtcagtgaaggacagttttattaggttctgttttatgagcttgttgcctttagaaaggcatgtgccattttgaagccgattataagccccccgtaaccttggggggggccaaaacctaatacacaggctggttgctatacccaaggaccacgactggggcaga

SEQ ID NO: 6003 - DNA, 3548 bp, Oryza sativa
  misc_feature (7)..(7): n is a, c, g, or t
  misc_feature (26)..(26): n is a, c, g, or t
  misc_feature (28)..(28): n is a, c, g, or t
  misc_feature (33)..(33): n is a, c, g, or t
  misc_feature (42)..(42): n is a, c, g, or t
  misc_feature (3362)..(3362): n is a, c, g, or t
  Predicted polypeptide sequence is orthologous to G1146
tttcganccctttgaacccgtttaanangaccnactataggncgaattgggtaccgggccctgcagtagttgcatcagtgacgaagggttctaatgcctttctgtcccgcctcgcattaattctttggcttggttggatgcgagagaaaaaagaggagagattttggtagaattgtaagatttttgttactactaccactcgttttcttggcttggtttggtttggtgtttgatcacgcggtggtgacattataagggcgcggttgcgcaggtgttcgaccagcgggtggcgaggtcggcggcgaggtggtggtggtgcgcacatgctcgaggtgctggacatggcgccgccccggcaccagccggcagctgggaaggcgggcggcgggcgcgggcatgggcatgggcatgggcatggtggtggtggtggtgggccggcggcgaggaagcagccgttgcagagtagcatggcgcagcccaaggcggagacggcggcggcgacggcggcggtcgcgccgccggagggagggaagaagtgcggcggcggtggcgggaggcggcgcggcgggcgcgggcgcggcggcagggcgggtgcggggccggggccggggctggcggcggcgccggccgtggtggtggcgcccgcggcgcgcgccgtcattgggccgccggtggcgagcaaggggctgtcgttctgccggcggccggggttcgggacggtgggcgcccggtgcgtcgtgaaggcgaaccacttcctcgccgagctccccgacaaggatctcacccagtacgacgtgaagatcacgccggaggtgagctcccggagcgtgaaccgggcaatcatgtcggagctggtccgcctctaccacgactccgatctcggaggtcgcctcccggcctacgacggccgcaagaacctctataccgccgggacgctcccgttcgacgcgcgcgagttcgtcgtccgcctcaccgacgacgacgacggcaccggcgtcccgccacgggagagggagtacagggtcgccatcaagttcgccgcgcgcgccgacctccaccacctccggcagttcatcgccgggcgccaggccgacgcgccgcaggaggctctccaggtgctcgacatcgtgctccgtgagcttgccaaccgcaggtatgtctcgatagggcggtcgttctactcgccggacataaggaagccgcagcggctcggcgatggcctacagtcatggtgtgggttctaccagagcatccggccgactcagatggggttgtcgcttaacattgatatgtcatctaccgcgttcatcgagccgctaccagtgatcgaattcgtggcccaaatactagggaaggatgtcatatcgaggccattgtcggatgcaaacagaatcaagatcaagaaagccttgcggggcgtgaaagttgaagtcactcaccggggaaatgtgaggcggaagtatcgcatttcagggctgacaacacaaccaactcatgaactgattttcccaatcgatgaccaaatgaacatgaaatctgtcgtacagtatttcaaggaaatgtatggcttcaccattcagcatccccatcttccctgccttcaggtgggaaaccaaaagaaggcaaactatctaccaatggaggcctgtaagattgttgagggtcagagatatacaaagaggttgaatgaaaagcagatcacatcattactcaaggttacttgccgtaggcctagagaacaggagatggatattctacagtctcaacaaaatggatatgagcaagacccttatgcaaaagaatttggaatcaacattagtgagaagctaacctcagttgaagctcgggtccttcctgcaccttggctgaaatatcatgatactgtgaaggaaaaggagtgcttgccacaagttggtcagtggaacatggtgaacaagaaagtgataaatgggtgcaaggtgaatcattgggcttgtataaatttctcaaggagtgtgcaagaaactactgctcggggattctgccaggagttggcacaaatgtgtcagatatccggcatggaattcaacagtgagcctgtgataccaatatactcagctagaccagatcaagtagagaaggcgcttaagcatgtgtataatatgtcattaaacaagctcaagggaaaagagcttgagcttcttttggccatcctccctgacaacaatggttctttatatggtgatataaaacgtatatgtgaaactgacttggggttgatatcacaatgttgcttaaccaaacatgttttcaagatcagcaagcagtacctggcaaatgtctcacttaaaatcaatgttaagatgggaggaagaaacaccgtgctgctggatgcaataagttggaggattcctttggtcagtgacataccaactattatatttggtgcagatgtcacgcatcctgaaaccggggaggactctagcccatccattgctgctgttgttgcatctcaagactggccagaagttacaaagtatgctggattggtgtgtgctcaggctcatcggcaagagctcattcaagatctttacaagacatggcatgatcctcaaagaggcaccgtaacaggaggcatgatcagggagctcttaatatccttcaggaaggccactgggcaaaagccattgagaataattttctacagggatggtgtcagtgaaggccaattctaccaagttctcctctatgagttggatgctatccgcaaggcatgtgcatctctagaaccaatttatcagcctcctgtaacattcgtggttgtccaaaagcgtcaccatacaagactcttcgcaaacaatcacaaagacagaagtagcacggacaaaagtggaaacattttgcctggaactgttgttgattcaaagatctgccacccatcagagtttgatttctacctctgtagccatgctggaattcagggaacaagtaggccagctcactaccacgtcctttgggatgagaacaatttcactgcagacgaaatgcagacattgacaaacaacctttgctacacttatgcacggtgcacacgctctgtttctgttgttccacctgcatactatgcgcatctggctgcgtttcgagcgcggttctacatggagccagagatgtcggagaaccagacgacgtcgaagagctccactgggacgaacggaacctcggtgaagccattgcctgcggtgaaggagaaggtgaagagggtgatgttctactgttgatgactgggagactacctttaactactcacatatgatgtacctaacattgtagaattttagtggtagggatttagaattagcttccttcaggaaagggagcanagcaagcatttggatcctgagcgacctcttttgaccactctgtaaagtactaagtaacgcatgtataatagttgttgtatcagtctgaaaaaaaggaagtgcactcaaaaaaaaaaaaaaaaaaaaaaaaaaaaaaaaaaaactcgagcgcgggtcgacaaggggtttcgaaaggggtttccaaag

SEQ ID NO: 6004 - DNA, 3003 bp, Oryza sativa
  Predicted polypeptide sequence is orthologous to G1146
atcgttgctcgaatatttccccgtccgctgtgcgtcgactccgactgctcgtgtgttcgcccgccgccgccgattcctatccatctcgcgagcgagcaggggcgccgtcgttcgtcctgctgcttccgccgcatccatcctgtgctaaagtttgtaccttgccttggaacattagtcatggagagtcagagaatgacctggctctacgatcgtcaccactccttgaaacataataaagctgaaagacaagccattctatcaacttatagattagcaaaacgtccaaatctctcttcagaaggtatgattggcgaaagttgcattgtgaggacaaattgtttcagtgttcatctggagtctttggatgatcagactatctatgaatatgatgtatgtgtcactcctgaggttggaatcaatcgtgctgttattagagagttggtaaaacagcagaaagattctggtttgggtggccgtcttcctgcctatgatggaaggaagaggctatacacatctggtccattgccatttgattcacatagatttcttgttctgctggatagtattgaagacagtcctgaagagtcaaggcacttgagagtgagagattttgtggtcactttaaaatttgctgcaaaaatttccttatggactttacgcaagttccgtggtgggaagccaaaccgagaaagtcgagcggccctgcgagcacttgacgttgttctaaaggaattacccactgcaaggtatacccaatttgctggttcattttactcacctaacttaggagaatgccgacaattgtgtaaggtcttggaaagctggcgtggttttcaccaaagaatacaagctactcagatgggacttcaactgaatatcgacgtgtcatcatcagtgttcatcaagcctgtacctgtggttgactatgttgcacagcttcttaacgaggacatcttattagacagaccattatgtagcactgagttcttgaagattaaggaggctctagaaggtctgaaggttcagattaatggcattttgttcaacacatatcatgtacaagaccttgtccatcaagcagcaagttttccagttaactttagtattcagtacccatctttgccttgcttgaaagtggctcattttggggagacaatatttctgccattggaggtctgtaaaattgctgagggacaatgtcaccagaaacagctcaatgcaaaacatatggctgctcttcttcaggtagctcgacagccccctaatgagcgtgactacaacattctgcagactgtgcatcagaacaaataccaggaggacccacatgctaaagagtttggcattaaaattgaggaaaaacttgtatcaattaaatctcgcatcctacctgctccttggcttaaattccatgacagtggcgagacgacagaattcttgccacaacttggcatatggaatatgatgcataagaaaatgatcaatggtgggagagtgaaaagctgggcatgtgttaacttttgctggagtgtacgggagtatgctgctaggaatttctgttatgaccttggctttatgtgccgagaatctgggatggtcttttcagttaaacctgtgcttcctctagtgattgctaaacctggatgtgtagaatctgcactcaggacacttcatgacgatgtcatggacatacttagaccacagggcagaaaacttgacctgctgattgtaatattgcctaacaacaatggatctctttatggtgatgtcaaaagaatatgtgagacagatattggactgatctctcaatgttgtcttgcaaaacatgttcttaagatgaacaagtggtatcttgcaagcgttgcccttaaaatcaatgctaagatgggcggaagaaatactgtactggttgatgctttagaaatgagactcccccatgttagggatacaccaactattgtatttggtgctcatgtcacccatccacatccaggaaaagctaatagttcttccattgctgctgttgttgcttctcaagactggcccgaggttaccaagtatgctggtttaatcagtgtgcaagcgtgccaccaggagtcaatacaaggtctttttaaagtccaggatgatccggaaagaggaaccacaactagcggaatgatcaaagagcatctcatgtctttctatcgagccactaaacggaagcccggaaggattatattttacagggatggtgtgagcaaaggacagctccctcaggctttgatgcacgaacttggtgccatcaaaatggcgtgtgcatctatgggacccgattataatccattagttacatacgtggtgctccagaagtgtcgccatacacgtctgtttgctgactactataatgcgaatactcatgattcaactgcaaacatacgggctggtactgtggttgattcaaatatttgccaaccaaatcagtttgatttctacttgtgtagccaccgcagcacgcagggaactaagcggcccaggtattatcatgttctgtgggacgagaacgacttcttggctggttctttccaagagctcacaaactacctctgctacacctccgcaacttgcacccaatccatatcagttgtggcccctgtgcactacgctcgtcttctgtcatcacgagctcgatgttacattaaaccacgctcgattggcgattcaacgagccacacctccttgccttctgaagaagatagcagcgcagcctcagagactggcagtcttcttcctataaaggataatttgaaaggggccatgtttttctgctagaactgctgccagcaagatctgctgtcattttgtacgtggtctgtacagtcccacagttcttggtagatttgactgagcagtcaaaactcattatcgttcagcgagattcaggtgtagcagctgtaggattactgataaacattgttcctgtaccgatactttagaagaaatgaattaattatatcttagaacagc

SEQ ID NO: 6005 - DNA, 3432 bp, Oryza sativa
  Predicted polypeptide sequence is orthologous to G1146
ggtcttcttccttcctcggcccggcctcgctcgctgcctgccagctgcagctgcaactctccatccatcgatcgatctcctcctactcccccgccgccgccccgtccaagacaagccaagccagccaccactccctgcatgccatggcctcacggaggccaacgcaccgccaccataccgaggctccagatcctggtggaagagggagagggagaggccgtgccgcccgatatgctcagcctcagcctcagcctcagcagcagcagcagcagcaaggacgaggatgccgtgctagaggtgcctcgccgccgccgccgccgcagcagcagcagcagcaacagccaaggtctactcctactcgtgctaccactgtcaccgtggcttcctcttcatctaccacggccaccgcatcatcaagccctctagctcccgagctgcgccaagcaataatggaagctccccgtcccagtgagctcgctcaaccctcacccactccgcctcaggaacaacctgtggatgccgctaccacgacgccgcaccatattccatcctcaagcaagtcaattaggtttcctttgcgcccggggaagggtaccattggcaccaggtgcatggtcaaggccaatcatttcttcgctcacctgcccaacaaggatcttcatcactacgatgtctccatcactccagaagttacatcacgcattgttaaccgagctgtgatcaaggagctggtaaatctgtacaaggcatcttatctgggtgggaggctgcctgcatatgatggtagaaagagcttatacacggctggcccattgccgtttacttcacaggagtttcagatcactttacttgacgacgatgatggttctggttctgagaggcgacagaggactttccgagtagtaatcaagttcgccgcacgggccgaccttcaccggcttgagttgtttttagctgggaggcacgcagaagctccacaggaggcactgcaagttcttgatattgtgctgcgagagctaccatcagcaagatatgcgccatttggacgttccttcttttcggcttacttgggtaggaggcaaccccttggtgagggattggaaagctggcgtggattttaccagagcattcggcctactcagatgggcttatcactgaatattgatatgtcagctacagctttcattgagccgttacctgttattgattttgttgcacaactattgaattctgacatccattcaaggccgctttctgatgccgaacgtgttaagatcaagaaagccttgagaggagtaaaggtggaagttacccaccgtggcaacatgaggcggaagtaccggatatctggtttgacaattcagccaactcgtgagctaacttttcctgttgatgaaggaggcacagtgaagtcagttgtacagtactttcaagagacatatggctttgccatccaacacacctaccttccatgccttacagttcagcgattaaattacctgcctatggaggtctgcaaaatagtggaaggacagagatactccaagagattaaatcagaatcagataagagctcttttggaggagacatgccaacacccacgtgatcgggagcgtgatattattaagatggttaaacataacgcttatcaggatgatccttacgcaaaagagtttggcattaagataagtgatcgtctggcatcagtagaggcacgaattttaccggctccacggcttaagtacaatgagactggtcgagagaaggattgcttaccaagagttggtcaatggaatatgatgaacaagaaaatggtaaatggtggtaaagtcagaagctggatgtgcgtcaattttgcccgtaatgtgcaggaaagtgttgttcgtgggttctgccatgaacttgctctgatgtgtcaagcctcaggaatggatttcgctccagaacctatccttccaccactaaatgcacatccagatcaagtggagcgtgctctaaaagctaggtatcatgatgcaatgaacgttcttggaccccagcgcagggaacttgatttgcttattgggatactacctgataacaatggctcgctttatggtgatttgaagcgcgtgtgtgaaatagatcttggaatagtttcacaatgctgttgcacgaagcaggtgttcaaaatgaacaaacaaattcttgcaaatcttgctctgaagataaatgtcaaggttgggggcaggaacactgtgctggtggatgctgtgtcaaggcgtattcctctggtaaccgacagacctacaattatatttggtgctgatgttacccatcctcatcctggagaggacagcagtccctcaattgctgctgttgtagcctcccaagattggcctgaggtgacaaagtatgctgggttggtttctgctcaagcccaccgacaagagctgatagaagatctatataaaatctggcaggatccacagagaggaacagttagtggtggcatgatccgtgagctgcttatatccttcaaaagatcaactggtgagaagccccagcgaataatattttacagggatggcgttagtgaaggccaattttaccaagttctactttatgaattgaatgcaatccgaaaagcatgtgcctccctggagacaaattaccaaccaaaggtgactttcattgtggttcagaaacgtcaccacacaagattatttgcacataatcacaacgatcagaactcagttgacaggagcgggaacatactccctggtacggttgtagattcaaagatccgtcatccaactgagtttgacttctacctgtgtagccatgctggcattaagggtactagtcgtccagctcattatcatgtcttgtgggatgaaaacaacttcacagctgatgcattgcagattcttaccaacaacctttgctacacctatgcaaggtgcactcgctctgtatcaattgttccacctgcttattatgctcatctggctgccttccgtgctcgtttctatatggaaccagatacatctgacagcagctctgtcgttagtgggcctggtgtacgtgggccactttctggctcatcaacatcacgtactcgggcccctggtggtgcagctgttaagccacttcctgctctgaaggatagtgtgaagagggtcatgttctactgctgaagctagggcctacatagctaaagctcttcgtttcttggcaacctgcctatgatggttgtaattatgtgtcaaaaaatcccataataatctgccagctgctatcttctccattgtactatgctggtcatgtttgccaaagttaccctatatgtatgtatattatgctattgttttttttttttttgcggggactattgttatcatgtattatgttttactgtcatgtctgtagttatgattcgaggagtttgcg

SEQ ID NO: 6006 - DNA, 3414 bp, Oryza sativa
  Predicted polypeptide sequence is orthologous to G1146
gatcaaccctctctctctctctctctctgcctcggcgacctcgcctccgcttactctcccacccagacaaaaccctctttgcctctcatggcgtcacgcggcggcgacggcctcgtcggaggagggcgcgggcccctcggtgggcgggacggtagagggcgcggcccggccggtgggcgaggcggcggaaggggaggcggccacccgcagcagcagcagcagcagcagccgggctacggccgcggcgacgggggcggccgtggtcctgcccctgctgctggtggtgtcgttggtcgaggaactggaggcggcggcggcggcgggcgcggggacggcggacgcggccgtggccgtggcggcggcggcggagatggcgttcgccctgctatggccgcggctccggcggcgtcgactcctggtccggttgctgttgctgctcggagtactcctcctcctactcccgcggtccagatccccgcggtggcgtcgtcgtcgtcagcgcagccagcggcggcggcgcagcctcctccggcagccgcggcggtttctgccctcgcgagggacgttgggaggcagctggctgtcgtggcgggcggcggccgccccgctccccccgcggcgccgccggcgcccatcccggtgtcgagcaagggcgtcgcgccaccgtcgcggccggggttcgggacggtgggggagaggatcgtggtgcgcgcgaaccatttcctcgtccgcgtctccgacaacgacatgatctacctctacgacgtgagtttgagtcccccaccaaagaccaggcgcatcaacagggtagtgatgtctgagctggccaggttgcaccgtgagtcgcatctcggtggcataagcttcgcgtacgacggaagcaaggccctgtacactgcaggaaaactgccgttcgactccatggacttcaagatcaagctgggcaaagagctcagggaaatcgagtacaaggtgacaattcgacgtgctggccaagcagatctgcaccacctgcacgagttcatcgccggccggcagagggactctcagcagcaaacgatccaagcactggacgttgtactgagggagtcaccttctctgaactatgtcatcgtttctcggtcgttctactccactatgttcggccgacaagacattggtgatgggctggaatgctggaaaggatactatcagagcctgcgcccaactcagatgggactctcattgaacatagacatatcctctaccccattcttcaaacctatcagcgtggtagaatatgtcaagaattgtctgggcacacctactaatgctaatggccctgaccctaggcggcctctttctgacattgatcgcctgaaggttaagaaagcactacggggagttcgtgttgaaacaacacaccaggggaagagcagcaagtacaagatcactacgattacatctgagccactgagtcagctgaacttttctatggatggaactacccagactgttattcagtacttctcgcagcggtacaaatacaggctgcagtacacgtcttggccctgtctgcaatccggcaacccttctaaccctatatatttgccaatggaggtatgcaccattgtagaagggcaaagatactccaagaagctcaatgacaaacaagtgactggcctcctgagagcaacatgccagcctccccagaaaagggagcagaaaatcattgagatggttcaacacaacaactacccggctgataaggtggtgagtgattttagaattaatatttccaatcagatggccactatgccagctcgcgtgctgcctgcgcccacgctgagataccatgactctggaaaggagaaaacttgtaatcccagagttgggcaatggaatatgatcaataagaaaatggttggtggagctgtggttcaaaagtggacttgcgtgaatttttcacgcatgcatattgatgccgtgcacagactatgcggcgaactagtttatacatgcaatgctattggcatggttttcaatgaaatgccagagatagaggtggggtcagctgctcctaataacatcgaagctgccctgagcaacattcacacaagggctcctcaactccagctgctcattgtgattctcccagatgttaatgggtattatggaagaattaagagggtgtgtgagactgaacttgggatagtatcccagtgcctcaagccaggccgcaagctcttgagcttagacaggcagttcctggaaaatgtctcactcaaaatcaatgtcaaggctggaggacgcaactcagttcttcagagacctcttgtacccggtgggcttgaaaacacaacaataatttttggtgccgatgtcacccatcctgcttctggagaggactcatcggcgtcgatcgcagctgtggtggcctccatggactggcctgagatcaccaagtacaaagccctcgtctctgcccagccacctcggcaggagattatacaagatctcttcaccatgactgaagttgcgcagaatgctgatgctccagcacagaaggctgaaggttcgaagaagaatttcatatgcggcggaatgttcagggagttgcttatgtcattctacagtaagaatgctaaacgtaagcctcaaaggataatattttacagggatggtgtaagtgatggacaattccttcatgttctgctctatgagatggacgcaatcaagaaggctattgcatctttggacccagcatacaggcccctggtgacatttgtggttgtccagaagaggcaccacacaaggctcttccctgaggtgcatggaaggcaagatctgacggacagaagtggaaatgttcgtccaggaaccgtggttgacactaacatttgccaccctagtgagttcgacttctacctgtgcagccatgccggaatccagggaacaagcagaccaacccactaccacgttctccatgacgagaaccgttttagtgccgatcagctgcagatgctcacttacaatttgtgttacacctacgctcgatgcacccggtctgtctctgttgtccctccagcctactacgctcacctggcagcattccgggcgaggtactacgatgagccccccgccatggacggagcttcgtcggtcggcagcggcggcaaccaggcggcggccggcggccagccaccggcggtgcgccgcctcccgcagatcaaggagaacgtcaaggacgtgatgttctactgctgatcgaatcggcgcctagcttgggttttaactacaaacattttgttggtcgctcgtcagtattcattcaggctgttagtgtactgtgctatctctgaaattgtgatggtgtcatttgggacatgttaacctgttgttgaacttgtgatctgtgatgttgatgcagctgct

SEQ ID NO: 6007 - DNA, 3636 bp, Oryza sativa
  Predicted polypeptide sequence is orthologous to G1146
aggtctgctctcctcaatcctcccccactccttgggtaaatcgttagcctagccgccacccgtactgagcgctccgccatggcgctcgtctgaacttcccctttagcgcccgccatggcctgccgccccatgtgagtaatgcggttatgtgtagcagggtagttttttcctattgctggagaagatcctccacttaaatggagaaaatcgacggggagatcgctcttttgttgctggatttctgtttattccgatctgttagactgctagtccctaaataggtgtagctttcgtttctgggcattctatttttcatggttgcggcgtcactttcatatctctttcacccatgaatcgactccgatagtgtgtgttactcgtaacctgtactactgcatttccattacatctagataatcagaaccgccactcaagtttcagtagtttggtcttgtaatggtggttctaattctgttggttgactgctctctgaaattaattttattcgtttagttattattatgtgatcttgaggtgtaggttcatgacttcatgttaagtagctccaaattattcttcattcccccctcctccccctgaaaatcttgttctgaattccaatagaaaagttattcttcctttttcccctgaaaatttcgttctgaattcccaataaaaaggttataaatttatatgcatgaagttcatcgagttgttctgaaaatcttacagttcgttatcaatacaaagactacttcaagtcaaacaagcaggattctacctgatgagctcatcaagttgcacgggttcacaactcttggtggcaaacggccagcatatgacggaagagagagtctctataccaatggttcacttccttttgaatcaaaggagtctgtggtcaaagtatttgatccagaaaagaatgctaaagaaagggcgcaaaaggaatttaagatcacaattgaaattgttggcaaaacaaacttgtaccacctccagcgctttctgctcggaaagcacaggggcatagcccaagaaatcatccatgtttttgatgttatcctcagtgataaactttctcggaatcatgtcacagggcccagatcctttctttgtactcagattggtcaccagggttacattggtgatggacttgactcttggagaggttaccatcaaagcttgcgcctgagaaagatagggatttcactcaatacggatatgtctgcagcatcctttatgcctgtgagaattatccaaattatagatgggttcctgaacataagttacacctcaagacctttgttagagcggaaccgtgtgcagctaaagaaagtattatgtcatgtttgcattgaaacaaaccaccatgatgaccaaatcggaagatataagataacagggatcacccctattcctatgagcaataacatatgtcctgttggtgaggaaggaacaacaatgactgttcttcagtacttctgtgatatggagaaaacaggtgtgcctagtgttggacattggaacatcgctgaagagaaaatcattaatggaggagctttggataattggacttctctgaatctttcacgaatgcgcccggaggaagtacaaaggttctgcagcgacctgattcagatgtgcaatgccactggaatgtccttctatccaagaccagttgtggacttccggtcatcacatcctaacaacatacagaatgctctgagggatgttcacaggccaatgcattcctatgttgattgtgatgagaatcatttttatgctgatgctcattgcaactgtaccgtgtctgtggtcccctcatcatcgaacgacaaagttgctgtggaacaggaggaattacaatttgcctcaacccctggcaacagtggacagggcaaatttcaggttggtttcctgctgaacagacagacgatactagtagatacagaaaatgacgactcagtttctgctgttatccagcaggcaattgaaaagacaaattattggccaaaggatgtgtattacacatactccatgggcatgattgacaaaaagaagatggtgaaggaatcacatctctataaaggttctctcatatttgtcaattccagaagccggggcggtggagagcctcctgctggttgcgagaggattgttgatagaatgattaaggcaaacaaaattcctctactggatcatatccatagtgtgaaggggcatgatccctgggctgaatggtttgagcgtgtgaacttaccaagatcccttttaacatcttcacaagaatggggtggtgtacttttgcaagatgcagcagctaaagttggacagatgttggctctctgtctggaaagggcccattgttctgggaaatgttttggtggctttgacatacgtgatgtctattatatagagtattaccagttgattgacattaatgcccccatgacggatttcacaagtagaagatatataaatgattggttatcgttcaataagattattgatgaccactttagatacactgatccaacctcaggttatctatcatatacactgtacgtggaagattttatgttcagaatatctttacttgaagatgtgccatctactggacgttcttggagggaaagggctgtctttttcaagaatatcagccttgaatcatcagagaggagagtccagattgttgaaggacttgtggggttttatcgtgaaagactcacttcagacagagaattattcgaggaggtattgcaggattgtggctattggaaaagacaaacaagaacggtgcctcgtatgatttctgcgttgacatattctgtaaagaatgaattgcaggactgggtacctgctaatcattactttgagaattgtgggtattcccagctttatttctgtagatgtttctttggacattatacagtaccaggaaggatcacgaagaaggaactggatacagctgtaggcatacttttgccaggtcatatcccaagggctcaaaaaagactgatggtcaactatgagaagacccaagtagatgctgcagtattgtcaccatcaggaaatactgcaaggttcagtgtgcatcatatttttggcattggttctgttggaaatgacctggctctcccacaaataaaaaaggctcttcctccctcgcaaagaaaaaggaaacaaacttgtgacaagtaagtctaactagcctactatacacatgtagctgcttctctgcaaacttcccgttggtagcagagagctctgatggcagcagcgggcaagctgtggaggtgcgttaacttcccaaagatcaaaggttcccaactgcttatatgatgagatgttggcgattcccatagagatgtggttgatgaagtttagttgaagattcccaactgcttataagacttctcttgaactggttgctggtagttttttttttgctgctcgttgtagtagattgtcagtgagcttctgtggtatgcaaggcactcagcttgacacaatgcaactatgccaagtatgttaagttcccagtagttttgttatctaacctttgttctctgtatgatatttgcctcatcagctgctctgctcaaaatgcttccttttatatttgtagttttg

SEQ ID NO: 6008 - DNA, 2503 bp, Oryza sativa
  Predicted polypeptide sequence is orthologous to G1146
gtggagctgtccggcagcaggaagttcaaggtggccatccggcacgtcgcgccggtcagcctgcaggacctgcggatggtcatggccggctgccccgccggcatcccgtcgcaggcgctgcagctgctcgacatcgtgctgcgcgacatggtgctcgccgagcgcaacgacatggggtacgttgcgtttggtcggtcttacttctcaccggggctcggatcgagggaactcgacaagggcatctttgcgtggaaggggttctaccagagttgccgggtcacgcagcagggcctttctctgaacatagacatgtcttcgactgctttcattgaacctggtcgggtgctgaattttgtagaaaaagctattggacgtcgaatcactaatgctattactgtgggatattttttgaacaattatgggaatgaattgatgaggacccttaagggtgttaaggttgaagtcactcaccgaggaaatctacgcaagaagtacagcattgctggcttcaccgagcagtctgcagatgttcagacgttcacatcatctgatggtatcaagactgtcaaggagtatttcaacaaaaaatacaatctgaagttagcttttggttatcttccatgcctgcaagttggcagcaaggagagaccgaattacctgcccatggagctttgcaatatagttcctggacaacgatacaagaacaggctcagtccgacacaggcttccaatctgattaacataaccaacgatcgtccttgtgaccgtgagagctccattcgtcagactgttagcagcaaccagtataacagtacggaacgcgcagatgagtttggcatagaagttgactcttatcctactactttaaaggctagagttttgaaagctccaatgctgaagtaccatgattctggaagggtgagagtatgcacgccagaggatggggcgtggaacatgaaagacaagaaagtagttaacggtgctacaattaaaagctgggcatgtgtcaacttgtgcgagggtttggataatcgtgttgttgaagcattctgccttcaattggtcagaacgtccaaaataactggactggactttgcgaatgtgagccttccaatattgaaagctgatcctcataatgttaaaactgatcttcctatgcgctatcaggaagcatgcagctggtcgagggataacaagattgacctcctacttgttgtaatgacagatgataaaaataatgccagcttatatggtgacgttaaaagaatctgtgaaacagaaatcggtgtattgtcacagtgttgtcgagcgaagcaagtctacaaggagaggaatgttcagtactgcgcaaatgttgctcttaagatcaatgccaaggctggaggaaggaactcggtatttcttaatgtagaagcaagtttaccggttgtttcaaagagcccaactattatatttggtgctgatgttacccatcctgggtcctttgatgaaagtaccccttccattgcttcggttgttgcttccgcagactggcctgaggtgaccaagtataattctgttgttcgtatgcaagcttctcgtaaggagattatacaagatcttgatagcattgttagggaacttctcaatgcattcaaaagggactccaagatggagccgaagcagctcattttctacagggacggcgtaagcgagggtcagttccagcaagttgtagagagcgaaataccggagatagaaaaggcttggaagtctctgtatgctggcaagccacgaattaccttcatagtggtgcagaagaggcatcatacaaggctgttccccaacaattacaatgatccacgcggcatggatgggactggaaatgttcgtccaggcacagtagttgatacagtgatctgtcaccctcgagagtttgatttcttcctgtgcagccaagccggggatcaaagggacaagccgtcctagccattaccatgtgctgcgcgacgacaacaacttcaccgcagatcagcttcagtctgtcacaaacaacctgtgctacttatatacaagctgcactcgctcggtgtctattccacctcctgtttactacgctcataagctcgcattccgcgctcgtttctacctcacccaagttcccgtcgccggtggagatccaggtgctgctaagttccagtgggtacttccagagattaaggaagaggtgaaaaagtccatgttcttttgctagtcgtccttgtgcccccctgaaactgaagcctggagccagccggcaagctctggaaatgctctgaataatcaaacttggaagaataagcacctgcccaggttgccattcgtttccatgtggcatggaggatggcatcctgaaaaggatattgtcatgtttgtgtggtttttaaacgacattgaagtttatctccggtgttactatctcagcactttggttgttttattttgttatgtctgaagatatagacacaaaacttcatttttgttt

SEQ ID NO: 6009 - DNA, 3177 bp, Oryza sativa
  Predicted polypeptide sequence is orthologous to G1146
atggcctaccgcggcggaggccgaggtggccgcggcggcgagcagcggccgccctactccggccgcggcgacgtccctggccgtggtggcggtggtggtgggggtggagccccgccgtaccgtcccgcctcgggcttcgtgtggccgccgccggggatgacgccgcggccggggcctcctcagccgcagtacccgcggccggggccgccggccgtcgtctacggcgcgccgatgccggcggcgcaccaccagggcgcgtaccagcccgggggcgtgtaccgtgcgccctccccgggggttccggtgatcggtggctacgcgcgcagcacgcccgtcaccatccgggcgcctccgccgtcgcactcgtcggctccggctccgtaccagccggcggcggccgcgccggctccctcgtcgtcctccacggcgccgtccgctacggctctggccaaggagttcgagcagaagctgttcgtgtcggagaccgcgctggcgccacccgcggcggtggcgtcggccgcggccgcgccggctggcgaggcgtcggtggagtcggacaaggatctggcaccggtgtcgaagaaggggctcgcccaccctgcgcggccggggttcggagcggccgggaagaaggtgatgatccgcgcgaaccacttcctcgtcaatgtcgccgacaacaacctcttccactacgatgtttcaatcaatcctgagtcaaaatcaagagcaacaaatagggaagtactcaatgagctcatcaagttgcacgggaagacatctcttggtggcaaattgcctgcctatgatggaagaaagagtctctatactgctggttcactcccttttgaatcggaggagtttgtggttaagctaattgatcccgaaaagaaggataaagaaagggcggagagggagtacaagatcacaattcggattgctggcagaacagacttgtaccacctccagcagtttttgcttggaagacagagggatatgccccaagaaaccattcaagttcttgatgttgtccttagggagtcaccatcttggaattatgtcacagtgtccagatccttcttctctacccagtttggtcaccggggtgacattggtgagggacttgagtgttggagaggttactatcagagcctgcgcccaacacagatgggcctttcgctgaatatagatatatctgcaacgtccttttttaagcctgtgacagtgatccaatttgtggaggagttcctgaacatacgtgacacctcaagacctttgtcagaccgggatcgtgtgaagataaagaaagcattacgtggggttcgcattgaaacaaaccaccaagaggaccaaatcagaagatacaagataacagggattacccccattcctatgagccagctgatatttcctgttgatgataatgggacaaggaagactgttgttcagtacttctgggataggtacaattacagactgaagtacgcttcttggccctgcctacagtctggcagtgattctcgccctgtatacttacctatggaggtgtgcaagattgtagaagggcagaggtactccaagaagcttaatgacaaacaagtgaccaacatccttagagcaacctgtcaacgcccccagcagagggaacagagcattcatgagatggttctccacaacaagtatacagaggataggtttgctcaggagttcggtatcaaggtctgcaatgacctagtctctgttccagcccgtgtgctgcctccacccatgttgaagtatcatgattctggaagggagaaaacttgtgcacccagtgttggacagtggaacatgattaacaagaaaatgatcaatggaggaactgtggataactggacatgtctgagtttttcacgaatgcgtcctgaggaggtacaaaggttctgtggtgacctgattcagatgtgcaatgccactggaatgtctttcaatccaagaccagtcgtggatgtccggtcaacaaatcctaacaatatagagaatgctctgagggatgttcacaggagaacatcagaactgctagccagagagggaaagggaggcctgcagcttttaattgtaattctgcctgaagttagtggttcttatgggaaaattaaaagggtctgtgagactgaccttggcattgtatctcaatgttgtttgccaaggcatgccagcaggccgaacaagcaatatttggaaaatgttgcactcaaaatcaatgtcaaggtcggagggcgcaacactgttcttgagcgagcctttatccgcaatggcataccatttgtgtcagaagtcccaacaatcatctttggcgctgatgtcacacaccctccacctggagaggactctgcatcatctattgctgcggttgtggcatctatggattggcctgaaatcaccaaataccgaggtctggtctctgctcaaccacatagacaggagataatagaagatctctttagtgttggtaaagatccagtgaaggttgtaaatggtgggatgatcagggagttgcttatcgcattccgcaagaagactggcagaaggcctgagaggataatcttctatagagatggtgtaagtgaaggtcagttcagccatgtgcttcttcatgaaatggatgccatcagaaaggcttgtgcatctttggaggagggatatctaccacctgtcacatttgtagtagttcagaaaaggcatcacacaaggcttttcccagaggttcatgggaggcgagacatgactgacaagagcggaaacatccttcctggaactgtcgtggaccgtcagatttgccatcctacagagttcgatttctacctgtgtagccatgctggcatacagggtactagcaggccaactcattaccatgtcctttacgatgagaaccattttacagccgatgcacttcagtccctgaccaacaatctttgctatacctatgcgcgatgcacccgggcagtgtctgtggtcccaccggcctactatgctcatcttgctgcattccgcgctcgctactacgtggaaggagagagttcggatggtggctcgacccctggcagcagcgggcaggctgtggcgcgagagggccctgtggaggtgcgccagcttcccaagatcaaggagaacgtcaaggacgtcatgttctactgctga

SEQ ID NO: 6010 - DNA, 3644 bp, Oryza sativa
  Predicted polypeptide sequence is orthologous to G1146
gggtagaagcagaggtaagcagggcagagagtagaaacaggagcactgcattactggtagtgggagcgtaaagctctctcctctcttcttcttcttcttcttggcgttttccctcatctccttctactagtactagtacatcaccctcccactcttcttcatcttccgcccagcgaggttcgtctggatgtgagctgaatctctccgtctgcccaagttgattgagttggtcgactgaatgggatcaaggagaccaagactgcctgggtttggtgaggactgtgagcctcgtggtggtgggagaggaggaggtggccgtggccgtggcagctactacccacaggcacagcaataccacccacaaggacatggtggccgtggaggagcaggctactaccatggtgctgctcctcaacctcgcggcgcaatggtggtgcagcaatggcgtcctgctactgctgctgctgagcatttgggccatcaacagccctacaacagcagtgtgagaccacagcactattatggtccgtctgccatagctcccgagctgctccaagcaatggatgctccacatgagcctcctgccaatgtctcctcaccagaagcagcctctccggaggcatcatcaccacggtctcttgctcttgaggtcacagagcagcttcaggacttgtctgtgcagtaccaattaagtgagagccaggaagagattgtccaacatgttcctgtgtccaccaaatcatttaaatttcctcaccgccctggaagtgggagtattggaaccagatgtttagtgaaggcgaatcacttctttgctcaactgccagacaaggatcttcatcagtatgacgtttcaatcaccccggagcttacatcacgaattcggagccgtgctgtgatggaagagttggtgagactgcacaagatgtcatacttgggaggacgtcttccagcctatgatggtaggaagagcctttacacggccggtccattgccgtttacttcaaaagaatttcgcatctctttgcttgaggaagatgatggttctggttcggagaggcgtcagaaaacatataacgtggtgattaagtttgctgcaagagctgatcttcaccgtcttgagcaatttctagctggaaggcaggcagaggctccccaggaggccttgcaagttcttgatattgtcttgcgagagttgccaacagcaagatatgcaccctttggtcgatccttcttctctcctgacctggggaggagacgatccctcggtgagggactagaaacctggcgtgggttttatcagagcattcgtcctactcaaatgggcttgtcactgaatattgatatgtcggcaactgctttctttgagccgttaccagtcatagattttgtcatacagcttttaaatactgacatccgctcgaggcccttatcagatgctgagcgtgtcaagatcaagaaggccttaagaggagtgaaggtaggagttactcaccgtggcaacatgcgccggaagtatcggatatctggtttgacatctcaggcaactcgggaactgacttttcctgttgatcaaggaggcacagtgaaatctgttgtacaatattttcaagagacatatggatttgcgatccagcatacctatcttccttgtctgcaagttggcaatcagcagcgtccaaattacctaccaatggaggtctgcaaaatagtggaaggacagaggtactccaagagactgaaccagaatcagataagggctcttttagaggagacatgtcagcgcccacacgatagggagcgtgacataattcagatggtgaatcacaactcctaccatgaagatccttatgcaaaggagtttggcattaagatcagcgagcgtctggccttggttgaggcacggattttacctgcccctcggctcaagtataatgagactggcagagagaaggattgcttgcctagagttggtcagtggaatatgatgaacaagaaaatggtaaatggtggtagagtcaggagctggatatgtgtcaattttgctcgaaatgtgcaagagagtgttgctagtggattttgtcgtgaactggcccgcatgtgccaggcctcaggaatggactttgctttggagcctgttcttccatctatgtatgcacgtcctgatcaagtggaacgagctctgaaagccaggttccatgatgcaatgaacatacttgggccacagcacaaggagctcgatttacttatcggactgcttcctgataacaatggttctctttatggtgatttgaagcgtatatgcgaaattgaccttggattggtttcccagtgctgttgcacaaagcaagtgtttaaaatgaacaaacaaatcctagcaaatcttgctctgaagataaatgcgaaggttgggggaaggaacactgtactggttgatgcagtgtcgagacgcattccgttggtaactgacaggcctactattatattcggtgctgatgtcacccatcctcaccctggcgaagatagcagcccatccattgctgctgttgtggcctcccaagattggcctgaagtgacaaagtatgctggtttagtttctgctcaatctcacagacaagagttaatagatgatctgtataacatcacgcatgatcctcatagagggcccatctgcggtggaatggtcagggaacttcttatatccttcaaaagatcaactggtcaaaagcctcaacggataatattctatagggatggtgttagtgaagggcaattttaccaggttctattgcatgagcttgatgcaatccgaaaggcttgtgcatcactcgaagcaaattaccaaccgcaggtgactttcattgtggttcagaagcgccaccacacgagattatttgcacacaaccacaatgatcagaattcagtcgacaggagtgggaacatattgcctggtactgttgttgactccaagatttgccatcctacggagtttgacttcttcttgtgcagccatgctggaatcaagggcacaagccatcccgctcattaccacgtcctgtgggatgaaaacaacttcacagctgatgcgttgcagaccctcaccaacaacctctgttacacttatgcgaggtgcacacgatccgtatctattgttccaccagcatactatgctcatctggcggcgttcagagcccgtttctacatggagtcagatagctcggacagtggttcaatggcgagtggtcgtggaggaggttcgtctacatcgcgcagcactcgtgctgcaggtggtggagccgtcaggccccttcctgcactcaaggacagcgtcaagaatgtcatgttctactgttagaattctactactgcttcgcttggctactactatcagttagcctttaaattgcctcccatttgattgcacttagttgttcatcatgggaagcctcaaataagaagtatgcaagacttctgaagccacatgctatcatgttgtgtgtttctgggacacaccattctatttcacattatctgtagactctatcccactatttcataaaagctgggcttcccctggctctatttgtactctaattcgtatggacctgtttcatcatttcaaaatggtcaattgtcttgtttgc

SEQ ID NO: 6011 - DNA, 3746 bp, Oryza sativa
  Predicted polypeptide sequence is orthologous to G1146
ttgaggcggaggcagcagcagcagtgcggtagtgcaagcgctagtggaggagttgggaggaggccccctagggtttcccgagaccgcctccccccgcgcctgcgccgccgctcgccgagcgcgcgctccgtgcccatcatggtgaagaagaaaagaactgggtctggcagcaccggtgagagttctggagaggctccaggagctcctggccatggttcttcacagcgagctgagagaggtcctcaacagcatgggggaggacgtggttgggtgcctcaacatggtggccgtggtggtgggcaataccagggccgtggtggacattatcagggccgtggagggcaaggttcacaccatccaggtggagggcctcctgagtatcagggtcgtggagggccaggttcacatcatccaggtggtgggcctcctgactatcagggccgtggaggatcaggttcacatcacccaggtggtgggcctcccgagtatcaaccgcgtgactatcaaggacgtggtggtccacgccccagaggtggaatgccacagccatactatggcggacctagggggagtggcggacgtagtgttccttcaggttcatcaagaacagttcccgagctgcaccaagccccacatgtccaataccaagccccgatggtttcaccaaccccatcgggagctggctcatcctctcagcctgcggcggaggtgagcagtggacaagtccaacaacagtttcagcaacttgccacccgtgatcaaagttcgaccagccaagccattcaaatagcaccaccgtcaagcaaatcagttagattcccgttgcgccctggcaagggtacatatggggacaggtgcattgtgaaggcgaaccatttctttgctgaacttcctgataaagaccttcaccaatacgacgtatctattactcctgaggttacttcacgtggcgtgaatcgtgctgttatgtttgagttagtaacgctgtatagatattcccatttgggcgggcgtctacctgcctatgatggaaggaagagtctttacacagctggaccattgccatttgcttctaggacatttgaaattactcttcaagatgaggaagatagtcttggtggtggccaaggcacccaaaggcgtgagagactatttagggtggtgatcaagtttgctgcccgtgctgatcttcaccatttggctatgtttctagctggaaggcaagcagatgctcctcaagaagcccttcaagtccttgacattgtgttacgtgaattgcctaccacaaggtactcaccagttggtcggtcattttattctcccaatttagggagacgccagcaacttggtgagggtttggaaagttggcgtggtttttaccaaagcataaggcctacccagatgggtctctcactgaatattgatatgtcatcaactgcatttattgagcctctacctgtgattgactttgttgctcagcttctgaacagagacatctcagttagaccattatctgattctgatcgtgtgaagataaagaaagctctaagaggtgtgaaggttgaggtgacgcatagaggaaacatgcgtagaaaatatcgtatatctggactcacttcacaggcaacaagggagttatcattccctgtcgatgatcgtggtactgtgaagactgtggtgcaatattttctggagacatatggttttagtattcagcacaccactttgccttgccttcaagtgggcaatcagcaaaggcccaattatctgcctatggaggtttgtaagatcgttgagggacagcgttactcgaagcggcttaacgagaaacagattactgcgctattgaaagtgacttgccagcgacctcaagagcgtgaactggatattttgcggactgtatctcacaatgcataccatgaagatcagtatgcgcaggaatttggcataaaaattgatgagcgtcttgcatctgttgaagctcgtgttctgcctcccccaaggcttaaataccatgatagtgggagagaaaaggatgtattgccgagagttggccagtggaacatgatgaataagaaaatggtcaatggtgggagagtcaacaactgggcatgtattaacttctctagaaatgtgcaagatagtgctgccaggggcttctgtcatgagctggctatcatgtgccaaatatctggaatggattttgcactggaacctgtgctgcccccacttactgctagacctgaacatgtggaaagagcactgaaggcacgctatcaagatgcaatgaacatgctcagaccgcagggcagggaacttgatttactgattgtaatactgcctgacaataatggttctctttatggggatctcaaaagaatctgtgagactgatcttggattggtctcccaatgttgtttgacaaaacatgtttttaaaatgagcaagcagtatcttgcaaatgttgcccttaaaataaacgttaaggtggggggaaggaatactgtacttgtggatgctttgacaaggaggattccccttgtcagtgacagaccaactatcatatttggtgcggatgttactcatcctcatcctggagaagattccagtccttccattgcagctgtggttgcttctcaagactggcctgaagtcactaagtatgctggattggtgagtgcccaagcccatcgtcaagaattgatacaagatcttttcaaagtatggcaagacccgcatagaggaactgttactggtggcatgatcaaggagcttctcatttctttcaagagggctactggacagaaacctcagaggataatattttacagggatggtgtcagcgaggggcagttttatcaagttttgttgtatgagcttgatgccattagaaaggcttgtgcatccctggaacccaactatcagcctccagttacctttgtggtggtccagaagcggcatcacacaaggttgtttgctaataatcacaacgaccagcgtactgttgatagaagtggaaacattctgcctggaactgttgttgactcaaagatttgccatccaaccgagtttgatttctacctgtgtagccatgctggcatacagggaacaagccgtcctgctcattatcatgttctgtgggatgagaacaaatttactgcagacgagttgcaaaccctcacgaacaacttgtgctacacgtatgcaaggtgcactcgctctgtatcaattgtgcctcctgcgtactatgctcatctggcagccttccgagctcgcttttacatggagccagagacatctgacagtggatcaatggcgagtggagctgcaacgagccgtggccttccaccaggtgtgcgcagcgccagggttgctggaaatgtagccgtcaggcctctacctgctctcaaggaaaacgtgaagcgtgtcatgttttactgctaagagcttgggctgtaccccgtatgcgccaaggaatgtagtactatgttatgttattttagcacttgcactctgtcgttgatcccgttaaaacgggtatgctaccataagctgttggactattctgggtattgtagtactacttgttttgtatttgtgtttgtgacgctgcagagcgtgaacaacgcaagtctggtacttgtatcgttgtgtttgtgggaacctaaatcttgttggacctttgttgtgcttgaagaaccaagttaaataatcctgtcagtatagggatttaattgctgcttggc

SEQ ID NO: 6012 - DNA, 3747 bp, Oryza sativa
  Predicted polypeptide sequence is orthologous to G1146
gaattatttctttgttctcctcctcctgattcgtcgtccgtccctaggaagcaaaggagaaagtttccactctgtctgcgggatatatcatatatatctcaatcgatccgccattggcgatcgacgaagtgatcaggggctagctcctttgcgctgcggctttgaccgcggtgtcgaagcttcttgcacatggccttccagttggacaacgggtactactcccatcaagctttagccatgatgagaaagaaaaaaactgaaccccgtaatgctggggaaagttctggaactcaacaagccactggagctcctggacggggtccttcacagcgacctgagagagctcacagcatggaggtggtggttggcaacctgccaatcctcaatatgctcaacaagctggtcgtggtggtggacaacaccagggacgtggtggacgttaccagggtcgtggagggccaacatcacatcaaccaggtggtggtccggttgaatatcaagcacatgagtactatggccgtggtgtccaacggcaaggaggaatgccacaacacaggagtggcagtggtggacatggagttcctgccagtccatcaagaacagttcccgagctgcaccaagcctcacaagaccagtaccaagctacggtggttgcaccatcaccatcaagaactgcaccatcttcgctgcctgttgaggccagcagcgaagaagtccaacatcagtttcaggaacttgccatccagggtcaaagccccactagccaggccattcaaccagcaccaccatcgagcaaatcagtgagatttccaatgcgccctggcaagggtacatttggtgataggtgcatcgtgaaagccaaccatttctttgctgaattgcctgacaaagaccttcaccagtatgatgtgtctataactcctgaggttccttcacgtggtgtcaatcgtgctgtcattggagaaattgtaacacaatataggcagtctcatttgggtggccgtcttccagtctatgatggaagggagagcttatacacagctggtccattaccatttacttctaggacctttgacgttattctgcaggatgaggaagagagccttgctgttgggcaaggtgcacagaggcgtgagagaccatttaaggtcgtgatcaaatttgctgcacgcgctgatctccaccatttagccatgtttttagctggaaggcaagcggatgctcctcaagaagctcttcaagttcttgacattgttctacgtgaattgcctactgcaaggtactctccagttgcaaggtcattttattcgcctaacttaggaaggcgccaacaacttggcgagggcctggaaagttggcgtggtttttaccaaagcatacgacccacgcagatgggactttctctgaatattgatatgtcatcgacagcattcattgagcctctacctgtgattgactttgttgcacagcttttgaacagagacatctcagttagaccattatctgatgctgatcgtgtgaagatcaagaaggccctaaggggtgtaaaggttgaggtcacacatagaggcaatatgcgcaggaagtatcgcatttctggccttacctcgcaagcaacacgagagttgtcttttcccattgataatcatggtactgtgaagacggtggtgcaatacttccaggagacatatggatttaacattaagcacacaactttgccttgcttgcaagtgggcaatcaacaaaggccaaattatctaccaatggaggtctgtaagattgtggagggacagcgttactcaaaaagactaaatgagaagcagataactgctcttcttaaagtgacctgccagcgccctcaagagcgtgagctggacattttgcagactgtgcatcacaatgcataccatcaggatccatatgcacaggagtttggcataaggatcgatgagcgacttgcatctgttgaagctcgtgttctaccacccccctggcttaagtaccacgatagtggcagagagaaggatgtcttgccaagaattggccaatggaatatgatgaataagaaaatggtcaatggtggtagagttaacaactggacatgcatcaatttttctcgtcatgtccaagataatgctgctaggagtttctgtcgcgagcttgctattatgtgccaaatatctgggatggacttctcaattgatcctgtggttcctctagtgactgcaagacctgaacatgtggaaagagcgctcaaggcacgctatcaagaggccatgaatatactgaaaccacagggcggggagcttgacctgctgattgcaatattgcctgacaataatggttctctttatggcgatctcaaaaggatatgtgagactgatcttggattggtctcgcaatgctgtcttacgaagcatgtttttaagatgagcaaacagtatttagcaaacgttgcccttaaaatcaatgttaaggtgggaggaagaaatacagtacttgttgatgctttgacaaggaggattccccttgtgagtgataggccaacgatcatttttggtgctgatgttacacatccccatcctggagaagattctagcccttccattgcagctgttgttgcttctcaagactggcctgaggtcaccaaatatgccggattagtgagtgcacaggcccatcgtcaggaattgatacaggatctttttaaagtatggaaagatcctcaaagaggaactgtaagtggtggaatgatcagagagcttctcatttctttcaagagggcaactggacagaaaccccagaggattatattttacagggatggtgtcagtgaaggacagttttatcaggttctgttttatgagcttgatgccattagaaaggcatgtgcatctttggaagccgattatcagccacccgttacctttgtggtggtccagaagcgtcatcacacaaggctgtttgctaataaccacaaggaccagcgcactgttgacagaagtggaaatatactaccaggcaccgtggttgattcaaagatatgccatcctactgagtttgatttctacctgtgtagccatgcgggcattcagggaacaagtcgccctgcacattatcatgttctgtgggatgagaacaagttcactgctgatggtttgcaaactctgacaaacaacttgtgctacacctatgcaaggtgcacccgttccgtatcaatcgttcctcctgcatattatgcccatctcgcggcatttcgagctcgattttacatggagccggatacttcagatagtgggtcgatggcgagcggtgcccatacccgtggcggtggcccccttcctggtgcacgcagcactaagcctgctgggaatgttgctgtaaggccgcttcctgatctgaaggaaaatgtcaaacgtgtcatgttctactgctaagtttgggaatatttgtgtatgggggaaaacgtctgacggtttgagtcgccccctgttatctaagacggaacgacctatagtgtgtgtacgttaatgattgtggtgctgtgaactatcgaccatgatctggttgtttatctattatcaacactagaagttgaggattctagactctttcagtgtggctactcaaatcatatcgtcgaagaaatgtaataattgacaattacattgctgccatgtttccaggacaagctgatctcagctactgcggttcctttccacttgttggatgcgcaccttgattcgc

SEQ ID NO: 6013 - DNA, 3168 bp, Oryza sativa
  Predicted polypeptide sequence is orthologous to G1146
atgtcttcgcgcggcggcggcggcggaggccgccgcggtgggcgaggcggcggtggtgggcgggaaggaggcggaggtggaggtggaggtggcgggaggggtggccagggtaggggcgatctcggcgtcgtcggcgagcggcaaggcggtggtcgaggggcgggtgagcgcggaggccgtcacgacgcgccgcgcggccgtggcggcgtcgctgtgggcgccggggctgggcggcagcagcagcagccattccacgccccggccccgccatctggcggcggcggacgaggcggcgtgcaggtgcagcccaatgcggcggcgcgtcgacccgtaggcggcgggcgcggcggcgtcggagtgccggcgcctgcgccggcggttgcggtgggggctctgtgcggcgagatgaaggggaagatggttgtgtcgggtggagcgccgccagcaggccagggttcgtcgttggcggcggcgcagggcacggacaatgtcaagagagagccatctcaggtcgccgcaccggcgcccgcgcccccgcccgcgacgctgccgccgtcgtcgagcaaggcggtgaccttcccggcgcgtccggacgtcggcacgatcgggaggcggtgccgcgtccgcgccaaccatttcctggtgcaagtcgcggacaaggacatctaccactacgacgtggtgatcactccagaatcaacttatcgtgagagaaatagatcaataatcaacaaacttgttgcgttgcacaaacaattcttggatggtaggttacctgtctatgatggaagaaagagcatatatactgcaggtccactacctttcaaaaccaaagactttgttgtcaagcacattaatcctttgaggggtaaccaacgggaggaggaatacaaggtgaccataaagcaagcctccaaaacagatctgtacagccttaagcagtttttggttggaaggcagagggagttgccacaggacactattcaagctcttgacattgctcttagggaatgccctacctcagtaaattttacttgtgacaggtatgtatctatctcaaggtcatttttctcccaatcatttgggcatggtggcgagattggtagtggtacagagtgttggagggggtattaccaaagtctgcgccccacgcagatgggactgtcgctaaatatcggtatggatttacctcaaaatatttctgcaacagcattttacaaggcccagccagtgatggactttgcagttcagtatttgaacatccgagatgtttcaaggcgcttgtctgatcaagatcgtattaaactgaaaaaggccctaaaaggagtccaaattgtggcaactcactggaaagagaaatccatacgttacaagatcactggaataccctcagctccaatgaatgaattgatgtttgatctagatggaaacaggatatcagtcgtccaatactttaagaaacagtacaattactccttaaaacatgttaattggccatgccttcaagctggcagtgatagcagaccaaaatatttgcctatggaggtctgcagtatacttgaaggacaacggtattcgaagaagctaaatgagcatcaagttacaaacattctaaggatgacatgtgaacgacccgcacaaagggagagcagtatcatagagattgttaatacgaactcttatggcaatgatgattgtgcaaaagaatttggcatcaaagtcgctaaccaacttgccgtggttgatgcccgtgtactgcctacccctaggcttaaatatcatgactctggaagagaaaaagtatgtaatccttccgttggacaatggaacatgattaacaagaggatggtaaatggaggatgtatcaaccattggacctgcctatcttttgcttctcggatgcatgtaaatgacattaggatgttttgtgaagacctggttggcatgtgcaataatattggcatgcaaatgaatacgagaccatgtgtggatatcatacaaggacagcaacgcaacatcgagggtgcaatcagaaatatccataggcaatcttcagaaaagcttgaccagcaagacctgacagggcagcaacttcagttattaattgtaatattgactgaaattagtggttcttatggaaggataaaacgaatttgtgaaacagaggttggtgtgataactcaatgctgtgcacccaagagtcttcagaaaggtgggaaacagtatcttgaaaatctggccctaaaaatgaatgttaaggtcggggggcgaaatacagtacttgaagatgcgttgcacaagaaaataccaattctgacagatcgtcctacgatagtgtttggagcggatgttacacatccatctcctggggaggatgcttctccatccattgcagcggttgttgcatccatggattggccagaagttacaaagtacaaatgcttggtatctacacaaagtcatagggaagaaatcatatctaatctttacacagaagtgaaagatccattgaagggaattattagaggtggaatgattagggagttgctcaggtctttctaccaagaaactggacagaaacctagccggattatattttatcgagatggtatcagcgagggacagtttagccaagtgttgctttatgaaatggatgcaattcgcaaggcatgtgctagtttgcaggagggctaccttcctccagttacatttgttgttgtccagaaaaggcatcacacccgcctatttccagaaaatcgtcgagatatgatggatagaagcggaaatatccttcctggaactgttgttgacacaatgatctgccatccgagtgagtttgacttttacctctgtagccattctggtatcaaggggacgagccgtccaacacattatcatgttcttttagatgaaaatgggttcaaggctgatacgctgcaaaccctaacctacaatcttagctacacctatgcccgatgcacccgagcagtctccatagttcctccagcatactatgcgcatctgggagccttccgagcacgctactacatggaggacgagcattctgatcagggctcttcttcctccgtaacgacgcgaacggatcgatcgacgaagccgcttcctgaaatcaaggagaatgttaagcggttcatgttctactgctga

SEQ ID NO: 6014 - DNA, 690 bp, Oryza sativa
  Predicted polypeptide sequence is orthologous to G1146
gtggatccccgggctgcaggttttttttttttttttttttttgaggtcaaaacgacttatagtatagaaaggagagagtacaaccctaggagacaggtcaccacagtccacaagcatttaacagtagaacatcacacctaggacacgatcagcaatctttggaacattcagaaactcaggcaactcagaagacacttcattcctgatgcttgatccatcgccaaacttcccgagatagcttcgtcctcgggctgcagcaagatgagcatagtatactgggggaactatagaaacagcacgggtgcatcgtgcatacatgtaacataggttgtgcgtaagcaactgaagcccgtcagcagtgaaatgattttcatcgaagataactgtataatgcgtaggtctactgtttccctgagaagtatggctacacaaataaaaatcaaaacccgaaggatggcatatgtcttggtcaatcacagttccagagggaatctgtgcaacttgttcagtataattactgcaaagtgtgtgagggaaaatcctggtgtgatgccttttctggacaatcactaatgtgatgggtggcagataatcctcttgtagagagaggcatgccttcctgatggcatctacttcatgaatgataacctggctgaattgactttcgcttattccatctctgtaaaagat

SEQ ID NO: 6015 - DNA, 3165 bp, Oryza sativa
  Predicted polypeptide sequence is orthologous to G1150
atggagggggagcgggagggggtggtggccaagaacgaggacaacgcaggcggaggtggtggtggattaggtacaggtggtaatggtggtggcggcggcggcggcagcgcgaacgggcggaggaggtggaggggcgggggcagcagcgggtataggcagcacccgatcatccaggcctacccggcgctcctgccgctgccgataaacggcgccaccggccacgcacacatcaacggcgcggtctcgctgccgctgcctctgccgccgccggtgctgctgtacctgcagccgccaccgccaccgccgctgctgcccctgctccccaaggtcgccgccgccacgttctacggcaagccacccaaggcggccgacgcggcaccgaggggctcaatgtggaagcacaggccatcgaaaaagccgccaccgcatgccattaccgccgcgctgctgccgctcccgcggggtattgatttgctaacagatggcaaggcgcttcaggagaaaatattcttcgcaaatgaaagaaaaacatctgaaaaggaggtaaatcatgtagacacccatgagaagtttactgttgcaccactggataatgcaatagcacggagacctgacatgggtggtgttgagggggccgagatccctctttctgcaaaccatttccttgtccagtttgatcctggccagaagattttccattacaatgttgacatatctccgcgtccatcaaaagaaacagcaagaatgatcaagaaaaaattagttgaagaaaatccaagtgttctctcaggttcccaaccagcctttgatggccgcaagaacttatatagtcctgttagatttcaggaggacagggttgagttctttgtcagcctcccagttgcattagcacgatgttcagtagttaaagaggatactggccacatgcttgacaaacagaaactcaagactttcaaagtgaatgtccggttggtttcgaagttatgtggtgaggacttgaacaaatatctgaacgaggacaaggatggcatccctcttccacaagattacctccatgcattggatgttgtgttgcgtgaaggtgctatggaaagttctatccttgtgggtcggtcactgtatgcacgctccatgggggaagcaagggacattggtggtggtgctgttggattaagaggtttctttcagagattgaggccaaccaagcaaggccttgcccttaatgttgatctctcactctcagctttccacgagagcacaggcataatttcatacttgcagaagcgctgtgacttcttgaaggaccttccacagaagaaaacaagggctttggcagaagaggagcacagggaggtggagaaagcattgaaaaatatccgggtatttgtgtgccatcgtgagactaatcaaaggtaccatgtgcatagcttgactaaggagacaacagagaacctcaagtttcgcgaccgaagtgggaaggatcttatggtggtggattacttcaaggagcactataaccatgatatacaattcaggaaccttccatgcttgcagattggcaggagcaagccatgttatgtgccaatggagctttgtgtagtttgtgagggccagaagtttcttggcaagctgtctgatgaacaaacttctaagattctgaaaatgggttgtgaaagaccgagtgaaagaaagggaatcataaagggtgttgtcaaaggtgcatttcatgcaagaagcgatacttatgctgatcagtttagtctccaagtgtcgaaacacatgacgaaactctctgggagggttctcttgcccccaaaattaaagcttggcagcagtgggcgcatcaaggacataacaccggaccgatttgatcgacagtggagctttctggatagccatgttgcagagggttccaagatcaagagttgggccttgataagttttggtggcaccccggagcagcacttttgcattacaaagtttgtgaaccagctatcaaatcggtgtgagcagctaggaattctgctaaacaagaagaccattatcagcccaatatttgagaggattcaactactcaataacgtgggaattttggagggcaagctcaagaaaattcaagaagctgcatcaggcaacttgcagttgctaatctgtgtcatggagaggaggcaccaaggctatgctgatctgaagcgaattgcagaaacatccattggtgttgtgacacaatgttgcctttactccaacttgagcaagctgacctctcaattcttgacgaatttggctttgaagatcaatgcgaaactcggtggctgcaatattgccctatacagcagctttccatgccaaattcctagaatatttttgtcggaggagccggtgatgttcatgggtgctgatgtcacacacccgcatccccttgatgattcaagtccatcagtggttgctgtagttgcaagcatgaattggccgtcagcaaataagtacatctccaggatgagatcacagacacaccggaaagaaatcattgagcaactggatgttatggctggtgaactgcttgaagagtttctaaaagaagtggggaagctcccaagcagaatcatattcttcagagatggtgtgagcgagacacagttctacaaggtgctgaaggaggagatgcatgcagtgcgcacaacttgttcgaggtatccgggttacaaacccttgatcacattcatcgtagttcagaagaggcatcacactagactcttccacagggagaggaatggcagctcgtcacactactctgatcagaacataccaccaggaacagttgtggacactgtgattacacacccaagggaatttgatttctatctgtgcagccactggggcaccaaggggacgagccggccaactcattatcatgttctgtgggatgagaataacttccgttccgacgaagtgcagcagttgatacacaatctttgctacacatttgctcggtgcaccaggccagtttctcttgtcccaccggcttactacgcacatctcgcggcatatagaggcaggctgtaccttgagaggtcagatacaactatgtacagggtcagtccgttgcagactgtgccgctacctaagctcagagacaatgttaagaggctcatgttctactgctag

SEQ ID NO: 6016 - DNA, 1756 bp, Oryza sativa
  Predicted polypeptide sequence is orthologous to G1181, G1850
aaagacttccggtccgtaccttcgttttcacacgcgaaaactgcctttcttccggcatctggaagctactactactacggtcggtcctcgccggatcagatccggccgcctccccggcggatggcggagcagggggcgggcgaggcggatgcgggcggcggggagccgccgccggcggcggtgatgacggcggcggcggaggcgttggcggggcagaggtcgctgccgacgccgttcctgacgaagacgtaccagctggtggaggacccggcggtggacgacgtgatctcgtggaacgaggacgggtcgacgttcgtggtgtggcggccggcggagttcgcgcgggacctcctccccaagtacttcaagcacaacaacttctccagcctcgtgcgtcagctcaacacctatggatttaggaagatcgtgccggaccggtgggagttcgccaacgactgcttccggcgaggggagaagcgtttgttgtgtgatatacaccgccggaaggtggtggcggcggctgccgcggcgccgccgccgccgtcgccgggatggcgacggcagctgccgcggtggcttcgggagctgtgacggtggccgcggcgccgatacctatggcgctgccggtgacgcgggcgggctcgccggcgcactcctcggaggaacaggtgctgtcgtcaaactctgggtcgggggaggagcaccggcaagcgtctgggtccggctctgcgcccggcggcggcggcggcggctccgcgtccggcggcgacatgggcgaggagaacgagcggctccggcgggagaacgcgcggctgacgcgggagctcggccacatgaagaagctctgtaacaacatcctcctcctcatgtccaagtacgccgccacccagcacgtggagggctccgcggggatatcctccatagcgaactgctccggcgagtcgtcggaggccgttcccccgccgccgcctctccccccggcgatactcgatctaatgccctcgtgccccgccctggccaccgccgccgccgctgcggggctcgccatagacggcgagcccgacccgagcgcgcggctgttcggcgtctccatcggcctgaagcggacgcgagacgacgccgccgccgccgccgacgaagacggcggcggcgaggatcaggccgagcacggcggcgcggacgtgaagccggaggcggcggatccgcatcccgccggcggcggcggcggaagcagcacggaggcgtcgccggagtcgcacccgtggcccatataccggccaacccccatgtaccacgcggtcaggctcacttgcaacgggccggacagggccgggtccgaccaagacgggtccagctccagccaaacgatgggacctggtgaattcgacgatctgcaaaagatgatggtggtgcaacagagcaacttcgtgatgcactggggacgctcggaatgcggtagtggcgtaaggggttttggatggtgatggcagacaacagcaaatggtgttgtgatccacggaggcggagatggtgcggtgatgggtagctgggactagttccaattctccctttccatcctctcgggttgcggcggaaagttcaagtcatcgttgaaggtttaaagctaactcttcaagctttgtgtgtgtgttggtgtgtttgtgtgttttcctctgcatgaggattggagtctaagaacttgtatgttatggttgtgtgatatagaggctagattaataaaaaaaattcattatct

SEQ ID NO: 6017 - DNA, 1938 bp, Oryza sativa
  Predicted polypeptide sequence is orthologous to G1181, G1850
atctgccatgaaaggaagcaggcttgcggtgaaagaaagttgtctgccgatgacgatgccaatgccagagactttcgcacagtacagtaatccattgcggtcaactagggcctacggtcaactctgcagggtgccaggccggcggcggcacgcgtgcgtcgacggctgggggcaggaccgcgcccgcacgaggggagacgacggccagcggcgctatgcgcagtgccgcggtggctggggagatatttggagatggggaggctacattacatgcgggtcaccgcgggagacggggatggtgaatggtgcaccgtccccgcccccgccatccccgatggtgatgagttttggaccattagattcaccatgggtgaagcaaccagacaccacggtgtatccaggccagatctgcgcggccgccggcggcggcggtggcatggctgaccagaccgctgctgccgttgtcgtcggaggaggagcggcggcgacgatgggggagccatctccacctccgccggcgccggcagcggaggcggcgggggtgggggtggggcagcagcagaggacggtgccgacgccgttcctgaccaagacgtaccagctggtggatgacccggcggtcgacgacgtcatctcctggaacgacgacggctccaccttcgtcgtgtggcgccccgccgagttcgcccgcgacctcctccccaagtacttcaagcacaacaacttctccagcttcgtccgccagctcaacacctacggatttaggaagattgtcccggacaggtgggagttcgccaacgactgcttccgccgaggggaacggcggctgctctgcgagatacaccgccggaaggtgacgccgccggcgccagcggcgacgacggcggcggtcgcggccgcgatcccgatggcgctgccggtgacgacgacgcgggatggctccccggtgctgtccggcgaggagcaggtcatatcctccagctcgtcccccgagcccccgctcgtgctgccgcaggcgccgtccggctccggctccggcggcgtcgcgtccggcgacgtgggggacgagaacgagcggctgcggcgggagaacgcgcagctcgcgcgggagctcagccagatgaggaagctctgcaacaacatcctcctcctcatgtccaagtacgcctccacccagcagctcgacgccgccaacgcctcctccgccgccgggaacaacaacaacaacaactgctccggcgaatccgccgaggcggccacgccgctcccgctccccgccgtcctcgacctcatgccttcctgccccggcgccgcctccgccgccgcgcccgtatcagacaacgaggagggaatgatgagcgcgaagctcttcggcgtctccatcggccggaagcgaatgcggcacgacggcggcggcgacgacgaccacgcggcgacggtgaaggcggagccgatggacgggcggccgcacggcaaggacgaacaatcggcggagacgcaggcctggcccatttaccggcccaggcccgtttaccagcccatccgggcctgcaacggatacgagtacgaccgagccggcagtgaccaagacgagtgtggagccaagccgagcaaccaggacaagaaagatcttcttcgacggtgggttgttctgatttctgaatctctgcaactgcacggccgtcaagttgtgggggctgtgcaagaatggcggcgcgaccgtcgtggccatcgacggcctcctgcaggtcacgttcagttgcgtacttgcgtcaacaacctcctggtcaccggcgccggcaccctcgacgctggacgagagtacgagaccaactccctacccaggccacgacggtgagatcttagggtttgtttagttactgaagtttgaagttaaaagttcggaaaaaaaagttaaaagtttatgtgtgtagaaaa

SEQ ID NO: 6018 - DNA, 1172 bp, Oryza sativa
  Predicted polypeptide sequence is orthologous to G1181, G1850
ctctctggatcttcttctccgtctcctccccggtctcgtgtgagcgctactcccggcccacaggttcttcatggcgtcgccggcggcggggacgccgccgttcttgacgaagacgtacgcgatggtggaggacccgagcaccgatgagaccatctcgtggaacgactccggcacggccttcgtggtgtggcgccccgccgagttcgcccgcgacctcctccccaagcacttcaagcacagcaacttctcctccttcgtgcgccagctcaacacctacggattcaagaaggtggtggcggataggtgggagttcgccaacgactgcttcaggagaggggagaagcacctgctcggtgggatacagaggcggaaggggtctgggaccggaggcgcgggggcggcgccggcggggggcataccgacggcgataccgatctcgtccccgccgacgagctccggcggggagcccgcggtgtcgtcgtcgccgccgcgcggggcggcggggatcgcggcgggggtgagcggcgcggtggccgagctggaggaggagaacgcccggctgcggcgagagaacgcgaggctggcgcgggagctggcacgcgcgcggcgggtctgcgacggcgtgcggcgcctcgtgtcgcggtacgaccacgaccacggcggcggggaggaggaagcgggggagggcgacgtgaagccgatgctgttcggcgtggcgatcggcggcaaaagatcgcgcgaggagaacggggaagacgaggaggaggaggaggaggaaggggctgacgaggacggcgaagacgatgaggtggaggaagacgacgaggagagagagaggcacgcggcgcggcgggtccccgtgagggaggggaaggtcaggaggacgacggagctgtcggatctggacgtgctcgcgctgtccgtgcgggcggcggccgcggcgaggccgggcggggcctcccgtgaccgcaagagctcggtctcgtaacggttgttgacttgctgttgattttatatgcggcgtaaaactgagaaaattggatggcacatgagccaaattgaattgtagttcgtaccagtaccaagcaaactgcagccactttacagggtactaaactatactttcgggagtagtaggaacattgtagccttggttgtcatgatgatgtaaa

SEQ ID NO: 6019 - DNA, 2791 bp, Oryza sativa
  Predicted polypeptide sequence is orthologous to G1190
ggtggatgcagagtagctgggggcaaagaaaaaaaaacatttaattcttgcaatcctagctagtaatatatattcgagtcgaattgtttgtttgtttgtttgttgctaggtttgtctgggggtttggttagttataaaaagagagctagcaattctccacatttctctcccggttcctccgctgcaaccgttctcttgcttcaattctcgattcgccatgcatgcaagagtctgctgaacgccgattgattaattgtcttgtagtatctaggaaagtaatccgctgctgtatcctcctcctatctggattctggagtgatccctgcccgctggctccatcccgccgctgccgacacacataattaaacagctactagttgatcgatattatttcttctcttctcttggggtcatccctctcaaatcaagctctactactctacatactctctatcgggtgccggcactgcagtcccccaggtgagtgagtgagtgagtggagtgcggtggcagagagctagctaggcatgaagtacagcaaggaagcaaagcccgagagggcggcgggagggcggtcgagagccgtgccggtggcgctcctgttggtcgtgctctgcgccttctccttctacctcggcgggatctacagcaccggccgcagcttgctcgatgtcaatggcatcgtcgtcaagggggcctcttcttcctcctctgcctctgccgttgccattcaaaaggacaccaacaccaaagccgtcgtcgtcttcccagagtgccccgccgactaccaggactacactccctgcaccgatcccaagcgttggcgcaagtatggcaactaccggctgagcttcatggagcgtcactgcccaccggcggtggagcgcaaggagtgcctggtgccgccgccgcaggggtacaaggcgcccatccggtggcccaagagcaaggaccagtgctggtacaggaacgtcccctacgactggatcaacagccagaagtccaaccagcactggctccgcaaggaaggcgacaagttcatcttccccggcggcggcaccatgttccccaacggcgtcggagcctacgcagacctcatggcggagctcatcccgggcatgacggacggcacggtgcgcacggcgctggacacgggatgcggcgtagccagctggggaggcgacctgctggggcgcgggcggggcatcctgacgctgtcgctggcgcccagggacaaccacgaggcgcaggtgcagttcgcgctggagcggggcatcccggccatcctggggatcatctccacgcagcgcctgcccttcccgtccgcggcattcgacatggcgcactgctccaggtgcctcatcccgtggacagagttcggcggcctctacctgctggaggtgcaccgcgtgctccgccccgggggcttctgggcgctctccggcccgcccgtcaactacgagaaccgctggcacggctggaacaccaccgccgccgcgcagaaggccgacctcgaccgcctcaagaagacgctcgcctccatgtgcttcaagccctacagcaagaagggggacatcgccgtgtggcagaagtccaccgaccctgcctgctacgacaagctcacgccggtctcctcccctcccaagtgcgacgacagcgtcgacccggacgccgcctggtacgtgcccatgcgctcctgcctcacctcgccttcttccacttcctcgcgctacaagaagctggcgctcgacgccacccccaagtggccgcagcgcctcgccgtcgccccagagcgcatcgccaccgtccccgggagcagtgccgccgccttcaagcacgacgatggcaagtggaagctccggaccaagcactacaaggctctgctcccggcgctggggagcgacaagatcaggaacgtgatggacatgaacaccgtctacggaggcttcgccaccagcctcatcaaggaccccgtctgggtcatgaacgtcgtctcctcctacggacccaactccctcggcgtcgtcttcgacagaggcctcatcggcaccaaccacgactggtgtgaggcattctctacataccccaggacgtacgatctattgcatcttgatggcttgtttactgcagagtctcataggtgcgagatgaagtttgtacttcttgagatggaccgtatccttcgtcccactggttatgccataatccgcgagaacgcctactttctggattctgtagccaccattgccaaaggaatgagatggaactgtgacaagcatgacaccgaacacaaggcagacaaggagaaggtcctcatctgccagaaaaagctttggtcaggaaagaacacccagcattgaaaaaaaaaatcaataacttgatagcctcaccttgatcgaacctggagggatcacaatgtaaatctgctcaacgatttcaagacagtgctcaacctaaggcacttcaccctcccactagacttcacactctgatacaagaacgttcgtataatgattaaattaaataaaatgagcaatactccaatataggatccaatacttcctactctctgccagttatcacacaattattttttacagttactaggggaccaattaattaataccaccaagaggcagctgtaagttattacttttttttagaatggacaactgtaagttacttttatactactatatagaatgttcatttgtattagccatagcttgtttctacgattgtaacaataggaacggctatatatttattttaattgaatgtttacaggagc

SEQ ID NO: 6020 - DNA, 1831 bp, Oryza sativa
  Predicted polypeptide sequence is orthologous to G1202
gatagtactagctaaatgctcgtgcgttacaacagaattctaaaagagaacttcatttttctaaaaccattccccattgtcgactcacgagactatagatgcatcaataaaattttattggttagctcgcatgacaaaatgattcctaatcatgatcctaacttaaagttgctattaaattttctaatggattttttgcgatttcgatagcctggttttcttgaatggctgtgatgatttggctgccccctcgagatcatctggtatcttcttggttccttggtaatatgttcagctagctgtcatactaggtggccttgctccccagcaagttaccagttgcagctatttcttgtctgtacatgatgtaacgaatgattctactcatttgttcatgtacggagttacggagggagtactatcaacatgttgcccagaaccataggcatttgtaacaattgggaattgacagttgggctaatctgagccattcaagtatatttcctttgttttcaaccatgttttacctccttactttcttatggctgtgcttgtaatgatctgagtctggtattctggtattgtttctgtttggtgagaaattaatattactatacaaacaatttttttttagattcgttgatctcattttgacttccatttaggccactcagttgtcatttgcatgtcgccctgttcatatacagtagcatatgcgagatgttggaactctttcaagttttgcttttgctgaggcatttaactttttgccacttttaagatgtggcaattaagaatttgttactcacaatctatgacagacattgtggatccagtagcaaatccttaattgccacttgtaaatagttaaatatctcttcatttctatgtagtttattcattcctttttttcttaaggaatggaatgttgactatttattaacttagctgtagtgtgatcattattattgtcctttcatactttaaggatatactcctgttcatccatattttgatgtttgttacttctttagttcttgaatggctgtgatgatttggctaccccttgaagatgatttgacatcttctcgccgtttgttacttctttagttcttgaatggttgtgatgatttggctaccccttgaagatttgacatcttctcgttcttggccatgtacatcagtcttggatgtagaggccatgttttaatccattatctaaaataaatatcttgttggttcattagcagtatgttcagttagctgtcatactaggaggccttgctgcccagcaaggtaccagttgcaggcttgcagccatttcttgatagtacatgctaatctactcatttgttcatgtacagagagacggagggagtatttacattttgccggagccacaggcacattaaactgtttggaattggcaatcgggttaatctgagccattcaagtcatttcctttgttttcatccatgctttgccccaatggtatttgttctttacagttttaccagcaggcgccttaataagcacgaagtcttggcaaaatgtttgttggtaatggccccagggacgaacccatcgacttgtgtgaattgctttgcgaatcttcggcttcagcttattacggatgtaacttcaacatcatctgttagtccctcgttagctttggctaattgtttctttttctggggagggaattttgtggctaaatttggaggttttgctccatgatatgcaaccagttttctgacaaattgttgttgctaatgccacatgatgaaatcagcaggcattgccagtggtgcacgctggaatgaacggttgt

SEQ ID NO: 6021 - DNA, 1290 bp, Oryza sativa
  Predicted polypeptide sequence is orthologous to G1206
gataactacatatactgccctacattggataatggaaagccagaagatctcacacacttccagaagcattgggtgaaaggcgaacccgtaattgttcaacaggttctcaagaaaatgtcatgtttgagttgggagccaccagatatgtggtctaaagtacatggcaccggcactagtcctgagatgaaaaacgtgaaggctattgattgtttatcttgctgtgaggtcgagatatgcactcaagacttcttcaatgggtattatgaaggtcggatgtatcaaaatctatggcctgaaatgcttaaattgaaggactggcctacatcaaatcattttgaagagcttttgccttcccatggagttaaatacatgaattctttaccttttcaaccatacacaaacttgaagtctggtttgctgaatgtctcaaccttgcttcctgatgacatcttaaagcttgacatgggcccaaaatcatatatagcttatggctatgcacaggaacttggtagaggagattctgttacaaagcttcactgcgatttgtctgatgcagttaacgttttgatgcatactgctgaagttgacccttccgaggaacaaatagatgcaataaaaagtttgaaaagaagacatacagcgcaaaatgaaaaggagtgttctgggaatgcagacggaaattatacatctcctaaaatctgtggggatgcaaatgagttgtcctgtcctataaacagtgagaccaacaagggaggtgctttatgggatatttttaggagggaagatgttccaaaactgaaattgtatctcgacaagcattctaaggaatttcgccatatatactgttctgcagttcaaaaggtatgtaaccctgtacatgatgaaacattttatctaacagaagaacacaagagaaaactcaaggaggagcatggaattgagccttggacatttgtacaaaaacttggggaggcagtattcattcctgctgggtgtcctcatcaagtacggaatcttaagtcctgcaccaagattgccttggattttgtatcacccgagaatgttaaggagtgtctcagcttaaccgaggacttccgaagacttcctaagaaccacagggccaaagaagacaaattagagctaggtgtggttcaaaatggacccaagcccacataccctcgagaaactattctaaactctcaatgggacatcttgttgtttgcatatcatccaaatagttatgacaaagtttaagaagatagattaatatgtgataatcactcttcaaac

SEQ ID NO: 6022 - DNA, 650 bp, Oryza sativa
  misc_feature (1)..(1): n is a, c, g, or t
  misc_feature (9)..(100): n is a, c, g, or t
  misc_feature (240)..(240): n is a, c, g, or t
  misc_feature (249)..(249): n is a, c, g, or t
  misc_feature (389)..(389): n is a, c, g, or t
  misc_feature (410)..(410): n is a, c, g, or t
  misc_feature (421)..(421): n is a, c, g, or t
  misc_feature (423)..(423): n is a, c, g, or t
  misc_feature (431)..(432): n is a, c, g, or t
  misc_feature (584)..(584): n is a, c, g, or t
  misc_feature (634)..(634): n is a, c, g, or t
  misc_feature (637)..(637): n is a, c, g, or t
  Predicted polypeptide sequence is orthologous to G1206
nacattgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttattgcatctatttgttcctcggatgggtcaacttcagcagtatgcatcaaaacgttaactgcatcagacaaatcgcagtgaagctttgtaacagaatctcctctaccaagttcctggtgcatagccataangctatatantgatttgtgggccccatcgtcacagctcttaacgagtgtcatccacggaatgcaagggttgacgcacattcagccaaagccagaacattcgaaggtttggtgtactgggttgacaaagtgtaacagacattcagtggtantattaaagcgtccagtagggnacaggggcaananaggcgtcnnttcaacacagtggacttgtggactgtcagcgcccagataccttaccaatcttcaagccatttcgaggcccatagcatttgtgactaacatccgaacccttcagtaactacgcccattggacacgacagtccttggaggtgcgatatcgtcgnaccctcacgagcacagatacacacaatccaatacgccccttccacggtanttnttacactccctca

SEQ ID NO: 6023 - DNA, 700 bp, Oryza sativa
  Predicted polypeptide sequence is orthologous to G1225
gtgtcataaattctcctctgttacccatcgtacgtagaccaacatccccgggggtattttactatactagtagaggctattgcatgggtgatcactgatcagaattgcgtctcgctgctgctgctgttgatgctgctccatatctgccatggccgattgcttttgaccagagattccatggcggaaaggccattgcttcccttggccccttgggtggaggaagggtgcggcatggcgacggtggacgacatcgcagcggcggtgcaccacgtgctctgcatcatcgacgccgaggcggcgtcgcagatgctgctcgccggggaggcctccggttagcgtggccacctagcaagataggcgcgcggcggcggccggtgtaacaaatctgtaaagtgtagcggatctcgatcgatctctcccctcccgtaggcgagtcgggtgatttgggggtcggtggcgtagggcaaaagcccgtgtaagtgcaataacatgcggcccgttgtaatcctagccggttttttttttttttgccgtcgagtgtgtgcgttttgcggttttctcggcggaagtcgacgtggaatccgggggagtgagacggtgaagagagggtttttttatccttgcttgtccctccatgttgggccgactaggtacacagcctatgggcttgagattagcacatggtccggcccaattgaac

SEQ ID NO: 6024 - DNA, 449 bp, Oryza sativa
  Predicted polypeptide sequence is orthologous to G1229
gcggtgaagatcatcgccgccctggagggccgatcgctggagattcttcacgccaagatcagcaccgtcgatgacaccgccgtcaactccttcactgtcaagattggaattgagtgcgagctcagcgctgaagagttggtacaggtgattcagcaaacgttcacatgactcacgcatgtttcgaccgaccaactgttgaagctgaaattaattaagtatagcatgcagcagaaacagagcgaacagccaagggagcactagagtcgacaatacgtgttgggctctctgtgtacgagtgtgtctgcatttgcgagatgaaattcaatttagtttcaattcagatttgcctctagtgctcatcatgcacgtgctaattttgcatttatttttgtctttttgttaattctcgtgcaaattgatttttctacatatataggactatcggattc

SEQ ID NO: 6025 - DNA, 3749 bp, Oryza sativa
  Predicted polypeptide sequence is orthologous to G1242
atcgctcggtccttcgaacccccaccgcctccgtcgacacattccgcgctcgaatcgaatctacgaaaccctagcccgccaccgccgccccaatggcgaagccggtgaagtacgacgaggaggaggaggaggtctcgtcctccggcgaggaggaggaggagcagtcggacggcgccgggtccggatctggcgaggaggaggatgaggaggaggaggaggcgcccgcggcggcggccggcgaggcggctggtggggaagaggaggaggtggatgaggaggagatcgaagccgtcaccaccggtgccggcgccgacgaggaagaggaggaaagcggtgcggccgccgccgcccccggggagggcgatgaggagtcgcagtccactgaggacgacgaggccgtcgtgggggaggacgacgacgcagatgaggctgaaggaggtgcagtagtagggaaacgtgagaaagccaggctcaaggaaatgcagaaattgaagaagcagaaaatacaagaaatattggatacacagaatgctgcagttgatgctgacatgaacaataaagggaaaggacgattgaagtacctactgcagcaaactgaaatatttgcacattttgccaaagggaaccaatcaaaagagaagaaaccgcgtggaaggggacgccatgcctcaaagatgacagaagaggaggaagatgaagaataccttaaagaagaggaagatgcccttgctggttcagggggaacacgcttgctttcacagccttcatgtataaaggggaagatgcgagactaccaactagctgggcttaattggctcatacggttgtacgagaatggtatcaatggtatattggctgatgaaatgggtcttgggaaaactcttcaaactatttcgctgctgggctatctgcatgaattcaggggaataactggtccgcacatggttgttgcaccaaagtctactcttggcaactggataaaggaaattcaacggttttgccctattctacgtgctgtgaaattcttagggaatccagaagagaggaaccatataagggagaacctattgcagccaggaaaatttgatgtgtgtgtcactagttttgaaatggcaatcaaagaaaaaactacactgaagcgtttcagctggcgttacattattattgatgaagcacatcgcataaaaaatgagaattctcttctgtccaagacaatgaggatttataatactaattatcgtctccttatcacaggcacaccactccagaataatctccatgagctttggtctctcctcaacttcttgttgcctgaaatatttagctctgctgaaacatttgatgaatggtttcaaatttctggtgaaaatgatcagcaggaggttgttcaacagcttcataaggttcttcgcccatttcttcttcgaaggcttaaatctgatgttgaaaagggattaccccccaaaaaggaaactatccttaaggttggaatgtctcagatgcaaaagcagtactatcgtgccctgcttcagaaagatttggaggttattaatgctggtggtgaacgcaaaagattgcttaacatagccatgcagttgcgcaagtgctgcaaccatccatatttattccaaggagcagaacctggtccaccttacacaactggtgaacatctagttgagaatgctggaaaaatggttctgttagataaattgctgcccaaactgaaggatcgtgattctagggtgctcattttctcacagatgaccaggcttttggatatattggaagattatcttatgtacagaggctatcagtattgccggatagatggaaatactggtggagaagatcgtgatgcatccattgaagctttcaacaaaccaggcagtgaaaagtttgtttttttgctttcaaccagggctggtggccttggcatcaaccttgctactgctgatgttgtggttctttatgatagtgattggaatccacaagctgatctgcaagctcaagaccgtgcacataggataggtcagaagaaagaagttcaagttttccgattttgcactgagtataccatcgaggagaaagtgattgagagggcatacaagaagcttgcattggatgctttggtcattcaacaaggccgactggcagagcagaagactgtcaataaggatgatctgttgcaaatggtaagatttggtgcggaaatggtattcagttccaaggacagcacaattacagatgaggatattgaccgtatcatagctaaaggagaggaaacaacagctgagcttgatgcaaaaatgaaaaagttcacagaggatgctattaaatttaaaatggatgacactgcggaattgtatgattttgatgatgataaggaggaaaacaagcttgattttaagaaactggtcagtgataactggatagagccacctagaagagaaaggaagagaaactactctgagtctgaatactttaagcaagcacttcgccaaggtgcacctgcaaaacctagggaaccacgaattccaagaatgccgcacctacatgatttccagttcttcaacaaccaaaggctcaatgaattgtatgaaaaggaagtccggtaccttatgcaagcaaaccagaagaaagatactattgatggtgaagatgaagatcagctggagcctttgactgcggaggagcaggaagagaaagagcagttgttagaagagggttttgcaacatggacgaggagagacttcaacacatttattcgtgcatgtgagaagtatggtcgaaatgatattaggagtattgccgctgaaatggaggggaagacagaggaggaagttcaacgatatgctaaagttttcaaggagagatacaaggaactgagtgattatgatagaattatcaagaatattgaaaggggagaggccaggatatcacggaaggatgaaattatgagagccatcgggaagaagttagaccgctataagaatccatggttagagttgaaaatccagtatggacagaacaaagggaagttctataatgaggaatgcgaccgttttatgctttgcatggtgcataagcttggttatggaaactgggatgaactgaaagctgccttccgcatgtcgcctttgttccgatttgattggtttgtcaagtccagaaccacccaggagttggctaggagatgtgatacccttatccgtctagttgagaaagagaatcaggaatatgatgagcaagaaaggcaggcaaggaaggacaaaaggatggctaagaacatgacaccgacaaagcgatctgcgttaagggtttcagaaggtgaaactactccatcgaattctttcaagaggcgacgccagtcccttatggatgactatgtgggctcgggaaggcgtaagcgaggttgatcgggcgttgcctgctgctccctttcaagcttgtcggaagtctgggagagctttgaaatgtgcgcgctatgtgatgtttaaagcctctaggcgcacttaactcatcgctgaggcctaactcagtatgatagtgtagtggtatataatactatatgttttctctgcggggatttcatgaccgctctggctagcctatgcattaggaatcagatgtactatggattatccaactttggtagaggtgaactcatcgaagctacccttttaaatccctatgcttatgttacattggccaaaagtccgctcctaatccgagtattctatcttccgagt

SEQ ID NO: 6026 - DNA, 4000 bp, Oryza sativa
  Predicted polypeptide sequence is orthologous to G1242
ggatttctttcctcttccgtttcttcactagttcatttcacgccgcccccgcgcgagcggcgacaaggcgaaaccgcttcaatataagatcaccccaatcccccaattcggcaactccaatccaattcaattccccacccccgatccgcctctcgcaaatctcccgaaaccctagccgccaccgccgccgccgccgcctcgagcgaggcgtgatggggaagccggggaagtatggcgacggcgacgacgacgactcggaggaggagcagctctccccttcgtcttccgccggcgaggaggaggaggaggaggtagaagaggaagagggggaggagcagcaggaggagcagggggaggaggaggaggggtttagcggggacgaggaggagcaggaggtggagggtgaggcggatggggagcaagtggaggaggaggaagaggaggagtctagtgtcggggaggaggaagcagaggcggagggtgaggaggaggaagaggaggtggaggaggagcagggggctggggaagaggaagaggaggaggttgatgaggaggagatcgaggcggtcaccaccggcgccggaggggacgacgacgacgaagaagtgggcgatgacgggggcgcggaggaggagtcgcagtccacggaggacgacgaggtcgccgccgggaaggatggcggcggtgaagatggcgacaagttggaagatgctactggaaacgcagagatcgggaagcgggagcgagcaaagctcagggagatgcaaaagctgaagaagcacaaaatccaggaaatactggatgcccaaaataaggccattgatgctgacatgaacaacaaggggaagggacgtctgaagtatctcctgcagcaaactgaaatatttgctcattttgcgaaaggaaaccaatcgacagagaagaaatcacgtggaaggggacgtcatgcatcaaagatgacagaggaggaagaagatgaggagtatctcaaggaggaggaagatgcccttgatggtgcaggagggacccgtctggtttcacaaccatcatgcataaaaggaaagatgagagattaccaactagctggacttaattggctcatacgcttgtatgagaatggcatcaatggaatattggctgatgagatgggtcttggaaaaacccttcaaactatatcactgcttggatatttgcatgagtttagaggaataaccggtccccacatggttgttgcaccaaagtccactcttgggaactggatgaaggaaatacaacggttttgtcctgttctgcgtgctatcaagttcttaggaaaccccgaagaaaggaaccatatccgggaaaatttgttagtcccagggaagtttgacgtctgtgttactagttttgaaatggcaattaaagaaaaaactgcattgaagcgtttcagctggcgttatattattattgatgaagcccaccggataaaaaatgaaaattcccttctctctaagactatgaggatttacaatactaattatcgtctcctcattacgggcactccactacagaataatcttcatgaactttggtctcttctcaacttcttgttgcctgaaatatttagctctgctgagacttttgatgattggttccaaatctcaggggaaaatgatcaacatgaagttgttcagcagcttcataaggttcttcgtccatttctgcttcggaggcttaaatctgatgttgagaaaggtttaccaccaaaaaaggaaactatacttaaagttggaatgtctgagatgcaaaaacaatattatcgtgctctgcttcagaaagatctggaggttgtcaatgccggtggtgaacgcaaacgccttcttaacatagccatgcaattgcggaagtgctgcaaccatccatatttattccaaggtgctgagcctggtccaccctataccactggagaccatctaattgagaatgcaggaaaaatggttctgttagataaattacttcccaagctaaaggaacgtgattccagagtacttattttctcacagatgactaggctcttggacatcttggaagattatctgatgtacaaggggtatcaatattgccgaattgatgggaatactggtggtgaagatcgtgatgcttcgattgaagctttcaacaagccagggagtgaaaaatttgttttcttgctttcgactagggcaggtggtcttgggataaatcttgctactgctgatgttgttattctttatgacagtgactggaatcctcaagtggatctgcaagcgcaagatcgtgcacatagaattggtcaaaagaaagaagttcaagtttttcgtttctgcactgagtatacaattgaggaaaaggtgattgagagagcttataagaagcttgccctggatgctttggtcatacaacagggtcgattggcagagcagaaagctgtcaataaggatgagctattgcagatggtcagatttggtgctgaaatggtattcagctccaaggatagcacaataacagatgaagatattgaccgcatcatcgctaagggagaagaagcaacagcacaacttgatgcaaaaatgaagaagttcacagaagatgctattaagttcaaaatggatgacactgctgaactgtatgattttgatgatgataaggatgaaaacaaacttgattttaagaagttggtcactgacaactggatagagccaaccagcagaagagaaaggaagcgaaactactctgagtctgattatttcaagcaagcacttcgccaaggtgcaccagcaaaacctagggaaccgagaattcctcgaatgccacacttgcatgatttccagttcttcaacactcagagactcaatgaattatatgagaaggaagtcaaataccttgtgcaagcaaatcagaaaaaggatacggttggtgagggtgatgacgaagatcaactggaaccgttgactgtggaggagcaagaagagaaagagcagctattggaagagggcttttcgacatggacaaggagggacttcaatacattcatccgtgcttgtgagaagtacggtcgtaatgacataaagaacatatcctctgaaatggaggggaaaacagaagaggaggtgcagcggtacgctaaagttttccaggaaagatacaaggaattaaatgattatgaccgagttattaagaacattgagaaaggagaagcaaggatataccggaaggatgagattatgaaagctattgggaaaaagctagaccgctataagaacccttggttagagttgaaaattcagtatggccagaataaagggaagttatacaacgaagaatgtgatcgttttatgttatgcatggtgcacaaactcggatgcggaaactgggatgaactgaaagcagcctttcgcatgtcgcccttgttccgatttgattggtttgtgaagtctagaacaacccaagagctagctaggaggtgcgagaccctcattcgtctagtggagaaggagaaccaagaatatgatgagcgtgagagattggccaggaaagataagaagaatatgtcgccagcaaagcgttcttcatcaaggtcgctcgatacccctccacaaagctcttcgaagaggaggcgccagtcctacactgaagccaatgcaggctcgggaaggagaaggcgagggtgatctgattattgttcgttcctccccccatatgcatttagggagctcatttggaggttgacatgaaacccaaggggaaaccccagatacatcccaattgtctagcagtagctttagctcaaaaaaaaaaaaaaaaaactagcagacataactctagtgagatggttagcttgtataccggttaaagtggttgtgttttaaagttttaaattggacgggcaacattacaaattttaggtgatcataactataacaagtagttgatctctcttttggagacatcaatcaaataaaacaaagttgcttttacctgt

SEQ ID NO: 6027 - DNA, 641 bp, Oryza sativa
  Predicted polypeptide sequence is orthologous to G1246
gagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagaggtgagggtttcgtggtcaatcgtgagttcatcacacgatcgatgatgctggattcgattcgatggctcggaaattggaacggctcggggaaaaaataagggcgattaattagtggattattattgcgagagggtttgggatttgaggagggtaattgcgatgattgatgctgctgataatgctgctgctgctgctgctgctgatgatgatgatgatgacgatgatgatttgtaaattcttgatacttgtataagtaatgctgctctgctcctctcttgtttttttctccttgattcttgaaatgtttttctcctcctgatttccaaatcatgttggggattcctgatttcctgtttcatcttgattagtagtattatgctgtgattggggattagtgtgttttgccctgtgttaatcagggattatatgttctctctttttttttttttgcttgcgaagaattggagagaaaaaaatgtgaattctctcaaaataggtatt

SEQ ID NO: 6028 - DNA, 1928 bp, Oryza sativa
  misc_feature (769)..(771): n is a, c, g, or t
  misc_feature (779)..(779): n is a, c, g, or t
  misc_feature (790)..(790): n is a, c, g, or t
  Predicted polypeptide sequence is orthologous to G1246
gtctttctcctcctcgccagggaaaggcccccccgccgccgccgtcgtcgttccagctatagctttccccgccggcggtggcgatcgatcgatcctctcctcgtcggttgattagggtcaagaattcttccctctcccagcttggttgaatttcttggtttgatcaaggggaggaattaattgagaggtgaattagttcgccggagtttgtttctctctctctctcctcttctctgagctgagagggggaggagagaatcaagtgacgagttatagtatggcgaggagcggcggcggcaatggtgggggagaaggtggcggcggcggcggcaatggcggtggcgggggagggttgaagaaggggccgtggacgcaggcggaggacaagctgctggtggaccacgtgcggcggcacggcgaggggaactggaacgccgtgcggcgggagaccgggctgcagcgctgcggcaagagctgccgcctccggtgggccaaccacctccgccccgacctccgcaaggggcccttctcccccgacgaggagcgcctcatcctccgcctccatggcctcctcggcaacaagtgggctcgcatctcctcctacctgcatgggaggacggacaacgagatcaagaactactggaacacgcggctcaagcggcgggtgcgcgccggcttgacgccgtacccgccggagatcgagagggagatcgcgcacctccgcgcgcagaatctcaacctgtccgccgaaggcggcggcggcggcggnnntatgctgnctttcgcgttncttctttacccgagcatcccgttcgccttgcagcaggcgccggtggtggcgccgtcgccgtcggcgtcgcaggcgaattcgccgccgctgatcaaccagaattacccgctcctgaaccagatgcaggggctgcagcttctccacctcgccaaccaccagcaggcgccgccgccgcagcagcagcagcagcagcagccggcgttccaccaccaccacgacggcggcggcggcggcgggttcgtctcgtcggggctcccgccgctgccgaacagaccgcgcgagctcccttcgaaccaattcgagacggcgacgagcggcggcggcggcggctgcgacgcgctgctcgagtcgctgctgctcggcgacgaccacctcctgccgcggcccaaccccgccatgctcagggtgggctccatgcccgagctgatgtaccgcgagcctagctcaagccacgtgctccatggcggcggcggcggcggaggcgccagcgacagtgacgtcacctcgcagtatcctccgggagaagaggacccgcattatggcgggagatgggacttcatcttcgaggacgtgaaacccaagaggaaggcggcgagcgcggtggaggagatctccggcatgttcggcatcgccccgggctccatcccgggggaatggttcaaccccggcggcgtcggcagcgccgccgccgccgccggcgggtcgtcggctccgtctccggggccgtcgtccgtcgtcaccaccgacgacgacttcaccctcgagatgcagcagatcatgtcgtcgctgccgctgcttcaacctgaagagcatcataactggaacgcataaagctttggaacagcaagatgagagatgatttggtagtgagagagagagagagactgtaaatcggttctgatgagcagtgagaaaaaatgttggttcttgttttttgttgtttgtactgggccttattgtcggatctgtcacgcgctctgccttttgagttgcaaactgtttttcgttattgctatcaagtaattaaaagggtttctcgtagttgatagtccttgtctaaatcagtgaagagattcaagaaaattcagctgatatattggaaatccactccagcaactgtggagtatgttccttgtcc

SEQ ID NO: 6029 - DNA, 534 bp, Oryza sativa; identical to SEQ ID NO: 5112
  Predicted polypeptide sequence is orthologous to G1248

SEQ ID NO: 6030 - DNA, 828 bp, Oryza sativa
  Predicted polypeptide sequence is orthologous to G1255
gacaaagctgggtaccgggccccccctcgagtttttttttccttttttttttttttttttgattaccaataaagtttgtattttgcaatcctgaatacatacaataatttatccccctttcaaaatttaaagttgggagaaagtgaaagaacttctattcaactcaacaaacatatgagggcatcactgaatcaattagttgtatatattgattgattgatttacatgtatatctcctggcctcgaactgtacccgtgcaggacaaccaatggacatatatgcatacatatagcacagctacaggctactactgtcaaccaaccccctgaatctgaagggaggaaaaaaactttcaaaactttcagcaattgagcgcaggggtactgtatacctctcaacaaatagtacaattcactttttagtattatcattattattatagtaataattattattaaaagtccttggatccttagcaaccatcaatggtgaactgatggaaaaagaagacgcatgtgtgaccgtaaaagaaaccagctaaaactaatgcagtttcgacgagttgttttgttcttgtgtgatttcatggcgagcgcgcggccggcagatcaaacttccgccatgcagcgctacgcgacgcacgccgtggcgaccgcggcggtggcggcggcggcggcgctcttgacgaagcggcccttcatccgcggccgcttctcggcgttgagcttgcgcacctcgtaccggatcttcttggagaagagccgcgtccgccgcttctccctgtacctcgacacccgcgcctccctgccgccgtccatccccagcct

SEQ ID NO: 6031 - DNA, 1841 bp, Oryza sativa
  Predicted polypeptide sequence is orthologous to G1255
gacactactgttcccatttttttttgttaacggcgaaaagtgttgtgttgtttgggtaggcagggtgttcgacggaatggcgagcgccgccgcggcgacgggcgcggcgctgggggcgcgcacggcgcgggcgtgcgacgggtgcatgcggcggcgggcgcggtggcactgccccgcggacgacgcgttcctgtgccaggcgtgcgacgcgtccgtgcactcggcgaacccgctggcgcggcggcaccaccgcgtgcgcctcccgtcggcgtcctcctcgccggcatcctcccctcgctcggcggccgctccacgtgccggatcagacgaccccgacgcgccggcgtggctgcatgggctcaagcggcggccgcgcacgccccggaccaagcccgggggaggcggcaagcacgacgcctccgccgcgacggtggccgcggcggcggcgtcggcggtcccggacctcgaggcggaggagtccgggatcgtgggcgacaccgaccacgacgtcggggaagaggacgacgaggacctgctgtaccgcgtccccgtgttcgaccccatgctcgccgagctctacaaccccgtggcggccgacgacgaggagcagcagatcgagcagaagcctgctgcacgcgtcgtgccgttctcggagccgtcgccggagttcgcctccggctcggtggaggcggacggcctctccggcttcgacgtgccggacatggagctcgccagcttcgcggcggacatggagagcctcctcatgggagtcgacgaggggttcgacgatctgggcttcttggacgacgagaagcctcacgtgaaactggacctggacatggacatggacttcgcctccatctcgccggcgccggcgccggagcgggaggagaggaagaggaagcggccggagatgatactcaagctcgactacgagggcgtcatcgactcgtgggcccgcgacggagcctcgccgtggttccacggcgagcgccctcgcttcgatcccagcgagtcatggccggacttcccggcgggaagccggggagggctcggcgcggcggtgacggcggtgaccggcggcgagagggaggcgcgggtgtcgcggtacagggagaagcggcggacgcggctgttcgccaagaagatccggtacgaggtgcgcaagctcaacgccgagaagcggccgcggatgaagggccggttcgtcaagcgcgccgccgcgctgccgccgctcccgctgcccaggcaccagcatccgccgccgccgccgccgcgcgctctgccgccggtgccgatgatgctcgcgccgcgcggcgcgcacgggcgctaccgtttttgagagctaccgctctcgatcggcttccgatgcgcatgcgcgcgtcgtctagctacatgcatgcatgcatgctagcgatagccgtttgcgtgatccaacaataagtacaaaaatactactatatatatatacaaacatacaaactcgtcgaatcatcgatcgtagcatgttggtttcaggtttaattgtttgggggtagtgttagttttgagcagaattaatctttgtgaattagggcgccctaccactctactatacgtaccaaatgtaccatgcatgtgtgcactgaagcagccggcaggttgtgtacttgtgcacaatttcatgtgcaaattaagtaggtaagttatgtgtgtggtagctaggctaggatgtgtactttcttggttttctgtaagaaagatcctgctaattataaaggttgttgtagattttgatcccggatcaatgtatgtaaaggcctatatgtatatactggtatatatatacagtgtttaagatc

SEQ ID NO: 6032 - DNA, 1941 bp, Oryza sativa
  Predicted polypeptide sequence is orthologous to G1255
gagaggttttttgtggaatcatcttttgtgctgggagatttcttctgtttgttcttttgtttcgtcgtgacgcatgagctgcagctcggagaaggcggccggggccgtgggcggcaaggcggcgcgcgcgtgcgacagctgcctgcggcggcgggcgcggtggtactgcgcggcggatgacgccttcctgtgccaggggtgcgacacgtcggtgcactcggccaacccgctcgccaggcggcacgagcgcctgcgcctgcgcgtctcgtcgcccccgccgctgacggcgcgggcgtcggtggaggaggaggcggcggcggcggtggggacgacgacgacgacgacgtcgaagagagagggcggcgtcacgccggcatggtcgaagcgcaaggcgcgcacccggcgcccgcaggtcaagagcgtcgggcagctgctctcgaggcggctcgtcgtgccggagatggcggtggagtcgtcggacgaacggaaggccgacgaagacggagctcacgaggagctcgaggggcagttgctgtaccgcgttccggtctttgacccctccctcgccgagttctgctcgcgcccccgatcgatgacgcggcggccgcatcctcatcgtgcttcaaggaggacgccgccgacggcgccgtggaagacgcaaagtatccggcagctgcggcgtcgtcgcccgtgcagcagctcccggatagctttgtcaacttcgaaccgacggacgccgagctgagggagttcgccgccgacatggaagccctactcggacaaggcctggacgacagcaacgagctgcaggactcgttctacatggagaccctagggctaataacgccgccggtagaagaatccggccgggtgaagatggagctcgacggcggtgttgcctccaacagcagggtatctctcccatcatgccgcgctcatccgaagccggaggacgtcgaatccgccgacgtgctggacatcgatttcaactgcacctcgccggacgaacagaagtcgtcggcgagcaacggcgccgcagccgattcgcagttcttccacaggagcctggatctcaggctcaactacgaggcgatcatcgagagctggggcaactcgccgtggaccgacggccggccgccgcacggccagctcgacgacttctggcccaacgaccaccattactcggggttgtgggctgcgggagggggcgggcatggcgcggaggtggggatgatgacggtgaggccgcggatggacggcccggggcgggaggcgcgggtgacgaggtacagggagaagcggcgtacgcggctgttctccaagaagatacggtacgaggtgcggaagctgaacgccgagaaacggccgcggatgaagggccggttcgtcaagcgcccctccgccgccgccgccccgtgcgccgtcacctagacgtacgatcgcgcacggcccggcgcgcggcaccatgcgtacgtgtccggtgtcgagacttgcctgcgttcgatcgtatgcctcatggactcgattggcacaaaagttcacgcaaaatttgtcgaagctgcacgattcaagtagtataacgttgttcaattcaaaagtttttctcttccttttttttttcggttttgttggtgtttggctcggtgcttttggatctcttttatctctgttccatcgaccggagagaaagtaggcgattgtacttgtgtaaacattggtgttcatggttttgtagaaacactccataaaggaaacaaaatgacttgtatatgtaaactgggttgtgcctgcgccacacccatgtacattgagtaatcagtacatacttaattattttcttgcatgtagataactggacaagtatctgaaaacttaccgggacgatcaaaagtgttcatgataatcacattcataaaatcactgctgtaagcattgtccgct

SEQ ID NO: 6033 - DNA, 1294 bp, Oryza sativa
  Predicted polypeptide sequence is orthologous to G1267
attttccatcccctccatcatgagctccaattagccgcacaccgatcccctcctcttcttcccccccttctcctctctcctctttttttcctcatccgtgcgcgatactgcgcttagtttgtgggtggggggagtgatcatcaccaaagccacaaagggggcgcggagagatattatatattctttgggaaagcgttggattagtttttctcgctttgggctttttatccggagttggagtgtgtgtgcgccgggagtggtggtggtgatggcggccggagaggaggtgatggatcggtcgacgtcggccgaggacgggtactgcagcgccggcacggactcgccgcgggcggagtccgtcgacgagcaaggggccgccgaggagtcgtcgccccggggagggcagaagcgggagctcccctcgccgtcggcttcgccgtcgtccccgctgccacctgccgcgaagcgcagccggaggtcagtggagaagcgggtggtgtccgtgccgatcgcggagtgcggcgaccggccgaagggcgccggggaggggccgccgccgtcggactcgtgggcctggcgcaagtacggccagaagcccatcaagggctctccctacccaagggggtactacaggtgcagtagctccaaggggtgtccggcgaggaagcaggtggagcgcagccgcgccgaccccaccgtgctgctcgtcacctactccttcgacggcgccaaagcctgagccggtggctgacggacagcaccccgagccagcggagaacgaatcgtcggcgtcggcggagctggaggtaccggagccggagccggagcaggaatctgagccggttgtgaagcaggaggaggagcagaaggaggaacagaaggctgtggttgagccggcggcggtcacaaccacggtggcgccggcgccggcggtcgaggaggaggatgagaacttcgacttcggatggatcgaccagtaccacccgacgtggcaccggtcgtacgcgccgctgctgccgccggaggagtgggagcgcgagctgcaaggggacgacgcgctgttcgcggggctcggcgagctcccggagtgcgccgtcgtgttcggccgccggcgcgagctcggcctggcggccaccgcgccgtgctcctgatgatcacctcctcttttctttttcctccccttttacaatttccctttttttttttgcttttctttagttctccttggagtaatttggattggaggttagtacatagcttgggtgatcaatgggagtgagtggcttaactgttc

SEQ ID NO: 6034 - DNA, 1942 bp, Oryza sativa
  Predicted polypeptide sequence is orthologous to G1269
gtgtttcctcttcctctcgcatcctagcggcagcggcagcggcagcctcctcctcctccgccgccgccgctcctcttccctctcccaactcccgtacgggcgtacggccgcctcgtcgccggattttttttttcgttcccccggcgagcttgcactctcttttcttcgattctctttcggctttgcttcttcggtcgcttttttttttggctgttcctggtcgatcccggcgaaggaggtggtcgggaagcaagatttgaactactcctcctcatggcttccatgccgcagctggaggaaaaggattcatccgatttggcaatcaacaaaggcccgtcgctggatcttgtcaaatctcccttgatgatgaatgatgcatctgcaactgtaactgcaatgcagcccaacgaggggatggaggagttccctgtcaaggttcggaagccttacacgatcaccaagcagcgggagaagtggacggaagaagagcacgacaagttccttgaggcattgaagctgtatggtcgctcttggcgtcagatacaagagcacattggcacaaagactgctgtccaaattcggagccatgcccagaagtttttctcaaaggtggtgcgtgagcccggttccaataatgcgattgagatccctccacctaggccaaagagaaaaccacttcatccgtaccctcgaaagtgtgcgaattctggatcggacgcaaatccagcaacagcgcaattgaagcttgctcctggctcatcttcatctggctctgatcaagagaatggttctcctatatcggtgctatctgcgatgcagtcagatgcttttggatcgtcagtatccaatccatcaaccagatgtacctccccagcgtcatctgacgatggaaataacattcccacattcacgagtggggaagataataatgtgccttgtgaaccaacagtgatagatccgtcccagtcccacaaggaaatagaccaagatagaaaagacgtgaataatatgtctgaagaggattcttcagaagaagaggtgcaagaaacaagcttgaagctatttgggaggacagttgtcatcccagatccaaggaagagaagctcctcagatccgaagcatgaaagtgaggagcagatatcacagccttccaatgaagaaatgttgcaggcttcttcatcggttggggagattccagcggcatattgtgcaccaaatggttggtttatgtcatacaattctttcccattccaattcggtgaatcagcggcagatgctagaattccccctttacacgtgtggtggccttactacggttttgctcccattagccatcctagaggactaagcacagtgatgcagcagactgaaggtagtgacgagagtgacggtgtgaagagccactcatccgaatcaagttcggactccggggaaaatgtgcagatgaccgctccccagagctcgagaatagtggaatcacttggagcgatttacgtccgagactcaggttcaagttttgagctaaaaccgagcgcaaattcagcgtttgtaagagtgaagccaagcaacagcggagatgaaggggtaataaggggatttgtgccttataaaagatgcaaatttcaataacgcaggcaagcgggtattttcttgaaagctgctaatttaacagagaagagtaggagcacgaacgttgcttgcatcactgtatttttttttgtttgtttgcggggattggtggtgcattaatgaattgtttgctgcttgcaccttaaaaaggatagagatggtgtaagcagtttgttgctgtaagaatgttacatgtagactagtacttaaaattataggggatgccaatctctgccctgatgatgttgtaaaagcagtacgcaccatgttttacctctggttgaaagctaagctgttaatggaaattgatctc

SEQ ID NO: 6035 - DNA, 3047 bp, Oryza sativa
  Predicted polypeptide sequence is orthologous to G1272
ggtgtggagaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctccgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagaaaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttcc

SEQ ID NO: 6036 - DNA, 3385 bp, Oryza sativa
  Predicted polypeptide sequence is orthologous to G1272
gggtgagcatccgcatcctctttctgattcatctctctctctcccaccgggactacttttttctggaatttgcttgcgttcgtcaatcctagcttctcttctaaatcttggaagaagctcttctcttcttttcagcgccataaccttaatacaagtaacaatctgtttgttccccaaaaagtttgagggtttaactgaacccctatgtctcaagttggatccgctcctgtaacgtttcccccttaaaaattttttttgggggttcaactaaaccctaggtttattggtatctgctcatagaatggacgctcatgatggtgaggccgatgagttgccgccgcctcctcccgtacctgcaaatgtggtgcctattaaagctgatgacgttgagagcgaggtgccagcaaacaaaccagcaaaacctaagcggtttccaatggccaggcctggtttagggagaaaaggacagccaatccagctcttggcgaatcattacaaagtttctgtgaagagtagtgaagaatatttcttccactacaatgttattctgaagtatgaggatgatcgaccggttgatgggaaaggggtaggtcgaaaggtgattgataaactgcagcaaacctaccgttctgagctttcaagcaaggactttgcctatgatggtgaaaagagcctgtttacaattggtgctcttccacaagtaactaatgagttcacagtggtgttggaggatgtttcaactggaaagactgctgccaatggaagccctggaggtaatgacagccctggaggtagtgacaggaagagagttaggagaccataccagaccaagactttcaaagtggagctgtgctttgcagcaaagatccctatgaatgcaattgctcaggccataaaaggtcaagaatcagagaactcccaagaagctctcagagttcttgatataatattaaggcagcactctgctaaacagggctgccttttagtacgccagtcatttttccacaacaatcctaataactttgttgacctgggtggtggtgtgatgggctgtcgaggattccattcaagtttccgtggcacacagagtggactttctctgaatatcgatgtttcgacaactatgattgttaaacctggtcctgttatcgattttcttcttgccaaccagaaagttgatcaccctgacagaattgattggcaaaaggccaagcgtgctctcaagaacttgaggataagaaccacccctgtgaattcagaattcaagatcattggtttgagtgacagaaattgcaacgaacagatgttttcgttgaggcagaggaatgggaacaatggggatgttgatgaagttgaagttacagtctatgattactttgtgaaaaacaaaggcatagagctgcgctattctggcaatcttccttgcataaatgtggggaaaccaaagcgtccaacttattttccaatagagctatgctctcttattccactacaaagatacaccaaagctttgtcaacactgcaaaggtcctcccttgttgagaaatccagacagaagccccaggaaagaatgtcagtccttaatgatgcacttcgacatagtaattatgattctgatcccatgttgagggcatctggcatttcaattgcccaaaattttactcaagttgaaggaagggtcctgcaacccccaaagctgaaagctggcaatggtgaagatatattcccacgcaatggtcggtggaacttcaacaataagaaactgattcagacctgttctgtcgataagtgggcagtagttaatttctctgcacgctgtgatgtgcgaaatcttatccgggacctcataagaaatgcatctgcgaaggggattcaaatggccgaaccttttgttgtgtttgaagagagcccctcattgaggcgagcacctgtatcaagaagagtagatgatatgtttgaacagataaaatcgaaacttcctggagctccgaaattcctcttgtgccttcttcctgagaggaaaaattgtgaagtttatggtccttggaagaggaagtgtcttgctgaattcggtattgtcacacaatgccttgctccacaaagagtcaatgatcagtacctactcaatttgctattgaagataaatgccaagcttggtggaataaactcattgctgcaaattgaagcatccccttcaatacctcttgtatcgaagacacctaccatcatcttaggtatggatgtgtcacacggtcaaccaggacaatctgatagaccttccattgctgcggtggttagctctcgccaatggcctctcatctctaaatacagagcatcggtgcacactcagtcacctaagctagaaatgatgtcttccttgtttaagccacgaggaactgaagatgatggcctcattcgggaatcgctgattgacttctacactagttctggaaaacggaaaccggatcatgttatcgttttcagggatggagttagtgaaagccagtttactcaggtcattaacattgagcttgatcagatcattgaggcatgcaaatttctcgatgagaagtggtcaccaaagttcacagtgattgttgctcagaagaatcatcataccaaattttttcagtctggatctccagataatgttccgccaggtactgttgtggacaaacaagtgtgccatccaaggaattatgacttctacatgtgtgctcatgctggaatgattggaacgacgaggccaacacattatcatgttctgcacgatgagataggtttctcccctgatgatctgcaggagctagtgcactcactctcttatgtgtatcagagaagcacaacagccatatcagttgttgctccgatttgctatgcccatcttgctgctgctcaggtgggcacattcctcaagttcgaagatatgtcggacgcgtcgtccagccaaggaggtcatacgtctgtcggaagtgtaccggtgcctgagctgcctcgcctccatgagaaagtgaggagctccatgtttttctgctgatcgtgccgcctctcgatcaaatgctcgccgacgttgagaaatccggtgatcggcctgggggaactactagtacttttgcttctcataattaggaacatgtatggaacctatgtacctgcccttggcatgctgcctgtgtcatggattatctgctggtaggagtatcctttaaccaaacccttttagcttttaagttaggtttaatggactgctgtttagtatgtggtgtggtgttagtaagtttccagacttcgacattgtgcagctatgcctattgctggttatggtcccttcccttctatgtagcatgtgccgtttccctttgtctgagttgattttagaaatagt

SEQ ID NO: 6037 - DNA, 812 bp, Oryza sativa
  misc_feature (802)..(803): n is a, c, g, or t
  misc_feature (805)..(806): n is a, c, g, or t
  Predicted polypeptide sequence is orthologous to G1272
tttttttttttttttttttttttgcaaaagcattgctgaatcactgaaacatggtgaattctaacaagcaaggccttgcaacgagaggatcaagaacttactgcttaacagagtgctgcctgagcgtgatgtcaagaaccctatgagcctccatcgagttctctgtctcctgccctcttagcacctcggcaatggcgctcatgggaaccttcgccgcgaaggagatctccaccatgaacttcttcaccgccatcggctgcttcatcctcttcctgtcactccccctcgggcttccatcgtctcctccggggctccgcctcgtcgtcgtcctgcacacagcaaaaaaaccaaagaaatggtgctcaccaccttcacaattttttttagatactggaaaatggttacatctccgaactctgccaacagacgtcaccacctggacatagcaacagttacatatccatagtttacttgccttatcagccgcgaacaaaatttaatttatgaaacctaatttcccagctgacctcgaaggctcccccgccacagacaactacgggcgcactggccttttaaacgactatcaggactacccgaagatgtctaagtaagtcgagcgcagggccagaaacatcaagaagagggtccaacagacatggcgcctcgagcacccaggtagcgactacaggagaaaccggaacgagctgctgtgaacgacagccggcactccgtgggctcacgtcgtcacaactgtcctcactgcttcgctgcagtactatgaacgacgagaaagcaagaaaannannagttgg

SEQ ID NO: 6038 - DNA, 2670 bp, Oryza sativa
  Predicted polypeptide sequence is orthologous to G1272
atggctgccaaaattggtgaaattgtccaagtacataatgataatcctgtaaagagagtacctattgcacgacctagctttggccgtgaaggaaagcaaatcaagctgctctcaaaccacttcactgtgaagcttagtggaattgatgcggttttctaccaatacagtgtttccatcaaatctgaggatgataaggtgattgatggaaagggtattggccgaaaggtcatggataaagtgctgcaaacatacagctctgagcttgctgggaaggaatttgcgtatgatggtgaaaaatgtctatttactgtggggcctcttccacagaacaactttgagttcactgttatcttggaggaaacatcttcaagagctgctggtgggagtctagggcatggaagccctaatcaaggtgacaagaagcgatcaaagtgcacacatcttgcaaaaaaaattgtagtgggcataagttatgcagcaaagattcccctgaagtcagtagctttggcccttcaaggaagcgagtcagatcatgctcaggatgctctgagagtccttgatattgtcttaaggcaacaacaggctaagcgaggttgcctgcttgttaggcaatcatttttcagtgatgactttagaaacttagttgatttaactggtggagttagtggatgtcgtggactccactcgagtttccgtactaccattggtggtttatctttgaacatggatgtttcaaccactatgattgtgactcctggaccggtttttgatttcctccttacaaatcaaaatgtcagagacattagagatatcgactggcccagggccaagaaaatgttgaaaaacctgagagttaaagctattcacaataacatggagttcaagatcattggtctgagtgatgagccatgctctagacaaacattccccatgaaagtacgaaatggaagcagtgaaggtgaaaccgttgaaattactgtccaggaatattttaagtccaagcaggtggatttaacaatgccttatttgccatgtcttgatgtgggaaaaccaaaacgcccaaattatgttccaattgaggttgctggcaccaatcctctgtgccatatggtatcacttcaaagatatacaaaggcgctttcttctcaacaaagagcaaccttggttgaaaaatcacgtcagaaacctcaagagcgcatgcgagttgttactgatgctgtaaaaaacaatagatatgatgatgatccaatcttatcttcttgtggaattaaaattgagaaacaactcactcgtgtcgatggtcgtgttctgtctgcaccaacgctagtcgtggggaatagtgaagattgcattccaaacagaggcagatggaactacaataacaagaggctatttgagcctgtcaagattgagcgttgggcaattgttaatttctctgctcggtgtgacatgagccggatctcaagagacctgataaactgtggacgaactaaaggcattattattgaacgccctttcaccttggtagatgaggatagccaatctaggagatgtactcctgttgtaagggttgaaagcatgtttgaaaaagtgaaagcaaaccttcctggtcctcctgaatttttgctgtgtgttttaccagaaaggaaaaattgtgatctctatgggccatggaagaagaaaaaccttcatgagatgggtattattactcaatgcattgttcctagtgttaagatgaatgatcagtactataccaatgttcttctgaaaatcaatgctaagcttggtggaatgaactccaagctttcattggagcatcgacatatgattcccattgtcaatcaaacacccacattaattttgggaatggatgtttcacatggttcgccaggtcgagctgatgtaccatcaattgctgcggttgttgggtccagatgttggccgctgatatcacgctacagagcatctgtccggacccagtctccaaaggtagagatgattgattctctttttaagccactggacgatggaaaagatgatggcataataagggaacttctactggacttctacaagaccagtcaacaaagaaagccgaagcagataatcattttcagggatggtgtgagcgagtctcaatttagccaagtactgaatgttgagcttaatcaaattataaaggcatatcaatatatggatcaggggccaattcctaagttcacagtgatcattgctcaaaagaatcaccacacaaaacttttccaagaaaatactccagacaacgttcctccagggactgttgtagattctggtattgttcatccaagacagtatgatttctacatgtatgctcatgctggacctataggtacctcaaggcccacccattaccatgtcttgctcgatgagattggtttcttgcccgatgacgtgcagaaactagttttgtcgctttcttatgtgtatcagaggagcaccactgcaatatctgttgtggcacctatctgttatgctcatctcgcagcagcgcagatgggccagttcatgaaattcgaggaattcgctgagacttcgtctggaagtggtggtgtcccttcgtcatcaggagcagtggtcccagagttgccgcgcctgcatgctgatgtctgcagttcgatgttcttttgttga

SEQ ID NO: 6039 - DNA, 612 bp, Oryza sativa
  Predicted polypeptide sequence is orthologous to G1273
atggaggaggatgatgggttggccttgatgacgggggcaaaccagagcttatggagttactacaagtgcaccagctcccgatgcagcgccaagaagcacgtcgagaagtccaccgatgacccggagatgctcatcgtcacgtacgaggggtcgcaccatcacggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtag

SEQ ID NO: 6040 - DNA, 2449 bp, Oryza sativa
  Predicted polypeptide sequence is orthologous to G1289
cttctgcaactctctgcactgtccccgcttccttccacggccacggcggcggccatcgccgccgtcggcgatctcgccctgctccatcccgctctcccgtttccaatcccccaaccggagcagaaatggccatctcctccgccctctccttcctctcctatcgcaagcgccctatcgttgtttccgtcttcctcttcctcctcctctcatccctcttcctcctcttcagccccgcacctgccgcgctccctttcttctccttcccctcctctcacctctcctcctcctcctcctctcctatcgccgccacgccgccacccctgactccagtttccgtccccgccaacgcatcttcaccggagaccccagttgacgcgtccggtgggagcaacgctggcgccaccgcacccaccagggacgctcctcagccagatcgcagtcggagcacgccccctgccgccgtcggagtgcgtggatcggcgggcaccaacggaaccagcaggggcgtctcggccggcggcgatggagcaggagcagcagcggcggcggcggcaggtgtggcggtgccgtcgtgggaggtgtgcgaggtggggaagggagtggtggccgcggactacataccgtgcctggacaacgtgaaggcggtgaaggcgttgaagtcgctgcgtcacatggagcaccgggagcgccactgcccgacggcgccgaggccgaggtgcctcgtgccgctgcccacggggtaccggtcacccttgccgtggccgcgcagccgtgacatgatttggtacaataatgtccctcatccaaagttagtggaatacaagaaggaccagaactgggttaggaagtctggcaattattttgttttccctggaggtggaactcaatttaaagctggtgtgactaaatacattcgatttattcaacagatcatgccaaacattgaatgggggacccatacaagaactgttctggatgttggatgcggtgttgccagctttggtggatacttgcttgacaggaatgtcattactatgtctgttgcacccaaagatgagcatgaagctcagatacagtttgctctcgaacgtggaattccagcattgttggcagtgattggaacacaaaaacttccattccctgataattcatttgatgtgatccattgtgcaaggtgtagggtccactggtatgctgatggtggaaaaccattattagagcttaatagagtgctcaggcctggaggatactacatctggtctgcaactcctgtatatcgtcgtggcaaaagagatgaagacgactggaatgcgatggttactctgaccaagtcaatttgctggaggacagtagtaaaatctaaggatgttaataggattggtgttgttatatatcagaagccaacctcaaattcttgctactttgagagaaaacagaatgaaccacccctatgccctagtagggaaggatcacattccccttggtatgcaccacttgatagttgcctcttgttacctgctgtgtcaagttcaggtgaaggaaacagctggcccatttcctggccagaaaggcttaacatcaaatactcaactatatctgacaacgcttctactcagttttctcaagaaaaatttgattctgacacaaagcactggaaggaccttgtttcagaagtatatttcaatgagtttgcagttaattggtctaccgttcgcaatgtcatggatatgaatgctggttttggaggatttgcggcgtcactcatccacaaacctttgtgggttatgaacgttgtaccttttgatcatccagaagccttgcctatcattttcaacagaggtttgattggggtatatcatgactggtgtgaatcttttaatacatatccccggacctatgatcttgttcacatgagttatctccttcagggcctcacaaataggtgtgatatcattgaagtagcagcagaaattgataggatacttagacctggaaaatggttcgtgttgcaagatactgagcaagtgattagaaaaatggatccagttcttcgctctttgcactacaggactgcaattgtgaagcaacaatttcttgtcgctacaaagggcttctggcgcccatacagtgcaggttctgagtcaagatgattcatgcttcgtcttctgttgctgttagtaaaaatcaaacaactgatttgattctttaaattctaattacatggattcttcgcatagcatagatgacacaaattagccccatatcaacggtgagttcattccctctgtttgtagttagcagtccatattaaccatcgggcttactgagttgattcttttgtttccgttttgttgtgtacaaattaaagaacttatggctacagcaatagccaataggttagcaataacagattgtggattttgaaagcatgtcttgattattcattggt

SEQ ID NO: 6041 - DNA, 2930 bp, Oryza sativa
  Predicted polypeptide sequence is orthologous to G1289
gatataccaaaatcgaaggggaagaaggctcatcaccaccgtcgaaaacgacctgcacccaccgccaccgccaccgccgccgccgccgccggccggccaaggccaaccacgcaacccgccgtggccgcgacgctccacttcccccctgactccgtcctcccacccgcccaaccaaccgaccgaccaaccgagtgaacaagtgaccaaccaccaccaccaccaccatcgccaccaccgtcttcgatctctctccgcctctccggcatctcttcacggcggcggaggaggagggagcagcgacgatggccgtgcccacctccgaccagcgcaagcggcggcccttcctcctctcgctgtcgctcttcctcctcgtctccgcgctcctcgccctcgccttcctcttcctcgacccctccgcgcaatccctctccgtcctctcctcccgcctcaccgcccctactacgacgctcgcgcctcccgcggtcgtcgccggcggcgccgaagccggggagagcgccgacgcaaccgaaaaagccgaagagaccgcatcgcgaccagacgacaccgccgccgccgtcaacgccgacgctgcagcaggggaaggtggtggaagtagcgagtcgccacggctcgatgcggataagggcgccgccgccacggagggagtggcggatgacgacggcggcggtggcggggacgagccggcggcgaaggtgaggtgggagacttgcaggccggggagaggggtgtcgtcggcggactacatcccgtgcctcgacaacatgagggcgatcaaggcgctgcgctcgaggcgccacatggagcaccgggagcgccactgccccgtggcgccgcggcccaggtgcctggtgcgggtgccctccgggtaccggtcgcccgtgccgtggccgcgcagccgtgacatggaagctactgtcgtgaggcagaatagagaatgccagataagagctgtaatgttgggtgtcaagcagattgtgcttagtgatcctttaatgtggctaaatttccttttgtgcatatactattttaaccactagtatcgttttataggctttcaactttcaaggcagtgagtgcagtgtgtgtatttatgatagttacatgaatatcttatggttaagatgccattaactgactatttgaagccatctcatttcatttccaaatccagatttggtacaacaatgttcctcaccctaaattggtggagtataagaaggaccaaaactgggtaacaaaatctggtgactatcttgtcttccctggaggtggaactcaattcaaaactggcgttacaagatacattcagtttattgaacagactttgagggggctaaacacaaaggctatgcttgcattgactctgttggggttcggtaatttgaatataatgcccaccattcaatggggaacacacacaaaaactgtcctggatgttggatgtggtgttgccagctttggtggatacttgcttgacaggaacgtcattaccatgtcatttgccccaaaggatgagcatgaagctcagatacagtttgcattagaacgtggtattccagcatttctagctgttattggaacacaaaaacttcctttccctgatgaggcatttgatgttgtccactgtgcaaggtgcagggtccattggtatgcgaatggtggaaaaccattgttggagcttaacagagttctcaggcctggaggatattacatttggtctgcaacccctgtctaccgtcaagaaaaaagagatcaagatgactggaatgcaatggttaaacttaccaaatcaatctgttggagaacagtggtaaaatctgaagatagtaatggaattggtgttgtcgtatatcaaaaaccagcatcaaactcttgctacctggagagaaggacaaatgaaccccctatgtgttctaagaaagatgggccccgttttccttggtacgctcctcttgatacatgcatttccagttcaattgaaaagagcagctggccccttccttggcctgaaagacttaatgccagatatctaaatgtgcctgatgattcttcaagtaccgacgagaagtttgatgttgatacgaagtattggaaacatgccatttcagaaatatactataatgattttccagttaattggtcatccacccgcaatgtaatggacatgaatgctggttatggaggttttgcagcagcacttgttgataaaccattatgggtaatgaatgttgttccggtcggtcagcccgatactttgccagttattttcaacagaggccttattggggtatatcatgattggtgtgaatctttcaacacgtacccacggacctatgatctccttcacatgagctatcttcttggaagtcttacaaataggtgtgacatcatggaggtagcagctgaaatagacaggatattgagacctgacagatggtttgtgttgagagacaccacagaaatgataaaaaagatgcggccagttctcaagtccctgcactacgaaactgtagttgtcaaacagcaatttcttgttgctaaaaagggtttctggcgttctggcaagtgagcctcctgatcagaatgacgctcaaatgttttcagggtagtcatcaacagcaaacaattcaattgattctttacatccctattgattagttcttatacagaagacagagtttgatcaaaccaaggattaggcatgttgattctacaaaatacttatacagaacagttagttcgacaaaaatacatatacacatcttgtttatggggggccattacagtaataggcttaggctagtccactagtgctcacaagtttgtaatcatattattattcttttacattcagaaacagatacttttcagggaaacattatgctctttcacgaatacatcctctgtcc

SEQ ID NO: 6042 - DNA, 1914 bp, Oryza sativa
  Predicted polypeptide sequence is orthologous to G1289
atggccatctcctccgccctctccttcctctccgatcgcaagcgccctatcgttgtttccgtcttcctcttcctcctcctctcatccctcttcctcctcttcagccccgcacctgccgcgctccctttcttctccttcccctcctctcacctctcctcctcctcctcctctcctatcgccgccacgccgccacccctgactccagtttccgtccccgccaacgcatcttcaccggagaccccagttgacgcgtccggtgggagcaacgctggcgccaccgcacccaccagggacgctcctcagccagatcgcagtcggagcacgccccctgccgccgtcggagtgcgtggatcggcgggcaccaacggaaccagcaggggcgtctcggccggcggcgatggagcaggagcagcagcggcggcggcggcaggtgtggcggtgccgtcgtgggaggtgtgcgaggtggggaagggagtggtggccgcggactacataccgtgcctggacaacgtgaaggcggtgaaggcgttgaagtcgctgcgtcacatggagcaccgggagcgccactgcccgacggcgccgaggccgaggtgcctcgtgccgctgcccacggggtaccggtcacccttgccgtggccgcgcagccgtgacatgatttggtacaataatgtccctcatccaaagttagtggaatacaagaaggaccagaactgggttaggaagtctggcaattattttgttttccctggaggtggaactcaatttaaagctggtgtgactaaatacattcgatttattcaacagatcatgccaaacattgaatgggggacccatacaagaactgttctggatgttggatgcggtgttgccagctttggtggatacttgcttgacaggaatgtcattactatgtctgttgcacccaaagatgagcatgaagctcagatacagtttgctctcgaacgtggaaaaccattattagagcttaatagagtgctcaggcctggaggatactacatctggtctgcaactcctgtatatcgtcgtggcaaaagagatgaagacgactggaatgcgatggttactctgaccaagtcaatttgctggaggacagtagtaaaatctaaggatgttaataggattggtgttgttatatatcagaagccaacctcaaattcttgctactttgagagaaaacagaatgaaccacccctatgccctagtagggaaggatcacattccccttggtatgcaccacttgatagttgcctcttgttacctgctgtgtcaagttcaggtgaaggaaacagctggcccatttcctggccagaaaggcttaacatcaaatactcaactatatctgacaacgcttctactcagttttctcaagaaaaatttgattctgacacaaagcactggaaggaccttgtttcagaagtatatttcaatgagtttgcagttaattggtctaccgttcgcaatgtcatggatatgaatgctggttttggaggatttgcggcgtcactcatccacaaacctttgtgggttatgaacgttgtaccttttgatcatccagaagccttgcctatcattttcaacagaggtttgattggggtatatcatgactggtgtgaatcttttaatacatatccccggacctatgatcttgttcacatgagttatctccttcagggcctcacaaataggtgtgatatcattgaagtagcagcagaaattgataggatacttagacctggaaaatggttcgtgttgcaagatactgagcaagtgattagaaaaatggatccagttcttcgctctttgcactacaggactgcaattgtgaagcaacaatttcttgtcgctacaaagggcttctggcgcccatacagtgcaggttctgagtcaagatga

SEQ ID NO: 6043 - DNA, 496 bp, Oryza sativa
  Predicted polypeptide sequence is orthologous to G1290
ccagcgcctcatcttcgccaacaccgctgcagcagggagactgtaggccttgaggtgctaatatctgtcaggcctatccaggaggtagccagccggcggcaacggctgttccacgccgacatgtgatgtgtgcaattatgtctgtagacactaagtaatgtttatcgtcgatgacttatatgtaccgtggcttatctgtatgagacactttgtaatgcttgctatatactccctccattttaaaatgtttgacacggttgactttttagtatatgtttgaccattcgtcttattaaaaaaatttaagtaattatttatttttttcatatcatttgattcactgttaaatatattttcatgtacatatagttttacatattttacaaatatttttgaataagacgaacggttaaacatgtgctaaaaagtcaacggtgtcaaacattttgaaacggaggaagtatgtggcttgtgctagttgtgcaaattctgtcca

SEQ ID NO: 6044 - DNA, 954 bp, Oryza sativa
  Predicted polypeptide sequence is orthologous to G1304
atggggagactgaggccgccgtgctgcgacgagagcagcgtgaagaaggggccgtggacgcgggaggaggacgagaagctcgtcgcctacgtcgaccagcacggcggccatggcagctggaggtctctccccaagcgagccgggctcaacaggtgctgcaagagctgccgtctgcgatggattaactatctcaggcctgacatcaagagaggcaacttcactcctgaggaagaacaggccatcattaccctccactccgtcctcggcaataagtggtcgaccatcgcgacacgccttcctgggcgcacggacaacgagatcaagaactactggaacacgcgcctcaagaagaggctcatcggcgccggcatcgacccggccacgcaccgcgcgcggccgcggccgccggcgcctggggacctcgccaccgcgctcccgcagctggtggcgctcgccagcctggccgtcgacctcgccgtcggccacgccgccgcagccggcggtgcgtggggcgccgccaacggcgccgtcgactaccagcaggccgacgcggcggcggcgcagctgcagtgcctccagcacctcctcctccagccacagacgacgccggccacctcggcgacgagcggcggcggcggccacccgaccgagctgaacgcggcgagcagcttcctgacccaagccgtcgcgtcctacgccgccgccgccgcgactcctctcccttctctcgtggtacccggtggtagccagcctctcgagctgaaacggtggcaagatcacatcggcggcgaccatgttggcgccgtgtcgcccttcgccggcgcggcgacggtgaccggccaccacggaggcggcggcggcggcggcggcgagtttctgccctcggagctgacggcgttgctgtgcagtgcgaacgccatcgatgatttgcaatccagtaatctagatttctga

SEQ ID NO: 6045 - DNA, 435 bp, Oryza sativa
  Predicted polypeptide sequence is orthologous to G1309
taaccgcagccaaggtggctggagctatttgccagaccgctctctacgactatcgactcccggttgatgccaagacacacttcggtcctccattgaccagcgtcgagctatatctcaaggacgccggcgctcacaagactactgatgagaaaatcgaaggccatattgtcgtgagaggaccttccgtggctggaggagaagtcaatgttgggattcccggaaaaattcgacatgacaatacccttgcttatgcttgatttcgtagagctacgtgcggaatagggtggtgatgccatcggagatggagacagcaagatatacagattgatcgaacttggcctctcggtccatagattattctatctagcatttatgatcttttcatggttctctcgaaaccgagagagtacgatatacaaaagtatggcattccct

SEQ ID NO: 6046 - DNA, 1640 bp, Oryza sativa
  Predicted polypeptide sequence is orthologous to G1313
gttgccgcacatatactcgtgctcgcgctcacgccgccgcccccgaaactccccgctccgccattgccgggggaggcgatctcccatctccatctcccatctcgcctcagcgaactccccttcacatcgcgtctcttccgtcgcagagagtggcggccggtgaccatttccggtgggagggcggaggttttgtcccggctccggcgacactccacactccgacagcccaccgctccgtcaccctgcatttttggtcaggatgcacgagagcgacagcagtcctgattctgacaggacacactggtatatgagcaatagcgatgacgagtcatttgttgataaagataaagattgcagaaggagcaccgtagccctgctgttgaagaaaggtccatggacatcttgggaggactccatcttagagaagtacatcaagaagcatggtgaaaggaactggaagcttgtgcagaagaacactggcctcttgaggtgtggcaagagttgccgtcttcggtggatgaaccatctgaggcctaacctaaagaagggggctttcagcaaggaagaagagaataaaattattaatcttcatcgcaaaatggggaataagtggtctcggatggctgctgatttgccagggcgtactgataatgaaataaagaactactggaacactcgaataaagaaatgcaagaacaatcgttcgcctttgtatcctgctaatgtatgcaacgatgctttgaatgaagatcaacatgagtctgctgaccccaacgttagggagaagctgaccaataatcatctagaagatactactagtatgtattctgcacccccaggttttcaggatgcttccatcagtaatatacttgataggagacttgcatcaaaagattatgactccatagaagatcaaagaaaccaaatagaagttgtagcaaaatatgagattccacttcctgtgttgaaaacaacgaacaatgacatatttccatcagcctctatctttgccaaccatggtatttcaaatggcaatctctctgctttgtccacaactgatgctttgcagatggagctccctttaatccaatttgatccaaacaaccagttcgtttactcaagggcttatgcgatgcacctaacaaactttgctttattaaatgatcaatcagaagaattactaaatgatactgatgtattgaactatgtggtgatgaaagaagagctttctggagggagtttgagtcctactattaatatgccatgtgaagcacataactccatggctgcctctaatgagctggtagtgccacaatatgaaggagatgctccacctcttcaagatgatttcacatcatatttctatttgaatgatactaatctatccatattcgaagacacaaatgaattgtttttggaaaacaagttggatactaaaggtaactgacgccagattgtcatgagttgctgctctcttggataaactcatcatgaaaccaagaattttattccatgaagctcgtgaacgagccagtcgttgctatctctcttattaggatttccagtttggatattgccgtactcctttacttttcttcatgtcgaaattaccatgcgtgctatgttgaatttcatctgct

SEQ ID NO: 6047 - DNA, 2412 bp, Oryza sativa
  Predicted polypeptide sequence is orthologous to G1313
atcctgcagactcgccccactctcttgctcagctcctcttcatccagtcctcaaaactctctctgatctctctctcttgctgaaaattctccgcacactccggtgggcttaagcggtggcggcgtctcgcctgggtgggcgagatccctctcttgctcgtccgcaaggtcgctccccctgcgagtccaatctactgacgagctgggaggagcaaaggagggggcaattggagctccgctcggttccaattcagccccaattttgagccccccggctgcggggttcggccagttgagacgccatgtatcgggtgaagagcgagagcgactgcgatatgatccatcaggagcagatggactcgccggtggccgacgacggcagcagcggggggtcgccgcaccgcggcggcgggcccccgctgaagaaggggccatggacgtcggcggaggacgccatcctggtggactacgtgaagaagcacggcgaggggaactggaacgcggtgcagaagaacaccgggctgttccggtgcggcaagagctgccgcctccggtgggcgaaccacctgaggcccaacctcaagaagggggccttcaccgccgaggaggagaggctcatcatccagctccactccaagatggggaacaagtgggctcggatggccgctcatttgccagggcgcactgataatgaaataaagaattactggaatactcgaataaagagatgccagcgagctggcctacccatctatcctaccagcgtatgcaatcaatcctcaaatgaagatcagcagtgctccagtgattttgactgtggcgagaatttgtcaaacgatcttctgaatgcaaatggtctttacctaccagattttacctgtgacaatttcattgctaattcagaggctttaccttatgcaccacatctttcagccgtttctataagcaatctccttggccagagctttgcatcaaaaagctgtagcttcatggatcaggtaaaccagacagggatgctaaaacagtctgatggtgtgcttcctggattgagcgataccatcaacggtgtgatttcctcggtggatcaattctcaaatgactctgagaagctcaagcaggctgtgggttttgactatctccatgaagccaactctaccagcaagattattgcacctttcgggggtgcacttaatggcagccatgcctttttaaatggcaatttctctgcttctaggcccacaagtggtcctttgaagatggagctcccttcactccaagatactgaatctgatccaaacagctggctcaagtacactgtagctcctgcgttgcagcctactgagttagttgatccctacctgcagtctccagcagcaaccccttcagtgaaatcagagtgcgcgtcgccaaggaatagtggccttttggaagagttgattcatgaagctcagaccctaagatccgggaagaaccaacagacatctgtgataagttctagttcttctgtcggtacgccatgtaatactacggttcttagcccagagtttgatatgtgtcaggaatactgggaagaacaacatcctggtccattcctcaatgactgtgctcctttcagtggcaattcattcactgaatccacccctcctgttagcgctgcatcgcctgacatctttcagctctccaaagtttccccaggttggactctgaaattcctcatccctctttgatgtgattattcggttatttatgatgtactgttttgcagcacaaagcacttcaatgggatctggagagcaagtaatggggcctaaatatgaacctggggacacttcacctcatcctgaaaacttcaggccagatgcattgttttctgggaatacagctgatccatcagttttcaacaatgccatagcaatgcttctgggcaatgacttgagtatcgattgcagacctgttcttggcgacggtatcatgttcaattcttcctcgtggagcaacatgccacacgcctgtgaaatgtcagaattcaaatgaattctgtatttggtatttgccagacgctacagcagattcttggtatcgttcttgctcattgtttggatcataacttgaggaagatctcgtcggttgtaattctgcattgctgacagagtccttgatggcatgcaggcactatcagatgttctcttatgcgactagcccttttgtccaataaagtagtgcatggagataagccggttaattattgttttcttttttgtattagagaaccctttttgtcatctctattgcccgaattctgttggaaattcgtcatgtttgtttgaacaatgtaagaccaattattgcatttgtggtgtactatcttgttgagcatttaccacttgccaatcaatagcaatttgttactact

SEQ ID NO: 6048 - DNA, 1355 bp, Oryza sativa
  Predicted polypeptide sequence is orthologous to G1317
tccgtctcctgctcccgccgctcttcacacggctaacgcctgcttggctgcgagacaaaccgaaccttttgctcttgcaccgcctgctagcgaactacgtgtgctcccgtgatcgatggggcgggcgccgtgctgcgagaagagcgggctgaagaaggggccgtggacgcccgaggaggacgagaagctcatcgcctacatcaaggagcacggccagggcaactggcgcacgctccccaagaatgccgggctctcgaggtgcgggaagagctgccggctgcggtggacgaactaccttaggccggacatcaagcgtggtcgcttctccttcgaggaggaggaggccatcatccagctccacagcatcctcggcaacaagtggtcagcgatcgcggcgcggctgccgggccggacggacaacgagatcaagaactactggaacacgcacatccgcaagcgcctcctccgcatgggcatagaccccgtgacccacgcgccgcgtctcgacctcctcgatctcacctccctcctcaagcccgccgccgccgccgcgtactaccccacgcaggccgacctcgacacgctccgcgcgctcgagccgctcgccggctacccggacctgctccgcctcgcctccgccatcctccccgccgccacgacgaccggcgcagccgccgccgccgccgccgagcaggcgcagcttttcctgccgtggctgcttcaggcgcagatggcgcagcagcaacagcaggtgacgccgccgccgccgccgccgccgcaggccgcggcgaccgaacagtttttgcaggccaccagcaccgcctgccaccaaatgccaggcctggttcacgccagcccgacgcagcagctggcgcagcaaccgcaggatcacatggcggcggcgacctgccaccgccgcggcgccgtgcagcacccgagctacgacaaccagctcgactacgtgccggcgctgatgcagatggcgtccgacgcgtccaacctgcagcagtggagcagcacggtttcgagtagcaacaaccacaacgtcaactccggcgtgtccacgccgttgtcgagcccagcagccgccggacagatcaactcatcctttacgacgacgacgacgacgtatggcttgaacgcgagcggtgacgtcgacgacgctgggctgctcatcaacatgcacctatccgagctcctcgacgtgagcgactacatgtaataagatttttccttgcgtggaaacagagccgaatcgaacactccacgccatgtaccaaaggggcaaaacatgatcatcacaagaggcaatttttgtacaggattgtaccaaaaaaaaaaaaaaaaaaaaaaaa

SEQ ID NO: 6049 - DNA, 1637 bp, Oryza sativa
  Predicted polypeptide sequence is orthologous to G1323
gcagcttggccgcacgcctgaacacacacaacagcagcagcagcaacagagcacggaggcagaggcaacaccgagacacgagttgttctgggcggcggcggcggcggccggggacggacgacgtacgatggggaagggccgggcaccgtgctgcgccaaggtggggctgaacaaggggtcgtggacgccggaggaggacatgaggctcgtcgcctacattcagaggtacggccacgccaactggcgcgccctgcccaagcaagcaggtttgctccggtgcgggaagagctgccgactccggtggatcaactacctccggccggacctcaagcgcggcaacttcaccgccgaggaggaggagaccatcatcaagcttcacggccttctcggcaacaagtggtcgaagatcgcgtcgtgcctgccggggaggacggacaacgagatcaagaacgtctggaacacgcacctcaagaagcgggtgtcgccggagcagaagaagggtgggggcaagagcaagaagaagacgacctgcaccgacgtgctcgtcccgtccccatcgccgtcgtcgtccaccaccaccacgaccaactgctccagcggcgactcagccggcgagcagagcaacacgagcaaggaggaggaggaggagacggacaagatcgagatccccatgctcgagctcgacccctgctgcttcgacttcgacatgctggttgaccccgttgtcccggacacgtactgccccgcggtgtcggcgtcggcgtcggcgtcggcgccgacgtcgccgtgctcgtccacgtccccgtcgtgcgcccgtgcaggcgtggacccgctgctcgacctgcccgaaatcgtggacctcgggccggagctatggagcatcatggacggcggcgccggcgacgggtgcaccgaagcgccgccgccggcgtggagcaatgcggcggcggcggcggcggccaatgcaacagtggccaccacgaccagcctggaggaggaggaggggaaggagtggtggttggaggacttggagaaggagctcgggctgtgggggcccacggacgactaccactgccacccgggcccacaaggtcagcccggtcgcgcgggcccaccaccctccgccgttgtggaggacccagtgtcgtgctacttccaagcgggccccacggcagccgccacgtggcagggacacgagccctcggctgtcatcacgagtaaccccatggattactacgtgtaagctcgtcgttaattacccatttttatctctagattaggagatatacgattacccaactcgaccgaatcgtccagtgatgctacatacttctagtacaatacacgcgtataattgtacgaccgtataaaggagtactataccaatccaatacgaagacggcatcgatgggaacaacacatgcaaagatgcatatatgcttttgggcagtaaaaaaggtgatagttaggctaggatgcacaaaaaaggtgttaatttttttttttgggatgtctatatatgttgggcagattaagtggtgcatgcaatcacaaatgagtcaagattgccggtacgagttaaccagagatgtaacttatgtacttttaacatcagtttccagcagatgttggtattg

SEQ ID NO: 6050 - DNA, 1665 bp, Oryza sativa
  Predicted polypeptide sequence is orthologous to G1323
ggatgatagggagagggagaggagacagaacgccctgcccgtttcagacctcggcgcgtgcacatatataccaccccctcccggtctcccatgcgctctcgatcaccatcttctgcttcatccatcatccactgctactctgtccgggaaacgttcagacagaggtgggcatggggaggggacgagcgccgtgctgggccaaggtggggctgaacaggggttcgtggacgccgcaggaggacatgcggctcatcgcctacatccagaagcacggccacgccaactggcgagccctccccaagcaggccggattgctgcggtgcggcaagagctgccgcctccggtggatcaactacctgcgccccgacctgaagcgcggcaacttcaccgccgacgaggaggacaccatcatcaagctgcacggcctactcgggaacaagtggtccaagatcgcgtcgtgcctgcccgggaggacggacaacgagatcaagaacgtgtggaacacccacctgaagaagagggtgtcgcagagagagaagccaggtgacaccaagaagaagggcaaggccgcggacgccagcgacgacgccgacgcgcattccccgtcgtcgtcggcgtcctcctcgacgacgacggcggccaataacaacaacagcggcgacacggccggcgagcagtgcggcacgagcaaggagcccgagaacgtcgacgtgtccttcttcgagcaagacatcgacatctcggacatgctggtggacgcgcccacggaggcgccgctggtcgcggcgccaatgccgccgtccccgtgctcgtcgtcctccctgacgacgacgacgtgcgtcggcgccgtgtcggacgagctgctcgacctgccggagatcgacatcgagccggatatatggagcatcatcgacggctacggcggcgatgagcccggcgacggcgatgcaacagtgccatgtaccgccagcccgggagaggagggagcagagtggtgggtagagaatttggagaaggagctcggcctgtgggggcccatggacgagtccctggcccatccggacccacccggacaggtttgttacccgggcccactcacggaaacagagggggacccagtctccacctacttccagtccgggcccaccgcctctccgctccaggagatcgcatcacccgccgttctctcatgattccaccgatggatcacgtccgtccgatttggagcagaaggcggagtttaaccaatagtgatctgatccaacggacaagatagatcgatcaagatagatcggccactgcactatcatctacagcaaatacgaatcgatcaacacaatttacccgctatatttgacgcgacgacgaagagtgattaatttgtttggtgttgcagtaaatggcgaaggtttagattaactaggatgcacatacaaaaagggtcaagccgtcaaacacaaggcgaaagtgtagtagagacacaacacaagtgtttactaccttctagtactctttttttaacatttttaacccaagaaaatgtagtttttgattgggcatgggacggcactccattgaagagccaatgagaagtgctatatatatcacacactcctatattgtaacatttgtacttatattattgagaagtgccaatgagtttgc

SEQ ID NO: 6051 - DNA, 1577 bp, Oryza sativa
  Predicted polypeptide sequence is orthologous to G1324, G2893
aaggggatcatacatcgacctcatcatccaatccaccaactgaccaacaacatttatactactagtagtagaagaagaagctctagatagctatatatcccagctgctgcaaaggtagtagacagcaatgtcgcagaggagagttgcagggcccatgggagtgatgagcaagcagcagcaggaggccatggcagaggagatgatggagctgaggcgaggaccatggaccctcgaggaagacaacctcctcatgaactacattgcctgccatggcgaaggccgctggaatctcctcgcccgctgctccgggttgaagaggacgggcaagagctgcaggctaagatggctcaactacctcaagcctgacataaagcgcgggaatctgacgccggaggagcagctgctcattcttgagctccattccaggtggggaaacaggtggtcgaggatagcgcagcatctgccggggaggacggacaacgagatcaagaactactggaggacgagggtgcagaagcaggccaggcagctcaaggtcgacgccaacagcaccgtcttccgcgacgccgtccgctgctattggatgcctcgcctcctcgagaagatggccggagcagccaccgaccccactccgccgccgccaccgccactccaccaccacgccgccatggccaccgcctcctcctcgccgttcgacttcgacacccacctgcagcaagcagaagcagcaacggcgtgcgtcgtcccgaacaacgtgtaccaccaccacatcgacccgagcccgagcacgtcgacgtcggccggctcgacggcggccgcggcggcgttccagccgctgccctgcttctccgagctgagatgggaccagcagatgcagtcctccggcgagctcgacgacggcgccgccggcgtgttcgtcgactcggcgtcggcgctgggaagcctcagcctcgacgggctggaccttggtccggccgagtactactccgactcgacgctcctcgactacctcaactccagctgcaccggcagcgccatgatgacgatgatgaccgcctccggcaacgccggcagctacaactactgcggcggcgccatggacggcggcgacacgtggaggtccgacgaggtgtgccaagcggcggcgagaaagctcggcgagtggggaggaggaatctagctagctagctaggtagctacgtatccagctgagcttagctgtagctaaaggctaagtggatggatggatcatggatagatgagatggtaagttgcttcttgtgatgtctctccattaaagcgagatgagatgatgatcatgatgatgatgttgatgatgctgtcacattagctaatggatgagttgttccatcatatcgatcaagatagaagtactagtgatcgatcaagcaaaaatcaaaagtagaagatgatcaatagcgtgatgattccgatcgatggagagaatattattgagatgtgtttaaacatattagctagagctagctagcttcttgtagtggttgatcgatcgatggtgcatgtaactattgttagtagtagtactttgttaatgt

SEQ ID NO: 6052 - DNA, 1421 bp, Oryza sativa
  Predicted polypeptide sequence is orthologous to G1330, G2423
gaccattttcctcaaacgatatagctagctctactacacacttgctctgcccgatgatgatggcgcgagaggtgagcagcgaggaggaggctggcggcggcgacgagctccggcgagggccgtggacggtggaggaggacctgctcctcgtcaactacatcgccgcccatggcgagggccgctggaacgcgctcgcgcgctgcgccgggctgaagcggacggggaagagctgccggctgcggtggctgaactacctgaggccggacgtgaggagggggaacatgacggcggaggagcagctgctgatactggagctccatgggcggtgggggaatcggtggagcaagatcgcgcagcatctccccggccgcaccgacaacgagatcaagaactactggcgcacccgcgtccagaagcacgccaagcacctcaactgcgacgtcaactcccagcagttcaaggacctcatgcgctacctctggatgccccgcctcctcgaacgcatccaccgctcctcccaatcccaatcccacgacgccgacgacgccgacctctccgtctccgccgccaccagctgcatcacctccgacctcgtcgtcgacgcgcatcacccgccgctcgccatggccgacagcaacgactctgcagccatgtggcagcaacatcaagcaccacagatgagcgtcgccggcgcgccgccgccgacgacgacgatggcccaacatgtagtactgccgaccgcggcggcgtcgtgccaccagatgcaggatcagttcgtctgcgcgcgcgcggcggagacgacgacgtgctgctggtccgagtcggagtcgctgccgggtctcgcggggctgtactacgacgacgcggcggcggcgctgccggagtttgacgtggagaccatggccatgtggggccctgaggacgacccatggtacacgcaaatgcttggcttgtgaaaaccgttgaccaaatatgatgccttcctacctacacctacacatttgtgtggattaaagaagaaggagatgcttattatttggaggttaatttgatttgatttaacccccaataatctcgtctccagttcttaccacatatatcgtcaattctcaagtacagtacattagctacactttagtacagtagtagtattttggaacatgcatggagtaattacttaagctacacttggtagttttcctcctccatgatcatcaagtaaaagcatgcatgcatgatcatggatggagataaactacagtgctaattaaattagtctggatgtacggttaatcgatcgcttggtttttactatactgcctgaattactccattcttaatttctcgggacggatgaaacggattggtttaatttgtttgtaataatgtatatcaagctagctagctagcttaatttggtg

SEQ ID NO: 6053 - DNA, 1404 bp, Oryza sativa
  Predicted polypeptide sequence is orthologous to G1330, G2423
gagctgcacccttgcatcttctctctctctctcttcttcttcttcttcttctccatatctcctactcctcgtgaagatcgatcgaccatcggcaatttcattcggtaatagttaagctaagatcaaatcaagattggcgaaacgatggagatggtgctgcagaggacgagccaccacccggtgcccggggagcagcaggaggcggcggcggagctgtcgtcggctgagctccggcgagggccgtggaccgtcgatgaggacctcaccctcatcaattacatctctgatcacggcgagggccgctggaacgcactcgcacgcgccgccggtctgaagaggactgggaagagctgccggctccggtggctgaactatctccggccggatgtgaagcgcggcaacttcaccgcagaggagcagctgctcatcctcgacctccactcccgatggggcaaccgatggtccaagatagcacaacatttgcatgggaggacggacaacgagatcaagaactactggaggaccagagtgcaaaagcatgccaagcaactcaattgtgatgtcaacagcaagaggttcaaggatgccatgaagtacctatggatgcctcgccttgccgagcgcatccatgccagggctggcgctgttgatgatagcggagactacagcaacaacgacttatcatgtgtatctggtgtaacaatggccactgttgctaattgttttgatggctctccgagcatggtgactagctcatcttccgattcgttcacgtcggagtcacaagatttgaagaagattaacttacatgtgcatggtgatgatgagaagatgaactctgaagactggatgcaggaggtggaccatgagttttggtctacagagattcagcctaataatgaacagtttcaggaccaacagcttaacggttgggtgcaaggtttttctgagggtttgtccgaaactctatggagtctagaggacatatggaagatgcaataaattttacatttacaaaggacatatttgtaaaatagaatagagagacatcaaggaaggcaaagagaaaaagttctttagtcatatactgtacgttgagacacttaagttctttgccaacttcaatgttttttttcttttatttttgctgcctctttcgatccctgaaggggtttttgccttctagatgtctaggggttcaaagaggaccagaggagatatatatgtgtttggatatgttgatatatgagctgatatatgccttactatatatatactccagaattgcactgaggattacatatccaattcagacatgcaaaccttaccagttgcaatattgtaaattacatgtccaattttgtagtttcatcttcctcatcataaaaaaattatgttgtgtcg

SEQ ID NO: 6054 - DNA, 882 bp, Oryza sativa
  Predicted polypeptide sequence is orthologous to G1330, G2423
atggacgcgccgtgtggatggacgacgtcggcggcggcggcggtggcggaggaggaggatgttcggagagggccgtggacggtggaggaggacgcggtgctggccgggtacgtggcggcgaacggcgaggggcggtggaacgagctggcgcgggcggcggggctgaggcgcacggggaagagctgccgcctccggtggctcaactacctccgccccgacgtgcgccgcggcgacttcaccccgcaggagcagctgctcatcctcgagctccacttccggtgggggaaccgctggtccaggatcgcgcagcacatgccggggaggacggacaacgagatcaagaactactggcggaccagggtgcagaagcacgccaagcagctcggctgcgacgtcaatagccgccagttcaaggacgtcatgaggcacctctggatgccgcgcctcgtcgagaggatccacgccgccgccgcctcgtcggaacgcgccgcgccgccgccgtgtgccgccgcgccggctagtcacagcggcatgtgccactcacctgacccgtcaaccacgacgtcgagcatggcagggtcgtcggtgacgcacggcgagcagttcccgtcgtcgacgaaccaccacctgatgaccatggccagcgtcaccaccgcagcggcagattggtccagcgagcaatgcggcagcggcagcgccaccagcacgagcgttgggatcagttatgacatgttcgaggggagctggtcggagctcctcgcccgcgcctacgacgacgacggcgccgattcttcgctgctgccggacttccaaatggcagacaccggagacaactgctggtggagtaatttggaggacatctggtcacagcagccgtactga

SEQ ID NO: 6055 - DNA, 1645 bp, Oryza sativa
  Predicted polypeptide sequence is orthologous to G1330, G2423
gagtttcatcgcagcacacatccatccatccatccatctatccagagagcacagcaacggcgcatatatagtacccctctaccaaagcacaacaaccagaatctcctgagctcgatctagctactagcttgatctatccgatcaatcgactggcccgcgaggatcgatcgagactcgaaagggagggattttgatccggatcggtcgacgatggacatggcgcacgagagggacgcgagcagcgaggaggaggtgatgggcggcgacctgcgtcgcgggccgtggacggtggaggaggacctcctgctcgtcaactacatcgccgcgcacggcgagggccgctggaactcgctcgcccgatcagcagggctgaaacgcacaggcaagagctgccggctccggtggctgaactacctccgccccgacctccggcgaggcaacatcacgccgcaggagcagctgctcatcctggagctgcactcgcggtggggaaaccgctggtccaagatcgcgcagcacctcccgggacgcaccgacaacgagatcaagaactactggcgcacgcgggtgcagaagcacgccaagcagctcaagtgcgacgtcaacagccagcagttcaaggacgtcatgcgctacctctggatgccccgcctcgtcgagcgcatccaggccgccgccgccgggcagcagcagcagcaggaaggcggcaccgacacgccgcccctgtcgtggcagcacggcggctccgacgggctctacgagtcgccggagctcccggcgcccgatgccagctgctggccagccgagtactgcgcggcggccggcggcgcgcagtcgggcggcacgcctgcaccggagctgtcgagcaccacggccgggtcgtcgtcgctgtccacggactccggcgccggggcgcagcccagctggcccacgcaggccgacggcgccgagtggttcaccaccgcctgcgacgcctccagcgccaccggcggcgtggccatgcgcgacacggagctggagctggcccagccgccgtgccagggcgggcagacgtggacgacgtccgagtcgtcgctgcctggcctcaccttccccgacctcgccgtcgcggacttcgagatcggcggcttcgacgtcgatagcttctggacgagcatggaggacgaccagctgtggtgccccacccaggccgccgtgtgaaaagtcagcacggccgccatgggaatccgccgcggcgagcgagcgcgcgcgcgcgcgacacccgcgggtgcacaaccgccggggacgcgtagcggagcggagaagcggattagaagaaggagagaagctatctgggggattagaacaagattaatcgcctcacgatgccatttttggactcctagctcccagactattctaactccagttcttttccgtttctttctcctttttttacttcctagggtaaaaaaaaagaagttaaagtgtagccgttatactagtgttgatgctgctgttactaaagtttgtccgttaaattttactcattctttttgagtaaatacagtactgccactactgtatgtacgagctgaactctgtaggattgacaggattactgtacacttctagaaaccggtaataaaagcaaagctccgacgcc

SEQ ID NO: 6056 - DNA, 371 bp, Oryza sativa
  misc_feature (332)..(332): n is a, c, g, or t
  Predicted polypeptide sequence is orthologous to G1330, G2423
attctcaaacacaccccacagctacagctgatcactagctagctactgagatcgatcgatggatttggagatggagatgatgaggatggcgatgagcccggcgatgtcgtcggcgacggcggcggcggcgagcgaggacgagggcgacctgaggagggggccatggacggtggaggaggacatgctgctcgtcgactacatcgccaaccacggcgagggtcgctggaactcgcttgctcgctgtgcaggtgattaattaattattcagtcaattgattaatcagttgatcattcgatcgatcgatcagagattgagattaattaaatagttnacgatctctgtgtgccaaatagccaatactgttgtgttg

SEQ ID NO: 6057 - DNA, 2761 bp, Oryza sativa
  Predicted polypeptide sequence is orthologous to G1340
gacttccgaacttgaagctctcctctctctctcctgccatggctggccatcacccaccaccggccgatctcctcctccgttgatcctctttctatttccttgcgccatagcgtttgcctcgacgaggagaatccatttttcccctttcccctctccctccaccttgagataaaccgccaccaccaccttctcttatcgccggagttgagctcctgccgtcgccgttccggcctcctcccctaactccttcgctgggcgaccacttccccgggtgcgtgtcgctcgggaacacacttggccgccgctgttgaggccgttccaccatcggagcaccggcgtcccttctctctctctctctctctctctctctgctgttcacgggaagaagagaaggaagaagaagacgagaggaagaagaaggagaaaaaaaaaaaaataaagagctactgacagcgcgtagattccgccgttttggaagatcgcgatcgcgaggaaaagtgttcagaagattcttttgaagaagcaagtacttctgagctgaagacgaagttagaggaccaaggcacatacccagttgagttttgcctgtggagtagagctgaagccccgctaggatcgcctttttcgcttctatcgttctcttccgatgtgagtactaagtgcctcttttgtaagtatttacactttatttatgtttggaactatatattacttgtcgttttgtgtacctgactggtcctggatagggatttaatacacaaaataatctagaaatttggggctaaatttctgggcgtgacaatccctcagccatatatatggtgatgggtgaatgggcccatttgaatatgtttcgttaggtttgtgtgcccaaaactccataggcttgaatatgagtttgattctcctcctactttatgtatatttcttctcaactttagtagtttgtcaccagcgtccaaatatacaccaactctcgtggaatttgttagaaataaatcctaccactatgttggatgttttacattttcatattaatgaaggtattgacggtgtaaatttggtatttaattcagtagtggcatataatggacatgcttgccagtcaaagttacaaatctatttctcatttgttacaacttgcttgcaatactaaaagtcaaatagaggaggacatggaaaaacaacacgctatgtttttgcctccttttactaaccatttgctggaagtgcataatcatgaaaaggaggagagagacatgattgaaccatcattccctttattcacactcaaattcgatgcacctccatcatctgaagaaatcaccaaaggtaaactagatgatgctaaaactaatcaaggtgaatgtgttgttaataaattgaatttgtccacttttcatgctatagtagggcaaccattaatgaaaccaattgttgagattactttgtcacaagttgatttttttttgttgttccttgtgataaagaagagttgcgtgatactgcttcacttatactcattccacaattagtgaatgaacatgatattcctattgttaatcctttatgtgttgattttaagcatgttgttcacatgtctaatgaagttaaggaacgcaaagtattgtcttctttaaatactttgggctatgttcagtttgatgatatttgtgagctagtaaataatttgaagaagaaattattggctaagtttgaattgccatgtccaactaatactatattttatatctttggcaaacataataatagaggattatatttggtgcacataatttatatatatttagatttggaacctcttataattacgtgagaaaatagcaagctagagagtagtatcattgctaatcatgttatctcgagtttgtgttgttttgatttgaagcatcaggtcggttttaaggaagaggagagaccggatcactctttgtggtcaccatgcacctagatagttgcgccatatgagtactcggcttctgaagaagggagcaaatgagtagcaagcgaaacaatcaaatgtggcatcgatgttctttgttgtgcgtctatatcgggtacatttgtttcattggatattaatactatttgctaaataactgatgatattacatgacgaaagtttgttgcatttattttcatgtaggcacttctatgtgcaagaccatgcactacacgataagcaccatatggaaaaactgaggacggttttctatgaagaagaggaggatgatgtgacctggctaccataggtataacaattgttcacttcagggatcaagaagaatacatcaagatcaagccgtccaagtgatggaatcaaattcggctacctgctaccgtgctgacttcaaacgactgtcaaatatgtatacaagctctgttttggttctgtgagtatttgatggatagctcttatcggagtcctctttccaacggatctagcctcatcgccaaattccatctcagtcatccgcaatcaaagaaacatggtgctaaaatacctgtcgtgggcctttggatttgtaacttcatttaggaccccggcccatgtggggtgagccccatcctggtggagcacgaccctagggaccctttggtcgtcccctcatctccttaaatagccatgtatcccttcagagtgtctagagtttgtttagattaaagtttagccattgctactttaccttgtacttacacgtgtcggctagaccacctaattactcatctttgaaacccc

SEQ ID NO: 6058 - DNA, 445 bp, Oryza sativa
  Predicted polypeptide sequence is orthologous to G1341
aagtatgagaagagcattggggtcacaagagcaatgaccttgaacaaccttcagacaggtttccctaacgtttttcaggcgatgacgggattcgccagcgtttgcatggaagcgtttgaatcggtgtacaacttcaagagttcagatcggatccttgattcgaagaggctactaacatgagattctgagaagttgtcttttgttggtgcttggtaggtcactgtataaagtgtatacagttctagagttcttgtagaatagcaggtggaacagggtttaacttacaaccgtctctgtctgttatcgtcttctatcttatggtactagagtaggcaggcacagaaatgcctcgagttcatttactcgctgtgaacgaacttgaggccttgttcttcctctttttggttagctctgaggtgtttgtccattcttggattcgaaatct

SEQ ID NO: 6059 - DNA, 1553 bp, Oryza sativa
  Predicted polypeptide sequence is orthologous to G1361
ggttccctcctctcctcctttctctctccctcctcccgcgcgcggggtctcgccttaacgtttgccgcatatgggggcgacgagcaaagcgtaggccggagggagggacagggagagagagagagagaggctttctggctcgctctctctgcacgatctctcgtcttgttggattatacagccatgacatggtgcaacagcttcaacgacgtgcgcgccgtggagaacaacctggccaccgccgccgccgtggccgcggccaagaagcagcagcagcagcagcaggtctcccagcacgtcaacctcatcaagacctgcccctcctgcggccaccgcgcgcagtatgagcaggcagcggcggcggcgacgatccaggacctgccggggctgccggccggggtgaagttcgacccgacggaccaggagctgctggagcacctggaagggaaggcgaggcctgacgcgcggaagctccaccccctcatcgacgagttcatccccaccatcgagggcgagaacggcatctgctacacccatcccgagaggcttccaggagtcggcaaggacggcctgatccggcacttcttccaccgcccgtcgaaggcgtacacgacggggacgcggaagcggcggaaggtgcacaccgacgagcagggcggcgagacgcggtggcacaagaccggcaagacgcggccggtgttcaccggcggcaagctgaaggggtacaagaagatcctggtgctctacaccaactacggcaagcagcgcaagccggagaagaccaactgggtgatgcaccagtaccacctgggctccgacgaggaggagaaggacggcgagctcgtcgtgtccaaggtgttctaccagacgcagccgaggcagtgcggcggcggctcggcagcgacggccaaggacctctccgtcgacctcgtcgccggtaacaacatcaaggctagcaatgctgctgctgaacaccaccataacgacggcgtcggcggcggcggccacggtggcaacaacagcagcatgctgaaggaagctgcaggcattgtagatttctacaacccagcggcggcgctaatcggctacagccaggcggctcctaacaacagggcggctgcttctgctcatttgacgatgcctaactttgaggtgcacacaggaggtgcaggctttggcccctgatggatggaagaaaacaaagcaaattaaacatatttgactgatgatatatataggttagatggagagggcagggcaggtatatgatggcaaatgtgcatcatgcatgctagcatggtgtaatttgcatcgagtgaaaaaaaaggagtttactaaaccgtctacgtacgtattactggacaataaggagtgtgtcgagtgagttgctgcacagatgttgaagcgtaggggggtcgatattcttacagtgttcattattgttacatgtgtacacatatataacttgacattctcaatttttttgtttaatgatatatatatatatatatatatatatatatatatatatatatatatatatgttgttctat

SEQ ID NO: 6060 - DNA, 1539 bp, Oryza sativa
  Predicted polypeptide sequence is orthologous to G1361
gaagctttccttcttcttttttccccctctcgacgatctctctctcatcaggaccccggccttaagttgtttcttccctatcagctcaggtctctctcgatctctcctagctagatagatagcttaattagcagctagagatgtgtctctagctaagctaactagctagtaggcttcttcttttaatccggcattgttcttggctgctggtcttagtttttggctgtcatgtatggagttagtggtaaaatactaggttaattaataatataaggcgtgtgtatatattggtgtggaggaggaggagaaagggggttggccggagagatcgatgacgtggtgcaacagcttcagcgacgtccgcaccgccgtggacagcagcttgtcgccggccgccgccgtggccgccgccgcggggaagaaggcggcggcgtcgctcgccgtcctcgtcaagatgtgcccctcctgcggccaccgcgcgcggtatgaacaggagacgacgacgatccaggacctgccggggctgccggccggagtgaagttcgatccgacggaccaggagcttcttgagcatttggaagggaaggcgaggccggactcgaggaagctccaccctctcgtcgacgagttcatccccaccatcgagggcgagaatggcatctgctacacccatcccgagaggcttcccggtgtgagcaaggacgggctggtgaggcacttcttccaccggccgtcgaaggcgtacacgacggggacgaggaagcggcggaaggtgcacagcgacgaggtcgacggcggcgagacgcggtggcacaagaccggcaagacgagaccggtgatggccaacggccggcccaggggctacaagaagatcctcgtcctctacaccaactacggcaagcagcgcaagccggagaagaccaactgggtgatgcaccagtaccacctcggctccgacgaggaggagcgggacggcgagctcgtcgtctccaaggtcttcttccagacgcagcccaggcagtgcggctccaccgccgccgccgccgccgccaaggaggcctccgccgccgtcgccgccgccgtggtgaacagcaactactccatcgtccatggccatcaaggtggtggtggtggtagctttctcaaggaggcaaacgttgtgcacgagttctacgacccggcagcaacgatgggttaccggccacctgctcctgctgcgcacttcgcgccaaacttcgcggtgcacgcggcaaggaacagctttggtggcccttgaaggaaaaaccaaaattacacaaaatctaaacattaccgtttataccgatatgattcacataggtgccattatattacattcttaaccttacattcatccatcagttatttgcagttttgttcaaagttgttatatcgtttccgatgctatactgtgcaaagattattactacacgccgttctaactcgaaaatgtcaattaatgtatcagtttgtacatgtatacatgcacacggaagaggtcctgatgatgcatcacttcat

SEQ ID NO: 6061 - DNA, 717 bp, Oryza sativa
  misc_feature (20)..(20): n is a, c, g, or t
  Predicted polypeptide sequence is orthologous to G1361
cttcgccaagaagcgcaagncggagaagaccacctgggtgatgcaccagtaccacctcggcgagctggacgacgagaaggaaggggagctcatcctctccaaggtcttctaccagacgcagacgcggagcgccgccgcagcagaggcaccggtaagctcgggtgctgccatggaggtgcagggacagcagcagcaagtgctgaagctgcaggctgatgatggtcacttcagctcagctcctaccaagaagagactgcatcaggatgttgtagcacaagtaaaagttgatcggggtcaccactgcatgccagcacaacgccaagtcaacttcaatttgaaagtaactcctgtgcccaccaccagttcattccctgtcgttgtcgacaaacagttgtattctcctgtggcgctattccgaagtgaacatcttcatggaagaacttcaattcatcagccccaaaaagcagattggcctcaccagcgctggcctcctgacaaccaagatcaacatggataacttcctggattcacagtagatgaacttaactggtaaatggttctagtgttgattttgaaacgtacaacagaaactggctgtaatatcttcggctactgctagagtgctagtgctagtaacctatctacttctgttcttagcccgtagggcagtattgtttcttattgagaatgactgtctatatacatgtcaaatctctt

SEQ ID NO: 6062 - DNA, 909 bp, Oryza sativa
  Predicted polypeptide sequence is orthologous to G1363, G1782
atggattggggatttgagatctggaatggcacggacactggacaacaaacaaagaaacaattttcgcatttaggatttttaagagatagttttcccactaggcgccacgacgggacggacgctacaggaatgcaagttgaagaacctgaaaaatgcatgcagtacggaacaatcgaaatgctggctgctttatttccaggaattgagacttgtggagtcggaaagcagatagcaaccccggacgtgcacccaaccaacctacacttaccagccgcattggatgccgttgctccccacacacaccgaaccaacggtgactccttcaggagaactgttgatggtcctatgaggtcaacgttgacttttgataataatcattctgtagtgccaagtcaaaacattgattacggccagccaatggcttgcatttcatacccatacaacgattctggttcaggagtttgggcatcctacagttcacgctcggtgccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctgcttccaccttcactgtaacttctgcggcacagaaagacgacgccttcttcgaccgccatggccaccatctcagtagcttctccggccattttggccaggcaagcgcacaaggtggcgtcggcagcatgcataacgggtcacagcagagggttcctgctatgagatga

SEQ ID NO: 6063 - DNA, 503 bp, Oryza sativa
  misc_feature (68)..(68): n is a, c, g, or t
  Predicted polypeptide sequence is orthologous to G1363, G1782
gcacaggcttgcatttcatacccatacaacgattctggttcaggagtttgggcatcctacaggtggangctcggtgttccatcctcaaattgtgggaggaggcacatcgccaagagttcccttgccctccctggagatagcagatgatgggcccatatatgtcaatcccaaacaatatcatggaattcttcgcagaaggcaactgcgtgctagggtagaggcccagaataagctcgtcaaaacccgaaagccttaccttcacgaatctcggcatcgccatgcaatgaagagggctaggggcactggtgggcgattcctgaataccaagcagctccagctgcagcaacagtctcacactacctccaccaagaccaccacagacagccaaaattcttcaggttcagtccatctacggctaggtggtggcgcaatcggagatcaaactccatttccgttcaaagcaatggattcacaagctaacatcaagagagctgcagcttctg

SEQ ID NO: 6064 - DNA, 886 bp, Oryza sativa
  misc_feature (858)..(860): n is a, c, g, or t
  Predicted polypeptide sequence is orthologous to G1363, G1782
ggtgggacgacagaaggatttcaagaagaacaagggatatccattcctctcatagagcacctgcttgcaagtcccacagatacaatgggttttggtgaaagcacccaggcaatcaacgtaagcttgatggtcctgggaaagtgtcaactgaattatctctagtcaatctagaagctaaaaatttgcatcctaaacctgagtgcaaccaacctcttgaacacatacctaccaagggtatgaagtgtactccactgctaccactacctacagaacatgctgatgatgagcctatatatgtgaatgcaaagcagtaccatgcaattatccgaaggagacaacgtcgaaaaattgttggatcagaagataaagtagcagcaattcgaaagaggatccttgttgaggctcgccaaaagcaagcaaaattgaggcgtagaggaaaaggcggacggtttattagcatagaacatccccttgaactttctatggatgatcagatatcgaaaaacggaggaagtgcctcgccttcttcatctacagtgtcagaaaactctagcaatgtgaacggttttacaggagatctctaatgccatggatagcagcaaaggtcaatcgcaatggctaccatctgaagaaaaaaaatctctaatgaactgaagtactgtgcaaccaattatgtctgtgggaaggcaatgacctatttatattggcggggctggggctacattgagggcttccccctttagtgtaaacatggcgggcactaagcaaccccgaaagggcttgttgtgccccaaaaaaaaaaaagggggcacacggccttttctaccccccgacccactccgaccccctgccctttannnagagaagaaagaaagaaaaaaaaaag

SEQ ID NO: 6065 - DNA, 538 bp, Oryza sativa
  Predicted polypeptide sequence is orthologous to G1380
gccggtgctcccgccgcggccgcccccgccgccgccgatccccgacggtgactgccgcagcgactgcgggtcgtcggcgtcggtggtggacgacgactgcgcggacgccgccgcctcgccctcgtgccggctcccgttccagttcgacctcaacctgcctcctggtggaggcggcggcggcggcggcggctttggctgtgcctacgacgacgaggagctgaggctgacggcgctgcggctctgagcccccaaccccaccggtcgttggagaaagaggaaaaggagaaaaatatttggttcttcccttctctcgtagccgacatgatccttccgcgctttgtgttgttcttgtttacttgatctgatgatgattaatgtggcccgatctgcgtatctgcctgcttgctgctggcgatagatgatgattgctgcgtctcgcagcagctcgctgtggttgtgctgttgtaatatagcaacattttacttgcttccttcctgtgaggaagcagacagctaaagtaacttattttcaatcttt

SEQ ID NO: 6066 - DNA, 820 bp, Oryza sativa
  Predicted polypeptide sequence is orthologous to G1380
cctgtctgaggtacggtcggaattccgggtgaccacgcgtctgccacgctgtcgagcgcaaatcaatcacccaccatacaccggtcgaacacttggcgctctcgcccgccttagctcgctctgctcgtggtgctcgtacccgaacaagaacggacatggctcccaggaacgccgccgaggccgtcgccgtcgccgtggcggagggcggaggagacggcatggagcccaggttccgcggcgtgaggaagcgcccgtggggcaggtacgctggcggagatccgtgacccggccaggaaagcgcgggtgtggctcggcaccttcgacaccgccgaggccgcggcgcgcgcctacgacagcgccgtgctccacttccgcgggcccaaggccaagaccaacttccccgtcgccttcgctgcacgcccaccaccacgccccgccggcgccgctggccaaggcggcggtgctgggcgtcgtcagcccgaccagcagcacggtcgagtcgtcctcccgggacacgcccgctcgccgccccggtggcggctgggtcaaggcccaggtgcccgcctcgccttcgctcgatctgagcctcgggatgtcggccatggtggccagccagccgttcctgttcctcgaacccagagtcgcggtgaacgtggccgtcgcggcaccggtagctcgccggcgggcgtcgtcagcgtaagaacgcagtaactcgctggacagcagagcacactggtcgtcgcaacgaggggagcctccggcgtgggtgggtaactaactgcgcgcaatagagggagatagccaaaaaaaaaccccaaat

SEQ ID NO: 6067 - DNA, 1126 bp, Oryza sativa
  Predicted polypeptide sequence is orthologous to G1380
aagcaccaatggtccctgcaggtacggtcggaattccgggctcagctcaacccagcagcgcagcagctcaagccttctcgcgttgcagcgccgcgccgaggaggtgtttgttgatttgtggagatggtggggggagaggtcatgtgcgaggcggcggcgccgaggtacaggggggtgaggaagcggccgtgggggaggttcgcggcggagatccgggacccggcgaagcgggcgcgcgtgtggctcggcacctacgactccgccgaggccgcggcgcgggcctacgacgtcgccgcgcggaacctccgtggcccgctcgccagaaccaacttcccgctcgtctcctccctcccgctcccgtcgccccactaccacctccccgggaaggcggcggcggcggcgccgccggtggccggccccgcggtgcagcgcgagctccaccgccgagtcctccgagcgggcctcgccggcccagaccggcggcccacgggaggcggcggtgcccccggaggcggctcccgcggcccatgagcacccggagcccgacgccgcgaaggcccacagcacacatgcccctcgacagcccccgccaggcctaacgccgcacacacctcaccggcaccgccccgcgtccaccgcgctcgcacctaacaaccaccccagaccgcagcccggcccccccagacaccagaccccagccctccgagctacaacgcaccaccccacccccagacccggacaccaaccccgccccccaagcacacacaaccccgccacccctccaccccgccacctcacacccgaacgaccgaacgccccagctacaaccaccggcagacccccacgccgccagaacgacgcgaccgcccgccgcagcggccactcccgggcagccgcccggccccacgcacacggacggcagcgcccacgcagcacgcaacaccggcccccccgaagaagcccacgcgcaccgccccgcgaggcgcccgctcccgggaccagcggagggcggcgccgcgctgcgcggggcgaccgggcggggcacgggcgcgcgcggcgccgccaccacgcccgccgcgccacccgcacgccgcaccccgccccccacccgcgcgcacccccaccc

SEQ ID NO: 6068 - DNA, 2328 bp, Oryza sativa
  Predicted polypeptide sequence is orthologous to G1382
gactctcacgagacagcttcccacgcagcgcagcgcaaccgcagcaatggccgattcgccaaaccctagctccggtgaccaccccgcgggcgtcggcgggtcgccggagaagcagcccccggtggatcggcgcgtcgcggcgctcgccgcgggcgcggcgggcgcgggggcgaggtacaaggcgatgtcccccgcgcggctgccgatctcgcgggagccctgcctcaccatccccgcgggcttcagcccctcggctctcctcgagtcccccgtcctcctcaccaacttcaaggttgaaccctctccgacaactggtactctgagcatggctgcaattatgaacaagagtgcaaatccagacatacttccttcgcctagggataaaacatctggtagcacccatgaagatggtggctctcgagattttgaattcaagcctcatctgaattcatcctctcaatcgacggcttctgctatcaatgatcccaaaaagcatgaaacttctatgaaaaatgaaagcctgaatactgccctgtcatctgacgatatgatgatcgacaatatacctctatgttctcgtgagtcaactctcgcagtcaatatttcaagtgccccgagccaactggttggaatggttggtttaactgacagctcacctgctgaagttggtacatctgagttgcatcagatgaatagctctggaaatgctatgcaggagtcacagcctgaaagtgtggctgaaaagtctgcagaggatggttataactggcgcaaatatgggcaaaagcatgttaagggaagtgagaacccgagaagctattacaagtgcacacatcctaactgtgatgtaaaaaagctattggagcgttcgcttgatggtcagattactgaagtggtttataaagggcgtcacaatcaccctaagccccaacccaataggaggctgtctgccggtgcagttcctccaatccagggtgaagaaagatatgatggtgtggcaactactgatgacaaatcttcaaatgttcttagcattcttggtaatgcagtacatacagctggtatgattgagcctgttccaggctcagctagtgatgatgacaatgatgccggaggagggagaccttaccctggagatgatgctgttgaggatgatgatttagagtcaaaacgaaggaaaatggaatctgctgctattgatgctgctttgatgggcaagcctaaccgtgagcctcgtgttgtagtacaaacggttagtgaggttgacatcttggatgatgggtaccgctggcgcaagtatggccagaaagtagttaaaggaaaccccaatccacggagttactacaagtgcacaaatacaggatgcccagtcaggaagcatgttgagagagcatcacatgatccaaaatcagtcataacaacatatgaaggaaaacataaccatgaagtccctgcgtcgaggaatgcgagccatgagatgtccactccccccatgaagcctgttgtccatccaattaacagcaatatgcagggccttggtggcatgatgagagcatgtgaacctaggacatttccaaaccaatattctcaagcagctgaaagtgacaccatcagccttgatcttggtgttggaatcagcccgaaccacagcgatgccacaaaccaattgcagtcctcagtttctgatcagatgcagtatcaaatgcagcccatgggttcagtatacagtaatatgggacttccagcaatggcaatgccgactatggctggcaatgcagctagcaatatatatggttcgagagaagaaaaacctagtgaaggttttactttcaaagccacaccgatggaccattcggctaacttatgctacagtaccgccggcaatttagtcatgggtccgtgagagtctatactaatgcttatagctcgagaatcatatattaccaatgcttcgtattgacattctcttcagaaagatgctcctatcattgacacatcagttgaaccggaggcgagagctgtacctgtgggctgcagcaaaatacaccacatgggtcttctggagcggcaaaggccttgttgtatacttgtatgtggcactggccctatattcgttgtacagtgaacccgttaagattaattagatcatcagaatttggttttctttaactatcttcgccttcagtggaatgtggatagaacatggattatggttgatttggttttgtgagcttgtctaattctcttttgtgacaaagctttgtatctcactgcatatgtacaatgccgttggcagtaaagatatgcaaatgtgatacctgtaacacg

SEQ ID NO: 6069 - DNA, 297 bp, Oryza sativa
  Predicted polypeptide sequence is orthologous to G1389
tgcggttcatgccccctggtttgtgtggcactcgggtgtgtgtggtggaacgacccgtgatgcgtcatgttctatccgtgagattgatcttcccggtcggagacctgctagtgtagagaaagctgcgtgagagagtgcgaggagagataaatgcctgcccctgtatgagcggatatggaccccccaaccttggctgcccatgtttggtgatgtgtagttctgagcttgcgtgttctctgaacctgttggatctttaataccgagagtatggcttttgttaaaaaaaaaaaaaaaaaa

SEQ ID NO: 6070 - DNA, 1108 bp, Oryza sativa
  misc_feature (774)..(774): n is a, c, g, or t
  misc_feature (870)..(870): n is a, c, g, or t
  misc_feature (1048)..(1048): n is a, c, g, or t
  Predicted polypeptide sequence is orthologous to G1399
acaggtccgaagtcttagtgaccacgcgtccgggacgcgtggtgcggacgcgtggggccccggcgagctctcctccgccgcctcggcgcgccacctctcctctcctcgcgccgcgggggagaagccgaacgggcgccggagacacggcgcggattgcctcaccccccctagtggccgtatcaactatcacccttggtgcgcggcctcctcgcgcgcgcgggaacggcgatcgtatcggggtcggatcggattggagccacagcccacagcagaggcaccaacacctgagcagctgaactcaactaagcggcatgcacaccagagtcggcttgcactcacacgctacaaccctgccacttgtacgaatggaagaatggttggactgcagcaggggatgctcgggcccccctgttgtgtctgccccttgaaacggggagaaaaactcatcaagtaattgaaggtggtgaataaacttttacggggcattatcatcgttcctaggttcagctgcaaaaagttaaagcaaattgccaaagatgacatctgaagagaataaagctgttgcacataatgaaccactacccatggagcagacattaagctctggtgctaagcgtaagcgtggtcgtccacggaagtatgagtaccgggctgctgtaatttcccttttgtggtgaggccattcggagggtccacctcttccagccacaagatagtcaaaatccgcaggggggatacgatcccctactcaggggaccttggccaataggccanaggttggccacagcggcgcttaataacggacccgatcgcccgtggaaactccgccgccctataagggccggggagagccctataggggccggcggnacatgccccagcggggaaaggccattaactcgcatccgccacagcgccgacaccccgcggtggcgacggacgtaacacctaccacgtcgtgagacgataccgaaagacgagcaagcacagccgccctctcgaccaccgcagcagtgaacgactagacgagaaaccagcataacgtagngtcgctgcatatgcacacgacgacggtagacagccaacggtgaggacacgactagacaaa

SEQ ID NO: 6071 - DNA, 388 bp, Oryza sativa
  Predicted polypeptide sequence is orthologous to G1399
tggcttattacaacttaccaagagatgacttttatctaaattctgttagtgtgcaagctgcaacgctcgttttagttctcctcaatcgttctagcagatttcatcgtaaatggaaaatcgtttaagattagcagccaaaagtaatgctatcagttctctatcgttatcgattgaagacacgcgcggtcattattattccttgagtcaaaatgattcgattagtttgggaacacccacaacaagttatgctgctgcggcagcaacgaatgcaacaacgcccagtgcactttgtatgcttatcaatggtcgtcgagtacagcaacattataaactattaaccgatggtgttgttcaagtgtgccgtgttccacatgctaaaaatatcatt

SEQ ID NO: 6072 - DNA, 1854 bp, Oryza sativa
  Predicted polypeptide sequence is orthologous to G1411, G2509
gtggcaactggttagacttttttttccctttgcctataataaagccatctctcataaagccatcgacctcatctcctcctcctcctctctctgtctctctctggctgttcttatcagtttacgttgtcctcatcgtcgccggcgccgccctcaaaagcttcatagatagctcgatcgatcgatcccgtcgtcgtcgatcgtcgtcgacgcagcagcctcgccggcggccggagactggggagatcgatcgagagggagggaggttgagtaaggtggatccacgggtcaggcatggcaagaggcccctaccggccggcgaggaggaggaagaagaccagccaccgcctccgacaccaccagcaaagcaggagcagcaggacgaggaggagctcgccgcggtcgtcatcagcggcggcggagcaggagcagctccggcgccggagacgtacgcgcagtactactacgcggcgcgcgccgaccacgacgcctccgccatggtcaccgcgctagcccacgtcatccgcgccgcccccgacctgcacctcccccaccacccatcctcctccgcctccgccgccgcccacccgcagcaggcttcttccttctacccgaccgccgccgccgccgcctcctcgccgtccgaccagctcgccgccgccgccgctgccgaagagcaagggaggaggcggcactacagaggtgttcgacagcggccatgggggaagtgggcggcggagataagggacccgaagaaggcggcgagggtgtggctggggacgttcgacacggcggaggacgccgccatcgcctacgacgaggcggcgctccggttcaaggggaccaaggccaagctcaacttccccgagcgcgtccagggccgcaccgacctcggcttcctcgtcacccgtggcatcccccccgccgccacccacggtggcggctactacccctcgtcgtcgccggcggcgggggcatgccccccgccgcggcagcagcagacggtcgtgccgtacccggacctcatgcggtacgcgcagctgctgcagggcggcgtcggcggcagttacatgccgttcggcggcgccgcgacgatgtcgtcgtcgacggtgtcgtcctcgtcggcgccgcagatactcgacttctcgacgcagcagctcatccgggccggcccgccgtcaccaatgccatcgtcgggctccggctcggcgaccgcggcggcgtcgtccacgacgtcggcgtcgtcgcccggtgcatggccgtacggcggctcggagcgcaagaagaaggattcgtcgtcgtgacgtcactggatggatcgatcgatgcatgaatatgccatgcatttgagaggaagaggtcaagtttttttttaagcaatggaaatggattacatcttcggcctcggcacgtggacagaaagagatcaagtgatatggatcgagaagaatgtttagctgatctgctctttactctgcacgatcgaggagatgaaaatgcatgcaatatgcatggaggggtaagtgttaagtggttaattggtgatttttgcgggttaattaattacatggacattaatttttcttttgatcaccttttgtttattttttctctgaaaactatcttcttttgttcatttttattttcttggaggtacttaattaattagctaggttaattagctggtgatttttagtttgttgtttccctccttttgttcaagtgtgaactaattgtgcaaaattagtccaagtaaagcaaagagagaggattcttatttaattattggttaaacattacccttttttaagatgaaacatgatgtctttttttaaaaaaaaaatctgaatgattacc

SEQ ID NO: 6073 - DNA, 475 bp, Oryza sativa
  misc_feature (130)..(130): n is a, c, g, or t
  misc_feature (147)..(147): n is a, c, g, or t
  misc_feature (200)..(201): n is a, c, g, or t
  misc_feature (252)..(252): n is a, c, g, or t
  misc_feature (288)..(288): n is a, c, g, or t
  misc_feature (293)..(293): n is a, c, g, or t
  misc_feature (364)..(364): n is a, c, g, or t
  misc_feature (383)..(383): n is a, c, g, or t
  Predicted polypeptide sequence is orthologous to G1412
tcggacctcaaaaggataccctggatggaatgccttacaatgccaccccaggggttcaaaaggcgacgaggacgacggaggaagtgtcgtgccatgctcgcgacagaaccacagagggcggaggacaggntgctgcgtggcggacantaagcgcccagtgccaagacggaacaacacccacgtgtgccgagtaaataccnnatggctgctggaatgcaccgtgccctgggctggaaattgtaaatggatgcnacggctgatgaaatataatagagtgatggctaagtnaggtnttgtgagtgttcgaccatggtgacattaagtgaaaaggagcacccatgaatggttgttgaggatcgtgttntgtttgacagcaaggagcnatggccaaatatatatatatacccatgggctcccgatgttgctttgctgtatttttcactgttttcctggtgaaaaaaaaaaaaaaaaaaaa

SEQ ID NO: 6074 - DNA, 933 bp, Oryza sativa
  Predicted polypeptide sequence is orthologous to G1417
atgaacacttttacacttttcagggatgaggtgcagaaagcttcagagaaggttcatcggcatcacgcgaacgacgacgaggccgggttattcctgtcacttgggcttagcctcggatcgtctcctgatgcgtgccagtgccacgccagcaagaaagacgaagcggacgccggcaacggcggcggcgacgggtacctcgccctcgcgctgcgttgcgcccccgccgccggcgagccaatggtgcatcccaagaggcagagggccaccaccaacagcagcagtagcagcagcatctgcggcgaatacgggggcggcgccgccgccgccgccgtgccggcgggccacgacgacgacgaccggtcttgcatgatcacggctgcgtcgacggcgaatcggcctggccgggtcgtactcagaacacgatgcagcgcacccacggtgaaggacggttgtcaatggcgcaagtacgggcagaagacggcgaagggcaacccgtggccgcggggctactaccggtgcaccggcgcgccggggtgccccgtgaagaagcaggtgcagcgctgcaaccacgacacctccgtcctcgtcaccacctacgatggcgtccacaaccaccccatcacgccctacgccgccgcgctccctccgtcgtcgtcgtcctcctcatcggcggcggtagccatgctcgcctcctcctcgtcgtcttcgacgtggtcggagcttcagcgcgcgatgccggcggcgcagtcgtcatggagccagagaaactaccctattcaggcagatgtcgtggcgaaggcgatctgggaccccaagttccaggcgacggtggcggccgccgtcgcgagctacgtccgtgaccgtgagcagagcgcgcgcgttgccggtgggaagggtgccggagagctcttcaacttggctcctccatgctga

SEQ ID NO: 6075 - DNA, 1509 bp, Oryza sativa
  Predicted polypeptide sequence is orthologous to G1417
atggagatgatggtgcagaagcaacgacacgaggagggggaagaggagcgaggaggcttgtgcgcccgcgagatcaaggagctcgacttcttctccgccgccggtgccggtgccggccggagagacgacgacgacgtcctccgtgcggatgggatcagcagcagccacgccggatttatggtcagcactgcgctggacttgctgacagcggtcaacgacggtgatcatcatgaggagaagaaagggcagtcaaatattcaccaaagcaagcagatggatgcggcggcgacgacggtggagggggagctccggcaagccggcgaagagaaccggcggctgcggcggaggctggaggagctcaccagcagctatggcgccctctaccaccagctcgtccaggcgcagcagctgcacaccaagcatcagcagcaggctccgatcgccggcgtgcagttgctggacgcgctcgcggcggcgtctccggcgagccaccggcgacgagcggcggcggcggtggacggcgatagaacagctgactctgatggtggcgagggcgacgagaacgtgtcgccttctcttggtagcaagaggccggcggcggcagcgacgttaacgcggctgacgccggagagcggcagcggcggggagaataatggcggcggcgagcaggcgccggcggcggagatggcgccgtgccggaaggccagggtgtcggtgcgagcacgatccgaggctccaatgatcagtgatggatgccaatggaggaagtacgggcagaagatggccaagggtaacccttgccctagagcctactaccgatgcacaatggcttcgcaatgccccgtcagaaaacaggtgcaacgatgcgcggaggacaagagcatcctcatcaccacctacgagggcacccacaaccacccgctgccgccggccgccgccgccatggccaagaccacctccgccgccgccgccatgctcctctccggccccgccgtcagccgcgacgcgctgttcgccgcccaccaccacgtcgtcgcgccgccgcccttcttccaccacccctacgccgggtccaccatggccacgctctccgcctccgccccgttcccgaccatcacgctcgacctcacccagccgccgccgacgacgacgaccaccgccgccgccgccatgctccagctccaccgcccttatgccttctcctcattgccgttctcgatgtacggcgccggcggcggctcgcaccggccgcccgtcgtcctgcccccgccgtcgtcggtggtggagacgatgaccgccgcgatcaccagggaccccaacttcaccacggcggtggcggccgcgctctcctcgatcatggcgggaggcggcgcccaagctcgaacacctccacgcggcgggagtgacgccgccggagacatcaacggaggcggcggcgccgaccacgccactgccggagcacgcgccgcggcggcggcgacgcagccttgcggcacgtctcccacctga

SEQ ID NO: 6076 - DNA, 290 bp, Oryza sativa
  Predicted polypeptide sequence is orthologous to G1425
tgataccaccttccgagtttcgcgttctcgccttgggtggaacgccacaaagtgttgagttctcggcctcctgcgccgatgggtggtataccggtgcctctagccctccagggaccgtaggcctggttccgccgcccgcctgctgccttggggtatcgagagggaatgagggatgggaggtagagtggagaggacggaggtagaagataaggcatgtaaccaaataaaatttctgtgcattgacggagtaagtagtgcatatctttgatttcaacaaaaaaaaaaaaaaa

SEQ ID NO: 6077 - DNA, 2363 bp, Oryza sativa
  Predicted polypeptide sequence is orthologous to G1435, G2741
ggccgacgcgccattgccctcgtcctcttcctcttcctcttcctcgtcgtcgtcgtcgccgagccgtcgcatggtggacgccgctgcggcctccggggacgcgtgcggccgcgtgacggagtgggagaccggcctgccggctccaggcgagatgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaagctttatattttgcaaatttttttccccaaaagatagccaaaatcagatagtacgttttttttcctttttttttctcatattttcgaggatccaagtagatatattgagtatttaatttcgtcaggaatcaagtgaaaccaatcaaagaggtacaatatattgaactcctgtcgtctgcaaaatcgaaatttggcttaccgtccgatggcaagttgagggatagtacatttcaagtacagttatgcacatatcgggaacaagatatagaccacactaaaatgccgctccttgcaaaaatttatcaaaccattgcatatattagttttctcttggtgatagagttcattcttttcggtaccagtgttgtcctcctggcgaaaatgtttttagccacagacatccttgggccgtttagctagaattactctcttttttttttctctgcgcttgatccgtatagaatgtttgttgtttatacttttgtaaatataatacttactactagttacgagtactatattatattaaaaaaaacttaacgtttacatgtcttccttctttcttctgtaacttaaaagccaacttttatgtttggcatacatatccattgttgtcgcaaccaaaattcattagttagatagcaaaatatagtagtttctgttttcagtaacgcgatgatagactattgaaagcaactttatgctcacaccaccttccctttaagagcaatttaggtatttaagttctttgaaggaactgctgtaatgatacccagttgatgattgaatggtggtggggttatctgtaatgtgcttccttgaatcagaagacttgggtatatggttaggagtacttccctcccttgccaccaccttgatgttgaaatggactgcccatttcaatgattatttgatgctttctggggcaatcaatcattgttagaggaattatttgttcctagcatgatttatactttaatataattaatattagtaaaggtcagcactatgttaattccatggtttgggggttctggcttctagcagtattccccacattcatggagctagcaaaggcatatgtctaaccttttactatgtgtgttcactcttaatagttgatacagtttctgaattgtttcctcgttttattctaactggttagctagctcaaggctagagaaggaaatgcaccaagagtgaattatattcagaagttgtgtctcttaagaattaggggacagaacatacaatatttttggatcatttcaagtgcatgctttccatgcatgctcccatcaaaagggataacgagacttgtccacgaggctacgacgcaaaactcggctaaaataaatatggaaatgctgctcatatccaagaacggcctcaggaaagatgcaaagtttttttctgtgtgagctgctaatgctcgaggtattgtctgaaggctacaggcacaataaggtttaccaaaggaattgtaattaggtttcctctgatctagattcagtttcaaattcatgcagcgtgctgtatcaaatgctgcctagatgtaacatcatttttcctcatcatgtatgtgtaagatgctactctttctaacctggtgacatcggcaaagctgctcccc

SEQ ID NO: 6078 - DNA, 579 bp, Oryza sativa
  Predicted polypeptide sequence is orthologous to G1435, G2741
atgacgccggtctcgcaccagctcgtcccgccggcgctcgccgccgccttcgggatcgacctcgcggccgtgggcgtgctcctcccctctccctccgtcgactcccctgtctcccacctcttcttccccgtcgacgaggacgacgacgaggatgaggagggggagggcgaggggggtaacgatgacgcccccgccgccgccgccgcgggcggcggcggcgggaggtgcgggaagaaggcgaggatggtgtggacgcccgagctgcaccaccggttcgtcgaggcggtggcgcacctcggcgagaagggcgccgtgcccaaggccatcgtgcgcctcatgaacgtcgacggcctcacccgcgagaacgtcgccagccacctccagaagtaccgcctctacctcaagcgcacgcgcgtcgccgccacgccgcctccttctccaccaccacctcctcctcctcctccgcccctgccgccggcgatgtacgtcccctgcttcgccgcgaaaccacctctcgacgcagctaaccgcagcgattcccctccttccagaacctcggacgcaacgactaagcagtaa

SEQ ID NO: 6079 - DNA, 1243 bp, Oryza sativa
  Predicted polypeptide sequence is orthologous to G1435, G2741
ccacctcgactcaactcaactcgcacaaatatcttctctcttctcacccaccgcccgattcttcgagtccccgatttggttcggcctgaagaagggtctgggtctctctagagagtgagtagccatcgatttgagatttgattagtaattcggaggaggaggaacgagtggtttttttgatttgatttgatttgattgagaagaaaatccgagtattatgggcgaggaggcgccggaggagtacgagctgggcggcggggaggacgagcgggtgatggagtgggaggcggggctgcccggcgccgacgagctgaccccgctgtcgcagccgctggtgccggcggggctggcggcggcgttccgcatcccgccggagcccgggcgcacgctgctcgacgtgcaccgcgcgtcggcggcgacggtgtcccggctgcggcgcgcgtcgtcgtcgtcgtcgagctcgttcccggcgttcgcgtcgaagggagcgggagcgggagcggacgaggcggagtcagggggaggcgcgaatggggggaacgggaacaccaacaacaacagcagcaagagggcgcggctggtgtggaccccgcagctgcacaagaggttcgtggaggtggtggcgcacctggggatgaagaacgcggtgcccaagacgatcatgcagctgatgaacgtggagggcctcacccgggagaacgtcgccagccacctccagaagtatcgcctctacgtgaagcggatgcagggcctctccaacgagggcccttccccctccgaccacatcttcgcctccacccccgtcccccacgcctccctccacgaccaggttccttctccttaccacccccacccccaccaccactcctacaacaacgccgcctatgccgccaccgtctcctcctaccaccactaccaccacgccaaccactgatccattccttctcatcatcatttcatttccacatctatataccacatactactccataacgaaggtgtttcatcaataagagaagagaagagaagagaatgctccctcaactgtaaactcctaattctaattaagggcaaagtgtatccatccatccatccacgctgtttgtttgtagctgttgttaattgagctggatgcatgacatgtatctctatgtacctacctgcgtgacaaaggcatcatgcatatgtatggttcccttgcaatttggggaatccagaaatgattcatacttgtgattcttgc

SEQ ID NO: 6080 - DNA, 873 bp, Oryza sativa
  Predicted polypeptide sequence is orthologous to G1444
atgaggatcaggaggcggcctcagtccctgcaggctctctcctccctgcatccctcctcagatccatccactgctccccagcctccaccaagaaaccatggacgttactggctctcggtagacaaggtggatgaggaggagaagaagtcggagcggttgcacttgcacccaaatgcggatcttgccgacgacgactcgtcggcggcgatgcgcgcggccgcggcattgccgttgttcccgcaggacaatgcggttgtggaatgcagcaagatcaggccccgtggtggtgcacagcagggagcagcagatggtcacaggagcctagagaatggccattacagcaagcctgatccggcgatcaggagtactacaggagagcgtctcgtcaacggcgtcgtccgggcaatgccagtggccgcgaacgcgaaggaagagaccaagaacgacggcggcggcggcggcggagccaagaagcggcgtggcccggcggtgctgatggaggggtcacgttgcagccgcgtgaacgggcgcgggtggcgctgcagccagccgacgctggtcggctactccctctgcgagcaccacctcggcaagggccggatgcggagcgtcaccggcggccgcggcggcgccggccagctcggccgcaccgagccgaggaagaacaccgccgccgccgctgtcgccgcggcgcccaaggcggcggcggcggtggctgagccgccggtggtggtggtggtgaatcatgaatgtgaattccatgttccgttttctgtgaattgcaaattccatggcgtcttcgtggaagaactggaagatcacactgcagatgatctgctcttgaccagaatttcccgtgatagattccattga

SEQ ID NO: 6081 - DNA, 1566 bp, Oryza sativa
  Predicted polypeptide sequence is orthologous to G1446
ggcacaaagtctgaggcggaactaacccaccaatccgccaccaacccagagcgccgagaagcccaaccgcggcgagcagtgtgccacgggccggcgcgccggcgaactcctcctcctatgctcgccgccggcgatgcccagcccgctgaaggagcgacccgccggccgactcggccgcctcctcgccgcgctccgcccggcgcgcgctggcccgctccccgtccagacaggcttccccacctccctcgctgacctcgtcgtcaagaaccatggccgcctcaagaagccctccgcctcggcgtccaggcgcaagaagcgcggcgggccggaggctcccccctcgccctcgccctcgccctcgccttcccctccgccgcagccttcctcgccaccaccaccaccaccatccccgccgcctgcggccgctgtctcggtctcgccgccaacccagccgagaccgagaccggaacttccgccggtggaggccgtcctccgccgccagcccaagggccgcgtgttcggccttgggctggggttcgtctcgctcgtcggcgtggtgtcgctcgccctcctcgtgatctggagcaagaaggtggtcgcggccgtcaccgtcgcctccttctcgctcttcctgctcgagtccgtcaggtcctccgcgctttcccggcggccgcggcggccggcggcgaacaacaagctggatttggacgggcgcggctacgtctcgccgatccgggaggtggagccggcgagggcaagcttctccgattcctccaggcgaagcgagttatccatcctcaccattgaggagagaagcgaggtaggcgacgattcgatagtcgccattgaggagagaatcgcggcaggcggcgacgactcaagcaacgccaaggtcaagaccaagaaacggtcatggaggaagctgattccccgcaagttacagaagggcatgaagggcaaggaggcggaggattcgtcgggttctttccgcagcagcgaaggcaaccgaggtgacgccacggcgacggattcctcggactctcgccgtggaatgcgcaccaaggccgcggacgccttcgtcgccagatcgatggattcttcgccgtctttccgcgggaacggaggcgacacggacgccgacgcttacagcaatgccacgcgggtagaaatcgacgcgccggccgatgtcctcgccggagacggcgacgccgtgggagggacccggtcctccgtcgcgctcctggtcgttgccgtcgttctcgtaggcctcgtcgccggcaagctcccggccgtcgtgttcaccgtgctttgcggcgtgttcattagctcggttcagagattgccggcgggcggtgacggcaacggcgatcggagctttacatggtggtttaggatcaaacccaaagatgtaaattagtggcagaagaaaggggagagttgagtgacaaaagaaagaagcagcaaatacataaatatttgttcttgttgctcgtgtcgttcgtgctttgcattcattccttactgaatcggaactcgaagtgcaatgttaacttaacaacgttatgt

SEQ ID NO: 6082 - DNA, 998 bp, Oryza sativa
  Predicted polypeptide sequence is orthologous to G1449
ggtggattgcagaagatgatgctgcagtgatcccgtccactagctggtgaattggagagacggatggagctcgagctcggcctcaggctcgcgctgccgtcgccgtcgccgtcgccggcgacggcgacggcggctgggagtgagcttgaccttctcaacagcgcgccggggtcctgccgcaagaggggcttcgaggaggcgctcggtgggttcaaaaccgacgacgacaacgacgacggcaatggccgcggcggtgacggcgattccgacggcgaaatgggcaacaagaggaggaagctggtggggtggccaccggtgaagtgcttgcaccggcggcgcgacggtggctgcggtggcggatatgtgaaggtgaagatggaggggttggccatcgggaggaagctggacttgtccatcctcggctcatacgctgagctgctcgacacgctccaccttatgttcccctccactaaccaagaggatgggcacgatcgtcgtcgacgtcacccatacgctgtcacctacgaggatggggaaggagactggatgcaggtcggagacgtgccatgggaggcctttgccaagtcggtgaaacggctcaagatactggtgtaactgactgcaaattaagctactagtactagtctttactacttcgaataaaattgtacgtgaacgggattattttgttcacgtttctctcatcataaatgtgtagtgtttcagcaatttcataagcatgacgaatgaaatctcgtagctgttgtcatcaatcaccttgcatttcgtgtcaaactacatctgtggccagcgcacagtagtgttagtatagtgtacaccgtagagtcacctcgctgtgatcagcacgtgcatgcatctgtataatacaccgccacatatgcacaggatggtactgaatactgagcatatcctgtacggggagttcagatatgggtgttatggcctaccaaagtgaatcttatcacatttttttaatc

SEQ ID NO: 6083 - DNA, 3731 bp, Oryza sativa
  Predicted polypeptide sequence is orthologous to G1451
gaggaagctgcaagaggaactgaggaaggaagcaagaaagcaaaccaaaccaaaccaaaccaagaagcaaatctcagttgcaactcttgagctcagaagaagttgcaacagaagaaggagggagaagggaagcatctcagctagctaggcaggaagcatgctcctagcctccctctccggctgcggcggcggcggcggcggtcggatctgccggagagcggcggccggggagcccagagctgagagctaaccgtgcagacctcgcggccgcgagatctgaccacgcgactcctcggatcaagcggtgtcgcctcccgcagcagcatttccccccccccccccccccccgaagatcacagcctttttttccactggttcttgctggtcttggaagtggggaaaaaaaattctcatcacctcgtcgatggagaagcttacgacgcttgctcggtagatttgatttttctttttcttcttcttccgggggaagcgtaattgcgaaacagcgaaagaagaagtgttggtgagttggcgaaactgagaaagcgatggtttttgggaaggcgctgtgatttggcctaaaaaggaggaatctttccttcgttctctccttccttccccagcttcgtgcacgctcttatattgcatttcagatcggtcttgtgattggtcttttggagagagagagagagagagaagaaaaatgaggctttcgtcgtcgtccggcagcgtcctcccggctcaggcggcgtcgccggaagctgtagaagaacaaaatgcctgaattcggagctctggcatgcgtgtgccggtccccttgtttcgttgcctgcagtgggtagccgagtggtttatttcccacagggtcacagcgaacaggtagctgcatcaacaaataaagaaatggagtctcagatccccaattatcctaacttgcctccacaacttatttgccaacttcacaatgtgacgatgcatgcagatgcagaaacagatgaggtttacgctcagatgacgctacaaccacttagcccgcaagagctcaaggacccatatctaccagctgaattaggttctgccaacaaacagccaacgaattatttttgcaaaacattaacggcaagtgacacaagtacgcatggcggattctctgttccccgtcgagcagctgagaaagtgttccctccgctggattttactcagcagcctccagcacaggagttaattgcaaaagatcttcatggcaatgagtggaagtttcgtcatatctttcgtggtcagccaaagcgacaccttctaactacaggctggagcgtctttgtaagtgcaaagagacttgtcgccggggattctgtcctatttatctggaatgacaacaaccagcttcttctgggaattcgtcgagctaaccgcccacaaactgttatgccatcttcagtcctatctagtgatagcatgcatattggtcttcttgctgcggctgctcatgctgcttcaacaaatagccggtttacaattttttataacccaagagcaagcccttcagagtttgttatcccactttctaaatatgttaaggctgtatatcatacccgtatatctgtgggcatgcgtttcaggatgctttttgagacagaagagtcaagtgtacggagatacatgggcacgataacaggaattagtgatcttgatgctgctcgttggccaaactcacattggcgttctgtaaaggttggctgggatgaatcaactgccggagagaggcagccaagggtgtcgctttgggagattgagcccttgacaactttcccaatgtacccatctccttttccactcagactgaagcgtccatggccaacaggcttgccttcattacatggtggtaaggatgacgacttgacttcttctctcatgtggctccgagacagcgcaaatcctggtttccaatcattgaatttcgggggtctcggtatgaatccttggatgcagccaaggtttgatgcttccttacttggtctgcaacctgacatgtatcaaacgatagctgcgactgctttccaggacccaacaaagcaggtctctcccacgatattgcagttccagcagccgcagaacataggtggcagagctaatacacttctgccaagtcagattttgcagcaagtgcagcctcagtttcagcagcagcaatacctccaaaacatcaacgagaccacaatccaagggcatgctcagtctgagttccttcagcagcagctccaacgctgccagtcgtttactgagcagaagccacagctgcaaacccagcaacaacagcaagaatcacagcaacaacagcagcagcaatcgcagtgtatgcaagtcccacaacatcagcaaatgcaacagcagaagaacatgaccaactatcagtctgtacctaatgcattgtcaccgttttctcaactctcctctccttctcagtcttcacctatgacactgcaaacagtattaccattctcccagccacagagctatccagacacgagtatgagctcattatcaccatccaacacatccaccatgcataatgcattgaggccattttcatcggaagcaccttcgcacctaagcatgccaagaccgactgcagtacctgtccctgacccatggtcatcgaagcgagttgcagtggagtctttgcttccctctcgtcctcaggttacatcgcagatggagcagttggactcaacagcacctagtataccacaaagctctgcgttggcgccgcttcctggaagaggatgcttggtggatcaagatgggaactctgatcctcaaaaccatctgttatttggcgttaacatagattcacagtcacttctaatgcaaggtggcatcccaagcctccagggtgagaatgattcgacggcaattccttattccacctccaatttcctgagcccgtcgcagaatgatttccccttggatcaaacactaagtagtgcagactgcttagatgaatcaggatatgtgccgtgttcacagaattctgatcaagtgattaatcgaccacctgcgacctttgtgaaggtttacaaatcgggaacctatggaaggtcacttgatatcactagatttagtagctatcatgaacttcgtagagaactagggcgcctatttggccttgagggccagttggaaaaccctttgagatcaggctggcagcttgtattcgtcgaccgagaggatgatgtcctcctcgttggcgacgacccttggcaggaattcgtgaatagcgtctcctgcataaagatactttcaccacaggaggtgcagcagatgggcaagccctttgagcttttgagctcggctcccggaaagaggctaggtagcagctgtgatgactatgtgagcaggcaggaatcaagaagcctgagcacaggaattgcatctgtcggctcagttgaattctgaagcaagggcgctaacgagcccttcaatcaaatctagcctgttacctatgtttctgcagtttttcttcccctagttttgagacctggaactgaaagaacatagatccatgcttagctaagttatgtaccatctaataattatgctatatgatatcaaattccaagtagaaactatcaacttttggtatatatatatataccaaaactttgttccatgaaacactaatcctgtgaatgtaggccatctaaattatcaggctcaccgcgaagtttagc

SEQ ID NO: 6084 - DNA, 3262 bp, Oryza sativa
  Predicted polypeptide sequence is orthologous to G1451
gtcgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagggaaagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaagagaagaagtgcctcaactcggagctatggcacgcctgcgccggcccgctcgtctgcctccccaccgtcggcacgcgcgtcgtctacttcccgcaaggccacagcgagcaggtggcggcgtcgacgaacaaggaggtggagggtcacatcccgaactaccccaacctgccggcgcagctgatctgccagctccacgatgtcacaatgcatgcggatgtggagactgacgaggtgtacgcgcagatgacgctccagccactgaacccacaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggatttcacacagcagcctccagcccaggagctaattgcacgggatattcatgacatcgagtggaagttcaggcacatctttcgaggccaacccaaacgacacctgctaaccactggctggagcgtttttgtcagtgctaagagacttgttgctggagattctgtgcttttcatatggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccgggcaagtccatcagaatttgtcataccactgtcaaaatacatcaaggctgtttttcacacccggatatcggttgggatgcggttcaggatgttgtttgagactgaggaatcaagcgttcgcaggtatatggggactataactgaagttagtgatgcagacccagtccgttggcctagttcctattggagatctgtgaaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatgatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaactcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgctatacaacagcaactccagcaactacagcaaatgcagcaagttcagaatgatcagaagcagaagattcaaccagatcaaagctaccaagttcctacaagtgcagttctcccaagtccaacatcattaccgagtcatttgcgagaaaaatttggcttctctgatcctaatgcgaattcttcaagcttcatcacctctagcagtagtgataacatgttggattcgagcttccttcagggaagttcgaaagctgtggacttatctcgatttaatcagcctgtagctagtgagcagcagcagcagcagcaacaggcatggaagcagaagtttatgggttcacagtcagtgtcttttgggggctcggttttgcataactcacccacaagcaaagatggttctgttgaaaacaaaattggtcgtgatgtgcaaaaccagtccctttttagtccacaagttgactcttcatccctcctgtacaacatggttcctaatctgacttcgaatgtttcggatggcaacttatcaacgatcccttctggatcaacttatctgcagaatgcaatgtatggttgcttggacgactcttctggtttattgcaaaatacaggagagaacgatccagcaaccagaacatttgtgaaggtttacaagtcaggttcggttgggaggtcgttggacataacccggttctctaattatgctgaacttcgagaagaactgggtcagatgttcggcattaagggtcaattggacgaccctgatagatcaggctggcagcttgtattcgtcgacagggagaatgatgtgcttctccttggagacgacccttgggagtcctttgtgaatagtgtatggtacatcaagatactttcacctgaggatgtgcataagatgggaaagcaaggaaatgatccacggtatctgtcctgaagtgagagaacatggtgccatttctgggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcaataatcgaagcgcacgaggattgtttcaattcgtgttgtaggatctggattttcaccgattgtccggttatgtcagtttcgagaggagctgtcaatctg

SEQ ID NO: 6085 - DNA, 3885 bp, Oryza sativa
  Predicted polypeptide sequence is orthologous to G1451
gagctcacctccactcgtggggttaaaaccccgagaactgcacagcagcagcagcacacggcgcagcagcggcaaaggcggcagcagcagcagcagcaagaaccgagcaaagtcgcaagaagcgagcacacacactcctctctctctctccctctctagctactgttgttcttggagttgtagaggaggaggaggtggtggtggaggtggtggagatagggggaggatgctgatgctcctagtcctatcctagttcgtcgtcaactccggcggcggatctgcggtggagcggcggctggattgtcgagcggtgagggtgacacgcatctccggagctcgccgcaggcgggagggatctgaggcgcgtttcttaatttgccttctctttgagctagctgcaaaggcggcggcgtgcggcggcggcggcgtcttggcgcgcgcattctatccggcgagtcgacgacgacgacgaccttcgcgccggtgtagcggcgcccgtgatgtgaaggaattcgagctcgctcccttgggatcgaaaaggttgcgggttggagaggcaagaaggtttggccggtttggggaaggagagaaagcgatggtggtggtggtggtggtggtggctgggttgcttgctccatgacacgacagcgcgtttgggaacgcctcgtgatctcggtgcagaaaggattccttctctgctccatttcttgcactctccactttgcattctagatcggttgggggaagaagaagaagagaagaagaagaatgaagctctcgccgtcggccggcggcgtctccgaccagccgccgtcgccgccggaagttgcagaggagcagaagtgcctaaattctgagttgtggcatgcatgcgccggccctctcgtttcgctgcctgcggtcggtagtcgggtggtttattttcctcaaggccacagtgagcaggtagctgcatcaacaaataaggaaatggagtctcagatccccaactatcctaacctgccgccgcagcttatatgccagctacataatgtgaccatgcacgccgatgcagagacggatgaagtctatgcgcaaatgacgctgcagccactcagcccgcaagagctcaaggatccattcctacccgccgagctaggcactgccagcaagcagccaacaaattatttctgcaaaacgttaactgctagtgacacaagtacacatggtggattctctgttccccgtcgagcagcagagaaagtatttcctccgctggatttcactcagcagcctccagctcaagagttgatggcgaaagacctccatggaaatgaatggaaattccgtcatatctttcgtggccaaccgaagcggcatcttctgactacgggttggagcgtctttgtaagtgcaaagagactggttgctggagactctgtcctttttatctggaatgacagtaatcagctgcttctgggaattcgtcgggcaaataggccacaaacggtcatgccatcatcagtattgtctagtgacagcatgcatattggtctgcttgctgcagctgctcacgccgcatcaacaaatagccggtttactattttctataatccaagagcaagcccttcggagtttgttataccactggctaaatatgtaaaggctgtctaccatacccgcatatcggtgggcatgcgtttccggatgctttttgaaacagaagaatccagtgttaggagatacatggggacaataacaggaataagtgatcttgatcctgttcgttggatgaactcacactggcgctctgtcaaggttggatgggatgagtcgactgctggagagagacagccaagggtgtctctttgggagatcgagcctctgacaactttcccgatgtatccatctccttttcctctcagactaaagcgtccatggccaacaggcttaccttctttatatggcggaaaggaggatgacttggcttcttctcttatgtggcttcgagatagtcaaaacacaggtttccaatctctgaattttggaggacttggtatgagtccgtggatgcagccaaggctggatagttccctacttggtctgcaacctgacatgtaccaaacgatagcggcggcggcggctttacagaacaccactaagcaagtatcacctgccatgctgcagttccagcagccgcaaaacattgtcggtagatcttctcttctatccagtcagattctgcagcaagcacagcctcaatttcagcagatgtaccaccaaaacatcaatggcaactcaatccaaggccatagtcagcctgagtacctccagcaaccgcttcaacattgccaatcatttaacgaacagaagcctcagttgcagccgcagcaacagcagcaagaatcacaccagcagcaacctcagcatcaacaaatgcaacaacagaaacacttgtccaactttcagactgtaccaaatgcattgtcggttttttcacagctttcctccacccctcagtctacaccctccacattgcagacagtttcaccattctcacagcaacataatttccctgacacaaatatcagttgtctctctccatccaatgtctcatccatgcacgatacactgagatcattcccttcagaagctgcttcagacctcccaggtgtgccaagaatcacccctgtacctgtctctgacccatggtcatctaagcgagttgcagtggaatctacgatcacttctcgcccacatgacatttcatcacagatagagaacttcgacttgacaccttctagtattcctcaaaactccacgttagcaccactgcctggaagggaatgcctggtggatcaagatgggagctctgatcctcaaaatcacttcttgtttggtgtaaatatagactcacagtcacttttgatgcaagatggcattccaagccttcacaatgaaaacagttcaagcacaattccatattccacatccaacttccttagcccttctcaagatgattatccattgagtcaaacactaactactccgggctgcttagatgaatcaggatatgttccatgttcagataatgctgatcaagtgaagcgaccgcatgcaacctttgtgaaggtttacaaatctggaaccgttggaaggttgctcgacatcactagatttagcagttatcatgaacttcgtagtgaggtagggcgcctttttggccttgagggccagttggaagaccctttgagatcaggctggcagcttgtatttgttgaccgagaggacgacgttcttctagttggcgatgatccgtggcaggaatttgtgaacagtgtgtcttgcataaagatactttcgccgcaggaggttcagcagatgggcaagccgggcattgaactcttctcgacttctgcaaggagacttggcaacagctgtgacaactacatgagcaggcaggaatcaagaagcctaagcactggaatcgcgtcggtgggctcagttgagttctgagaaatagggagctcatagcacccggcgttaggcgtccagttctgtacgtctctgtagctcttagttctgtgacctggaacccaagcacataggtcaagtgtagctctaagttatgcgctgtctggtaattatgtcatattacattgacttttagtggtacctattacattttggtatacatgccgacactttgtttcctggaatactgatcatgttaacttagggcatctaattattaggttcatgttgagtagtgctgtagtgccgcaggcgctagctttggccatattctgtatattgatgatgttttcctcctgcaatgtactgttaatgacagcaagtaaggttttccatgcaactgtgaaaattcagttcaagaactattgagct

SEQ ID NO: 6086 - DNA, 3878 bp, Oryza sativa
  Predicted polypeptide sequence is orthologous to G1451
ggaagaaaaaaaaaactcgaccaccacctccaccactcacacctcgatccggccatggcggcctagccctagcacctagggttcgcgcccccaccaccctccccgccgtctcggaggccgcgcgcccccagctcccgcctcgctgtcgcgccgcctgattccgccgccggcgccgaatgctacgccgtttggtggtggtggtggtcgtcgtcgcctgattccgcgatctcgtgagctccggggggtgcgcggttgcggcggcggcgcctgagaggaaggctggactcgtccgcggcggcggcggctgcgggctagtgtcggtggcgatttgagggcggcggtttgggttagccgtcgccgagagtgaaggtgctgtgttttgagtgcttgggatgagctgcgtgttgatctgatgaactcggggtcggcggcgttcttcggtttctccgctcacttgctcccgccgttggcgaaaatccggttcttcggatcgagttgcggtcgcctgggtgtttttcatcagttttgggtgaaaatactcgagctctgaggggggtgattggtttccaagtttgattgatttaaagagtttgtgtggaattttttcggggagatgaaggggaggatttgctgcgacggtccaggttttggttagttgttgagggagaaaaaaatggaagatatttctgggcgcaagagaggaaggcaggtgtttgctgctgctgctgggagcatgatgggaagctgaccagcagcttctccagtatcctggtgcggcggagtttcgtgctctttggcgacgggtgcactggtgattggagatgaagctctctccgccggcgtcggcggatatgccgcaggccttgccggagaacgacggggaacaaagatgtctgaactcggagctgtggcatgcatgcgctgggccccttgtgtctttgccagtggtcaggagcagggtcgtctactttccacagggccatagcgagcaggttgcggcatcaactaataaggaagttgatgctcaaatcccaaattatccaaacttacctcctcagttaatctgccagcttcataatgtcaccatgcatgctgatgcagagacagatgaagtctatgctcagatgacattgcaaccattgagcccggaagagcaaaaggagcctttccttccaatggagttgggtgctgctagcaagcaacccactaattacttctgcaagacattgactgcaagtgacacgagcactcatggtggtttctctgttccccgccgggcagctgagaaagtcttccctccactagatttttcacagcagccttcggcacaggagctgattgcaagagatttgcatgataatgaatggaaatttcgccatatatttcgtggtcagcctaaaaggcatctcctgacaacaggctggagtgtgtttgtgagtgcgaaaagactagtagcaggagactctgttatatttatctggaatgataacaatcaacttcttttgggaatacgtcgtgcaaatcgccaacagactgttatgccctcttccgtgttgtcaagcgatagcatgcatataggtcttcttgcagcagcagctcatgctgcagccacaaatagtcgcttcactattttctataaccccagggctagcccttctgaatttgtgattccattggccaagtatgtgaaagctgtttaccacacacgtgtatctgttggaatgcgttttagaatgcttttcgagacagaggagtcaagtgtcaggcgatacatgggtacaatcaccagcataagtgatctagattcagtgcgctggccaaactcacactggcgttctgttaaggttggttgggatgagtccaccactggtgataaacagccaagggtttctctttgggagattgagcctttgacaacctttccgatgtaccccagtgcttttcctttaagacttaagcgtccgtgggcttcaggactgcctatgcatggcatgttcaatggtgggggaaatgacgattttgcacgctattcttctctcatgtggcttcgagacggaaatagaggaacccagtccctgaattttcaaggacatggagtctcaccatggcttcagccaagaatagattctccattgctgggccttaagccagacacgtaccagcaaatggctgcagcagcactggaagaaattcgatatggggacccttcaaagcagcatccagctactctgcaataccaacagactcataatctgaacagtggattaaattctctgtttgcaagccatgttctagggcaggtgcagtttcaacctcagcagtcacccctgcaagttgttcagcaaggccattgtcagaacactggtgactctgggttccttcaaggtcagcttccacggctgcagttgcataacactcagcagctgctaaaggagcaagagttgcagcagcagcaaagacagcatgttttacaagagcaatctagtcaagagatgcaacagcagctcccatctagtgatcatcatgttgctgatgtagcttctgagtctggatctgctcctcaggcacaatcatcattgcttagtggatcatcattctacaatcagaacctcttagaaggaaatagtgatccccctttacatctacacaacaatttccacaacttctctaaccaggaagcctcaaaccttcttattttgcctcgaagtagccaattaatggcatcagatgggtggccttcaaagcgattaactttagaatctgctgttcatcctgaagctccgtccatgcaccccaagattgagaaagtaaatcaccagggtatatctcattttcctggcgcctttccaccacaatcagcaagaggctgttccatcgtccaggattgcagggcagatgctgagaaccgcctactttcatcatcatttgaactccaggatggcatgacaagcatcataactgatgctaacagagaaactgatactatggccatacctttgttgagatatagtggtgcagatttgacaactgaaaacaccttagcaacctccaattgtttaggtgaatctggaacgttcaatcctcttaataacatatctgtaaatccatcacaaggagcaacctttgtgaaggtttacaaattagggtcccttgggagatcacttgacatctccagattcagcagctactgcgagttacgtagtgagcttgagcgtctctttggtcttgaaggccaactggaggaccctgtaagatcaggctggcagcttgtatttgtcgaccgggaaaatgacattcttctcgtcggcgacgatccatggcaggagtttgcaaatagcgtatggtgcatcaaaatactctcgccacaggaggtgcagcagttggttcgtggtggagacggccttctgtcctcacctggagcaaggatgcagcagagcaatgcctgcgacgactattctgcaagccacaacatgcagaatatcgccggaaacattgcatctgtagcgcctctggactactgagatgtagaccagaatccaaactaagcacccttaagactgcagggtcaccattcgtgatcgcctgcattccatgcgatcttcactagtcctgtccgaatcagtagcaactcagtcaataatatagctagatgatccgttgtattccatctgatcatggacatgctgtatgatagctgctttagctctattaaatctctaatggcaggcaactaggcaagaacagttctatgatgaatgatggcagtcgctgtagaattgaccttattctgtagctataatatgatgtctagaactgatgattccaatttccaaatggagcccggaacatattaaaatcaatcatttgtcgccttcttc

SEQ ID NO: 6087 - DNA, 2145 bp, Oryza sativa
  Predicted polypeptide sequence is orthologous to G1468
gaggttcaggagaactcgcggcattgctgcgatcgtgagttcgtgacaccggacggaggcgcgcacttgatcggcgctcccatctccaggtcgaattcgattccgccgcggcgaaccaagcgcatgcatgtgtgaatcttcaccgtctttgcatcatggccagatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtttgccatcgactgttcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtgattgatctgcgaattgatcagtacatacatatatactgttacattatttccatgcgtttgcaattgcatatatgttgttcgcatgagcatataagtatttgccttcttttttgtgactttttcttttcttttagacttgtaggtttttttttcttctcaagatagtgagtatgttttacaaagaggtaacatatgaatttgggaagaggcagtagacttgtaggatttttttttcttctgaagagaagcaagtagtgagtattttttcacaagaggtaatgtattaatctgtcaagctgcgtgatc

SEQ ID NO: 6088 - DNA, 1701 bp, Oryza sativa
  Predicted polypeptide sequence is orthologous to G1468
atgtgtgaatcttcaccgtctttgatgcagccgtcgccgtcatcacctcgggcaccgccgccgacggcggcgcaggcgtcggggtacaagcacttctgcagagtctgcaacaaggggttcacgtgcggaagcgccctaggcgggcacatgagggcccacggcgtcggcgacggcgatgggttgggtgccgatgatgacgacgacgacgacgacgattcgctcggcgatgaggccgtgcggcgtgcgcgcggcggggcagatgatccttggaacgcgggcggcccgtcgtcgtcaggggcagcgacacacgtctacgagctccgcaccaatcctaaccgggtcacgaggagccgccaggtgtgcaagaactgcgggaaggagttcacgtcgtgggagcatttcctcgagcacggcaagtgcagctccggcgaggacgacgacgacgaggacgacgtggatcactcgctgcaaccgtggtcgccttcgcccgaggccgacggcgaagaggattctgcaccggccgccggttggttgaaagggaagcgctcgcgtcgctgcaagggcacaggagtcgatttgtcaccgacaccctcagcgtgcgctgccggcgaggaggaggacctggccaattgcctggtcatgctctcgtcgtccaaggtagatcaggcaggcgtcactgaagcagaacaacggtcatcttcttccgcgagtaaggaacataagagactgatcacgttcatggagccgacgacgtatgtactggatacagtgatggcgcttcccccgccggcgccggcgccacagtatgtctcgaccgtgcctcgaggcatgttcgagtgcaaggcgtgcaagaaggttttctcttctcaccaagctctcggcgggcaccgtgccagccacaagaaggtgaagggctgcttcgctgccaagctggagagcaacgccgcagaggtggctgagccatcacaccatgcagaggtcgctgatcggagcgaggacaatcccgccaaggccacttctgatgccaggaggaacgtgcacgcaagcatcgacggtgatggaaacgccggcacgagcgatgccgcggcagaactgtcgatggccatcgtgcccatagaaccgccggtcgccgcgctcgccgctgcaccgttgaagaagaagggcaagatgcacgaatgctcggtctgccatcgactggtcacctccgggcaggcgcttggaggccacaaacggtgccactggctgacgtcaagttcggcggatcacaccgcctcagtcccacccctagccgacgaccttgtcccgctctcgttccggccaatgttggacgcaccggagcccgctctcgacctcagcatcgcggcgaacccgccactgctggcctcggccgcaacagtccgtccgaaggtcggcggcagctcgtttcatctcgacgcgccaccaccggtatacatcccatcgtcgccggcgatacccagccaacggaacaaggctaccgcgacaaccggcagccagaacgccaacgacgcggtcgggttaagcaccgccgcagcagaggacgaggcggacagcaccaccgtcaagagagcgaggcttagcgatctcaaggacgtgagcatggcaggggagacgacaccgtggctgcaagtcggcattggctcctcgtctcgcgggggtgctgatgataacgacaaggagtga

SEQ ID NO: 6089 - DNA, 312 bp, Oryza sativa
  Predicted polypeptide sequence is orthologous to G1476
atggacggcgagggggcgccggcgaggcgggcgccggcggcgtcctactacgagtgcaccttctgcaagaggggcttcaccaacgcgcaggcgctcgggggccacatgaacatccaccgcaaggaccggagcgccggcggcaagtcgcagggcggcggccagcaccacgaaggcggcggcagcggcagcggtggcggcggcggccagcagcacggcagagatgtccacctgggcctcaccctggggaggaacgaggaagagagggacggcgtcgacctggagctcaggcttggccatgcccactatccttga

SEQ ID NO: 6090 - DNA, 724 bp, Oryza sativa
  misc_feature (620)..(620): n is a, c, g, or t
  Predicted polypeptide sequence is orthologous to G1480
gatgaataataccatatagttgtgatttattcgttggggggagctaatacaatatagatgatcttgctgatcaaaaaaataattaccactaagtagtaagcacgtaattagtagcagtagtagtgtacaaaactagcgtgagctagctcaaaatgagtactacatgggattactacgcccctacacatcgatcgatcgatttgatacaagattacaagcgacggcgcggcggcggtggccggcggcgggcggcgatcagaaggacgggacgacgccgtagccgaagtcgagcatgtaggaggatgggacggcggcggggtcgtcggcgtcggcgtcggcgtcgtcggcgtcgtggtcggcgcgcttggcgaagcggcccttgatccgggggcgcgtctcggcgtaggccttgcgcgacgcgtaccggatcgtcttctcgaaccgccggttcttccgcttctccctgtacctcatcagcctcgcctccctcccttcccccatcgccgccgcccgctccggcaccacgcccacgtcgaccaccgacgacgacatctgcgcgcttactacgctgtggctcggaggaggagtcgccgtgtacggcatgtagggttgaggcttcngcctcgtgaagtcgagcttcatgtccttcgcctccacgttgaggttgagcgcgccgtgctgctgccgctgctggtgggggtggtgctcggccgcggccttatcc

SEQ ID NO: 6091 - DNA, 1025 bp, Oryza sativa
  Predicted polypeptide sequence is orthologous to G1480
acaaacacacacaatttagcttagcttaagccacttgatctcaagctcaagcttaaaattagcttaagattaagccattaattagccaagctaactaagcaagcaagatcttgttgaggagatgatggcaagcgacggcagcgcgagcccggccagctgcggcggcgcggcgtgcggggtgtgcggcggcgcggcgacggtgtactgcgcggcggacgcggcggcgctctgcgtgccgtgcgacgccgcggtgcacgcggccaacccgctggcgtcgcgccacgaccgcgtgccgctcgcggtcgccatggcggcggcgagctccggggtgtacgaccacctgttcgcgcccgacgacgacgccgcctcgtcatgggctgccgccgcggcggcgggggcggcggtgcaggggcaggggcaggggagccccaacgacagctcgtcgagcttcaccaacgacagcgccgccgcctcctcgtcatcggacgacgacagcacggccgccgccggagtcagcggcgccggcggcgccggcgccgccgccacgaaggaggccaagttctggctctccttctccgacgacggccgcgccgacggcgtagggttctacatggacagcaccaccgctgccaccgcggcctacggcgtcgtgccaaccttctagaaagttccagaaacccctctcccaatgggcgccaacgcggcaacggcaatggcgttggcccgtcttaagacaaacattaagaaaagggcaacatgtcataatctcgccgtcatgctaatggtggcgcatggtgttcatgtcgtcgtcttcttcgccgtcgctttctgattccgtggtggaaacccgcatcactatttttaactgctgatgcgggttttcggtgggtggaattccaaattccatcggttaaaattagggggattattattaatgcattgtgacttttgtaagataactcatgtagttaatttctatggttcagtgctgaaataataaaaaaaatccaatgtgatttttctct

SEQ ID NO: 6092 - DNA, 1370 bp, Oryza sativa
  Predicted polypeptide sequence is orthologous to G1480
gcggcgcgtgcgcggtggcgccggcggcggtgcactgccggacgtgcgacggcgacggcggcggaggtgggtatctgtgcgcggggtgcgacgcggagcatgggagggcggggcacgagagggtgtgggtgtgcgaggtgtgcgagctcgcgccggcggcggtcacctgcaaggccgacgcggcggcgctgtgcgccgcctgcgactccgacatccacgacgccaacccgctggcccgccgccacgagcgcgtccccgtgcatccgatcgggtcatccgccgccccgccgccggacgcgctcctgctcggcggggagaacgacgccgctgccgccgtcgacggcggcggcggcggcaaggaggtgaagctggacttcctgttcgccgacttcatggacccgtacctcggcggctcccccgagctcgcgcgcttccctcacgccgacagcgtggtgcccaaccacaacggatcggccggtcccgcgatggagctgggcttcgccggtggcggcggcgccgccgtcaaaccgtcgtacagctcctacacggcggcttccctcggcaacagcggctcgtcgtcggaggtcgggctggtgccggacgccatctgcggcggcggcggcggcggaatcatcgagctcgacttcgcgcagtccaaggcggcctacctgccatacgcctcgacccctagccatagcatgtcctcgtcgatggatatgggcgtggcggcgccggagatgagcgactgcgcggcggcggcggccgggagggcgtacgcggcggaggggagagcggcgcggctgatgcgataccgggagaagcgcaagaaccggcggttcgagaagacgatccggtacgcgtcgcgcaaggcctacgccgagacgcgcccccgcgtcaagggccgcttcgccaagcgcgccgacgaccacgacgccgccgcgccgccgccgcagatcatgctcgacttcgccggctacggcgtcgtgcctaccttctagtgttctagctcatcgatctgaacgttttttgagctggcaaattgatcaagctggcgttgcatacgtacaacgtagtacttcaattcaccatgcataggattagccaaagttctagttgatcacaattcacaaacttgaaagttttttttacctagcctgattgagttttaggctagtttctgcaatcgtgtttgctagaacggctataactagttgtagttaatctggattttctgtatgtatggtgttttgtagtaccgatctgatgatgatgatgaagaaaaatatttgggcaaaatcgatcgatctcatccagtttctaattaacatgcatgcgatcgatcgattgcgcgcgagatctggattgagatt

SEQ ID NO: 6093 - DNA, 1388 bp, Oryza sativa
  Predicted polypeptide sequence is orthologous to G1480
gtgcccaacgcccaaaaaacacagccaaactccgcgagaaaccgagctgcgagcgagtgaaacgcaccacgcgccgagcggcaaagcgaagcgaagaagaaatggaggcggtggaggacaaggcgatggtgggagtgggaggagcggtggcggcggggtactcctcgtcgtcgtggaggttggggacgcgggcgtgcgactcgtgcggcggggaggcggcgcggctctactgccgcgcggacggggcgttcctgtgcgcccggtgcgacgcgcgggcgcacggcgccgggtcgcgccacgcgcgggtgtggctgtgcgaggtgtgcgagcacgcgcccgccgccgtcacgtgccgggcggacgccgcggcgctgtgcgccgcctgcgacgccgacatccactcggcgaacccgctcgcgcgcaggcacgagcgcctccccgtcgcgcccttcttcggcccgctcgccgacgcgccgcagcccttccccttctcccaggccgccgcggatgccgccgcggcgcgggaggaggatgcggatgatgaccggagcaacgaggccgaggcggcgtcgtggcttctccccgagcccgacgacaatagccacgaggatagcgccgcagccgccgacgcgttcttcgccgacaccggcgcgtacctcggcgtcgacctggacttcgcccggtccatggacggaatcaaggccatcggggtaccggtcgcgccgcccgagctggacctcaccgccggcagccttttctaccccgaacactccatggcccacagcttgtcgtcgtcggaggtcgcgatcgtaccggacgcgctgtcggcgggctcggcggcgccgcccatggtggtggtggtggcgagcaaggggaaggagagggaggcgcggctgatgcggtacagggagaagcgcaagaaccggcggttcgacaagaccatccggtacgcgtcccgcaaggcgtacgccgagacgcggccgcgcatcaagggccggttcgccaagcgcaccgccgacgccgacgacgacgacgaggcgccatgctcgccggcgttctccgccctcgccgcgtcggacggcgtcgtgccgtcgttctgaggaaggacgtacgcacggtacggcgagtcggcgacgtgcgccgtcgtaattttggcgcgccccgtgcgcgcgtgcatgcgtgcgtgtgtgcgacgcatggccccgtgtgacatgaataatatgtacagtagtttttcatccatggacgtagtattctattgtactccttgtactcctactactcctcttctgcctaaccaaggcttgtacattaccatgggagtagctgtttttgcaaccgtgaccatggttcagtgcttcaagttcaagggcgttaatgttactgtc

SEQ ID NO: 6094 - DNA, 861 bp, Oryza sativa
  Predicted polypeptide sequence is orthologous to G1480
atggggatggccaatgaggagtcgccaaattatcaggtgaaaaaaggcggccggattcctccacgatcgagtttgatttatccgttcatgtcgatgggaccagcagccggagaaggatgtggcctgtgcggcgccgacggtggcggctgttgctcccgccatcgccacgatgatgatggattccccttcgtcttcccgccgagtgcgtgccaggggatcggcgccccggcgccaccggtgcacgagttccagttcttcggcaacgacggcggcggcgacgacggcgagagcgtggcctggctgttcgatgactacccgccgccgtcgcccgttgctgccgccgccgggatgcatcatcggcagccgccgtacgacggcgtcgtggcgccgccgtcgctgttcaggaggaacaccggcgccggcgggctcacgttcgacgtctccctcggcgaacggcccgacctggacgccgggctcggcctcggcggcggcggcggccggcacgccgaggccgcggccagcgccaccatcatgtcatattgtgggagcacgttcactgacgcagcgagctcgatgcccaaggagatggtggccgccatggccgatgatggggagagcttgaacccaaacacggtggttggcgcaatggtggagagggaggccaagctgatgaggtacaaggagaagaggaagaagaggtgctacgagaagcaaatccggtacgcgtccagaaaagcctatgccgagatgaggccccgagtgagaggtcgcttcgccaaagaacctgatcaggaagctgtcgcaccgccatccacctatgtcgatcctagtaggcttgagcttggacaatggttcagatag

SEQ ID NO: 6095 - DNA, 1396 bp, Oryza sativa
  Predicted polypeptide sequence is orthologous to G1480
gtcagcctggtggggaggggaggtgggtcgccgaaagcttggctgagattcgcctcgcctcgccttctagctcgcggccgccgctagcgcgagtgagagactgagagtgagtgaggtggtgtggccatggagggggacgacaagtcggcggtggcgggaggggcgtactgggggctggcggcgagggcgtgcgacgcgtgcggcggggaggcggcgcggctgttctgccgcgccgacgcggcgttcctctgcgccgggtgcgacgcgcgggcgcacgggcccgggtcgcgccacgcgcgggtgtggctctgcgaggtctgcgagcacgcgcccgcggcggtcacgtgcagggccgacgccgccgcgctctgcgccgcctgcgacgccgacatccactccgccaacccgctcgcgcgccgccacgagcggctccccgtcgcgcccttcttcggcgcgctcgccgacgcgcccaagccgggttccggtgcccacggcggcgacgcggcggcggccgacgatgacgggagcaacgacgccgaggccgcgtcgtggctcctccccgagcccgaccacgggcagaaagatggcgccgtcggtgcaaccgacgagctctacgccgactccgacccttacctcgacctcgacttcgcgcgctccatggacgacatcaaggccatcggcgtccagaacggtccgcccgagctcgacatcaccggcggcaagctcttctactccgaccactccatgaaccacagcgtatcatcctcggaggcggcggtggtgccggacgcggcggcgggcggcggcgctccgatgccggtggtgagcagggggcgggagcgggaggcgcggctgatgcggtacagggagaagcgcaagagccggcggttcgagaagaccatccggtacgcgtcccgcaaggcgtacgcggagacgcggccgcgcatcaagggccgcttcgccaagcgcaccaagggcggcgcgggcgcggacgccgacgcggacgccgacgccgacggcgaggacgaggagatgtactcctccgccgcggccgccgtcgccgcgctcatggcgcccggcggctccgacgccgactacggcgtcgacggcgtcgtgccgaccttctgatcgatcgcaaccaaagccgctgtgtacactagcccttctcccccattgggctgtaattttgttgcatgcatttcgcgcgcgcgggaaatgctttctgtagcattaatcaattgtatgattattacacggaagtaatccggacttccaatctcctcttctctctctctactctgatccttccatccttgcatgtatattatcatcgcgaactgctgctaatctgcaaattgtaattttactaatcagtaatcagtacagtggtggttgc

SEQ ID NO: 6096 - DNA, 557 bp, Oryza sativa
  Predicted polypeptide sequence is orthologous to G1480
ttttttttttttttttttttttttcgggttccttacaacctacgtcaccttttcaatggtgcctaggcctcttgaaggacaatacaccaaggagaaaggtagtgtagaagcacagcagagtatataaaggatctttaaagaccacctagtccgttggcaggtcctgcacgcagctttcccttgtactcggcatgtaaaatagccttgttgcttactgcacaagttgcaccaatacattttgacgtatctatcagacaataatggaaacagttctagcccagcctatgtggtactaacttacctcttcacctgtatttccctgtattcggttgattgtcatgtgcacctcggtacgacttaaatcgccaggggctctattgagccacgcacatttctcaaatactaaaaaaaagtccgaagactttttctagtacaattcggtgtcccaaatgtagcatcatattcattggctccgaatcatgtctttgatcaatagtagggttgcccggatcctgtgattactaacgtacgttccaatcgttccgataaggtagtaa

SEQ ID NO: 6097 - DNA, 1380 bp, Oryza sativa
  Predicted polypeptide sequence is orthologous to G1482, G1888
gagcttattatatttccctccacttcgtcctcttcttcctcctccatccccatcctccatcggatgcactagtagctggccttgtaccctacctagcttagctacccacccatgtcctcctcctcgtctcctctcgctgtctgcctttgacttggagacctagctcgtcgatcgccggccatgcgggtgcagtgcgacgtctgcgccgccgagccggccgcggtgctctgctgcgccgacgaggccgcgctctgctccgcctgcgaccgccgcgtccaccgcgccaaccgcctcgccagcaagcaccgccgcctcccgctcgtccacccgtcctcctcctcctccggcgacggtggcgccgccgccgcgccgctgtgcgacgtgtgcagggagaagaggggcctcgtgttctgcgtcgaggaccgcgccatcctgtgcgccgactgcgacgagcccatccactccgccaacgacctcaccgccaagcacacccgcttcctcctcgtcggcgccaagctctcccccgccgcgctcgccgaacagccgctcccgtcctccgactgcagctccgacgacgacgccgccgccgccgccaccgaggaggagtaccactcctccgccgcatccaccggcgccgcagtgagcgcgcctcttgacgcctccagcaacggcgccggtggcggaggaggagtaggagggagcagcatctccgactacctcaccaccatctgccccggctggcgcgtcgaggacctcctccccgacgacgacgccttcgccgccgccgccgcgcaggcggggaaagagaaggacgagcgcgtgccgttcctcgacgccgacctgttcgacgtggtcgccggccggccggagaagaagggcggcgcgtgggcgccgcacgtgccgcacctgccggcgtggtgcctcgacgaggtgccggtcgtcgtcgccgcgtcggcggcgccagcggcgacacctgtaaaggcgaagcagggacacgtgcgggacagccactggagcgacagcgacgcgttcgccgtgccggagttctcgccgccgccgccgccggccaagagggcgcggcccagctcgcagttctggtgcttctgaacgccgccgccgccgtacaatctggccgccggcgagctcgacgaacacctcgatggatcgatcgaacacctgtgtaatcactcagctggtcactactacaagtagcaatcagcaagcttgatgtgccactgttactagctgctgctgtttaattagtgagtactaagctactactagttaattttggtgaaaactatgctactttgttactatataatgaagtatgtgtatcaaactaaactgagatgttggtaattaattatcgtattttgt

SEQ ID NO: 6098 - DNA, 1200 bp, Oryza sativa
  Predicted polypeptide sequence is orthologous to G1482, G1888
gatatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgttttttttctacgcaataacgagaatttttcctcttttccaatgc

SEQ ID NO: 6099 - DNA, 1220 bp, Oryza sativa
  Predicted polypeptide sequence is orthologous to G1482, G1888
accactcgtccactcctaataacctaccactctacttctccttgcaacatcgtcgttagtcctctaacccaaggcattgacctgagcttgttgtgcgcttctgccttatctgcatcccctcccggccgagacgcgaccatctttctttcccgcttcgttagctgtctctgccgatcgatcggactggacggggagacatgaaggtgcagtgcgacgtgtgcgcggccgaggccgcctcggtcttctgctgcgccgacgaggccgcgctgtgcgacgcgtgcgaccgccgcgtccacagcgcgaacaagctcgccgggaagcaccgccgattctccctcctccaaccgttggcgtcgtcgtcgtccgcccagaagccaccgctctgcgacatctgtcaggagaagagggggttcttgttctgcaaggaggacagggcgatcctgtgccgggagtgcgacgtcacggtgcacaccacgagcgagctgacgaggcggcacggccggttcctcctcaccggcgtgcgcctctcgtcggcgccgatggactcccccgcgccgtcggaggaagaggaggaggaagcaggggaggactacagctgcagccccagcagcgtcgccggcaccgccgcggggagcgcgagcgacgggagcagcatctccgagtacctcaccaagacgctgcccggttggcacgtcgaggacttcctcgtcgacgaggccaccgccgcctcctcctcctcagacgggctatttcagggtgggctgctggctcagatcggtggggtgccggacggttacgcggcgtgggccggccgggagcagctgcacagtggcgtcgctgtcgccgccgacgagcgggccagccgcgagcggtgggtgccgcagatgaacgcggagtggggcgccggcagcaagcgacccagggcgtcgcctccctgcttgtactggtgaaaaaaaaacgtgcgcttatcagccacagccagtacgaaatgtacgatgcttgtgtaccagtgtactgaggtagtagcgttagaagattaggaatttagtagtggatgttgattttgagcttaacgcgtgtcttggatgaatccctgactcctgaatgtttggggaattaatgtgagtggtagtgtcctctttgggcggcaaagaattatacgccccttgcgaacatgtcgaactgtacggtctgccatttaatctgcacgttcacccctc

SEQ ID NO: 6100 - DNA, 258 bp, Oryza sativa
  Predicted polypeptide sequence is orthologous to G1482
atggtgatccagctggtgctggccgacgacgacaagccaacgtttgcactgctgacgaagcttcacttatcggagactgtcatcaccgatgacgagggcgggtacgtatctcagcgaggtcatgtcgtagggctgtcctcgcctgcagatcctcgagcttccaatctcacaaagatgcaagtgaaggattgcttcgtcattgaattgaaggactcggccatgtcactctcgatgccggcgatggaggagttctgctag

SEQ ID NO: 6101 - DNA, 1199 bp, Oryza sativa
  Predicted polypeptide sequence is orthologous to G1482, G1888
catatcttttgtacacgggcgtactacgtgttacggctgaaccaatctatccccgtgctcgctgtgaggccattgaccagaggaaacggaggaggagagagcgatcgtggtcgtacgtacgttgggagagaagaagggacgcgcgcgcgcgcgccggagcggcagggcaggatgaaggtgcagtgcgacgtgtgcgcggccgaggcggcgtcggtgttctgctgcgccgacgaggccgcgctgtgcgacgcgtgcgaccaccgggtgcaccgggccaacaagctcgccgggaagcaccgccggttctcgctgctcaacccctcggcgtccggccgctcgccgacatcgacgacggcgccgctctgcgacatctgccaggagaagaggggtttcctgttctgcaaggaggaccgggcgatcctgtgccgcgagtgcgacgtgccggtgcacacggcgagcgagctcaccatgcgccacagccggtacctcctcaccggcgtgcggctctcctcggagcctgccgcgtccccggcgccgccgtcggaggaggagaacagcagcagcttctgctgcagcgccgacgacgccgtgccggccccggcggcgcccgccacgagccacggcgggagcagcggcagcagcagcatctccgagtacctcaccacgctgcccgggtggcacgtcgaggacttcctcgtcgacgacgccactgccgaggccgccgccgccgccgccgccacctcttccggcatctccgcgaacgggccgtgtcagggggtaacacggatcggagggctgcaagaatccgccggctaccctgcgtggatggcgcagcagcagctgtgctgcgacggcctcgtcgccggcgacgcgtcgccggctagccgggagcggtgggtgccgcagatgtacgcggatcagcttgccgccggcagcaagagatccaggacgtccactgcttcttcctactcctactggtgaaactaaagcaattgaggccatggtttgtacgtagtagatgttgtttcgggcttaattaatgactgcattttgcgcttccggacgggagtgtttgtgcgttatttttgaggcgcagaggaaaatctgagccttttgtatcccttcctttttgctcgtcacgactagtactgtatgtttttcttctacgcaataacgagaatttttcctcttttccaatg

SEQ ID NO: 6102 - DNA, 2055 bp, Oryza sativa
  Predicted polypeptide sequence is orthologous to G1483
caaaaaaaaacaatttgtgcggccattaggcgttgagacctcggcgaatggcagccggcgacgtcgtcccacctccaccgcgcccacgaatccattccattccattctccatcgccccccacccatgtcgcctcctcctccaccatattaccaccacctcctcctcctccgctcctcgcccaccaccactggaggaggagctcgggttcttgccgcggcggagctcgcacgcatgaagctactgtgcagcgcgtgcgaggcggcggaggccagcgtcctctgctgcgccgacgaggccgccctgtgcgcgcgctgcgaccgcgacatccacgccgccaaccgcctcgccgggaagcacctccgcctccctctcctctcccccgcctcctcctcctcctcctccgccgccgccctcgcgccgccgccgccgtcgccgcccaagtgcgacatatgccaggagagccacgcgtacttcttctgcctcgaggaccgcgcgctgctgtgccggagctgcgacgtggcggtgcacacggccaacgccttcgtctccgcgcaccgccgtttcctcctcaccggcgtgcaggtcgggcaggagcaggacgagcactcccctgacccgcctgagccgtctcctcctcctccgccgccgccgcctgcatccaagagcgaccacccggcgccgctctacggcgagggcggaggagggttcagctgggacgccgccgactcgccggccgcgggcggcctccccgactggtcggccgtcgtcgaccagttcggctccccgccgccgcgccacacggacaccgcgaccgtgacgaccccgccgccgaccaagaggagcccacgcgcgccggcgttcggcggccagggcggcatgatggattggcccctcggcgagttcttcggcggcttcaccgacttcaccggcggctttggcttcggcttcggcgacagtggcacctccaaggctgacagcgggaagctgggagggagcacggacggctcgccgtactaccggtcgtcatcggaagatgaccggaacgccgacgagctcttcgggcaggtaccagagatccagtggtcggtgccggagctcccctcgccgccgacggcctccggcctccactggcaacgccatccagccgccactcacggcggcggcggcggcggacccgacaccaccgccttcgtccccgacatctgctcccccgacagctgcttcccggccaccacctccaaacgccggaggcaataatgctagctagctaatagctatgtccagaggttgaagacgacgacgacgacgacgaccagccatgtgagtgtgactgcgattgctaatagctcgagacgctgacgtgatcgtgtgtggtaccacctttcatggcgatggcgccaactacaatgttaggtaggagaagctttctactcgtctggtggttggttggttggttgttgacgatgatgatctgttgccatttccggcgacatcgaggcggaaacagatctctctgattttgagtgcctgacatatgggtttcatgtctaatgggttcttatattagcgacccacattagcagtattgtagagaagacttgttgaaaacagccgcaatcagcattggctgacaaatacagttgggggagatcaatggaactacagtgtacagtctatgctctgcagcatctgattctgatcctgaagtctggaaagaggaagaagaagattagaaagaagagaggcctctgctttttcgatggccgaaactgagatgcacctcgctaattggtgggcagtggacaggataggataggggccatgtgatggattgatggtgatgctctactttgttcagaacagaagtctctgaattttggttggatcacagaaacttgtaaaagattcttgcatgtgtacagaagttttatactacagtagttagatagaaacatggatggatccgtgagaaaagaaaaatgctggtaatgttgtattgtactagtaaaagaaaatgttatatgtttttaactcggctgattcattctttttcg

SEQ ID NO: 6103 - DNA, 1450 bp, Oryza sativa
  Predicted polypeptide sequence is orthologous to G1483
gatacagtggagagataggggaagagagggagcgatccaatcgcgtcgctaaaaccctagcggctggctgatttgggggattgctcgtcggagagatgaagatccagtgcaacgcgtgcggcgcggcggaggcgcgggtgctgtgctgcgccgacgaggcagcgctctgcacggcgtgcgacgaggaggtgcacgccgccaacaagctcgccgggaagcaccagcgggtgccgctgctctccgacgacggcggcgccgcgcccgccgccgccgccccggccgtgcccaagtgcgacatctgccaggaggcttctggatacttcttctgcctggaggaccgtgcacttctttgcagagattgtgatgtttctatacacacagtaaactcctttgtttcagtacaccaaagattcctactaacaggtgttcaagttggccttgatcctgctgatccagttccacctgttgctgacaagcatgttaagagtgctggtggttcagtggattcagcaactaaacatttgcaaaggaatcctacagacttatctggtgaaaacagtgcatctttgcccagccaaaatgtaatcaatggtaattattctaggcagagttctgttacaatggccaagacaggacaggtcaattggactatgagcaacaacacaattagatcaatagaccctccacccaagtattcatcagaggaaagtccagcacttctgctagctagccacactagcaccatggcagcgtactccagtcaaatcagtaaggatagtgatcggatctacaacttaccattcacaggtggtaatgggtcagatagtctacatgattggcatgttgatgagttctttagtaactcagaatttggctttgctgagcatggttcttctaagggtgacaacgctaagccagggagtgctggtggatctccgcagtgccgtctggctgaaggcctgtttgtcgaaggacttctaggtcaagtgcctgacaatccatggacagtgcctgaggtcccctcgccaccgacagcctctggtctctattggcaaaataatttgctttgcccttcgtacgacagcaccatgttcgtccctgagatttcctccttggagaactctcagaacaacttcactgtatctgctggtttgaagcgccgaaggaggcagttttgatctgccgatagcatcagacaccattcggtttagttggcaggtcacgttgagaggagggcttcttgcctgcctgaccaaagccacaaaacacagggatggatgatcatccagtggtcagtctaaaaatatgttgtaatgtttgtgtttcgactatacgtttgttgctgaagtttaaaggcgagggaattgttgtgagatctgggatgacagatttgttgttaccaattttgtgaatagtgaaaataaaaagagcatggataagatcatgaatt

SEQ ID NO: 6104 - DNA, 793 bp, Oryza sativa
  Predicted polypeptide sequence is orthologous to G1483
gaattggtctctcgttgggctaacgacgcggcgatcgagtagcttagctagctgaagctgccacatgaagatcgggtgcgacgcgtgcgagcaggcggaggcggcggtgctgtgctgcgccgacgaggccgcgctctgccgccgctgcgacgccgccgtccactccgccaacaggctcgccggcaagcacacccgcgtcgcgctcctcctcccctcctcctcctccgccgccgccggcgacgacgaccaccaccccacctgcgacatctgccaggagaagacgggctacttcttctgcctcgaggaccgcgccctgctctgccggagctgcgacgtcgccgtccacaccgccactgcgcacgccgccgcccaccgccgcttcctcatcaccggcgtccgcatcggcggcagcgtcgacgccgccgccgcggccgacgtcatcgtcagcccaacaagcagcagcatcgcgccggccggctcggccagcagcaaccacgccggcgccgccggcaacaacaatggccggtcgccggcgccggtgaggttctcagggggagacggcggcgttgagccggagcagcagtggccgtggagtgacgtcttcgccgccgacgacgacgatgacgtcagcgccgccatggagcagtgctactatcatggcatctctgaacctcactcctccagcctcactggatgatggcagcttagcttcagtcaaattaattaatgagctgctataattgatttccatgaactgatcccacagaggtcatcaacatcgagaatattagtt

SEQ ID NO: 6105 - DNA, 1074 bp, Oryza sativa
  Predicted polypeptide sequence is orthologous to G1483
atgaaggtgctgtgctccgcgtgcgaggcggcggaggcgcgggtgctctgctgcgccgacgacgccgccctctgcgcgcgctgcgacctccacgtccacgccgccaaccgcctcgccggcaagcaccaccgcctccccctcctctcctcctcctcttcttcctcctctccctcccccccgacctgcgacatctgccaggacgcccacgcctacttcttctgcgtcgaggaccgcgccctcctctgccgcgcctgcgacgtcgccgtccacaccgccaacgccctcgtctccgcccaccgccgcttcctcctcaccggcgtccacgtcggccttgacgccgccgccgacgacgacgacaaacaccccccacaccccttgtcgtcgtcgctgccgcgcaacacggcaccgcccccgcagccgccgccgaagcgcagcccctcgccgatctacagcgatgacgacgtcatcgactgggccaccggtggccacgacatcggcatcaccggcaacctgcccgactggtcgctcgtcgacgagcagttcaacacccctgcgctgccgccggtggtgaccaagaccccgccgaagcgggcctcccgtggccccgtcacggccggcaccgccgcggcggtgttcggcaacctcgccggcggatcgccggactggccgctcaacgagttcttcggcttcgccgacttcagctccggcttcggcttcgccgagaacggcacgtccaaggcggacagcggcaagatcgggagcatggacggctcgccgaacggcggcaggtcgtcgtcgtcgtcctcctcctcctccgccgccgccgccggcggcggcggcggcggccaggacttcttcggccaggtgccggaagttcactgggccgtgccggagctcccctcgccgcccacggcgtcagggctccactggcaacgggacccgcgctacggtggcggcgccaccgacgccagcgcggtgttcgtgccggacatctcctcgccggagaaccccttccgttgcttcgccgccgccgccgccggtgaccataccatgaaacgccggaggagatgctaa

SEQ ID NO: 6106 - DNA, 1022 bp, Oryza sativa
  misc_feature (642)..(643): n is a, c, g, or t
  misc_feature (724)..(724): n is a, c, g, or t
  misc_feature (728)..(728): n is a, c, g, or t
  misc_feature (777)..(778): n is a, c, g, or t
  misc_feature (780)..(780): n is a, c, g, or t
  misc_feature (782)..(782): n is a, c, g, or t
  misc_feature (785)..(790): n is a, c, g, or t
  misc_feature (792)..(792): n is a, c, g, or t
  misc_feature (794)..(810): n is a, c, g, or t
  Predicted polypeptide sequence is orthologous to G1488
gtcgggcaccgcggcgccggcattcccggccaagaaggcggcgaagtccgccaagaagaaggacgggccgtcccccgcgccggcgccgaacgcggccgcgcaggcggcggcggaggggaggaggtgcctccactgcgagacggacaagacgccgcagtggaggacggggcccatgggtcccaagacgctgtgcaacgcgtgcggggtgcggtacaagtccgggcggctcgtgccggagtaccggccggcggcgagcccgacgttcgtggtgtccaagcactccaactcccaccgcaaggtggtggagctgcggcgccagaaggagatgcagctcctgcaccaccaccagcagccgccgccgcacgtgggcgcgggcggcggcggcgccgccggagggctgctccacgtgacgagcccgctgctgttcgacgggccgacgtcgtcggcgccgctcttcgccggcgcggacgaattcctgatccataaccgcataagcccggactaccggcgccaggctacctaggaaactattcattagcccaggaataattcagcgataaaaacagctaatttttttttgtcctgcaaaccgcattttgggtactctttatttctcagcttcttaagtttcttttttctttnnttgagaattttagtgtttttcccccttagaagcagactctgaggagtttctttcgtagcacatttttttttcttttgattnttgnatgcaggactcttagaagaagaggaacaggagcagttttcattgtttcnncnanaannnnnntntnnnnnnnnnnnnnnnnnctcttgaggggggcccggacccaattcgccctttatgagtgtttaccgccctacatggccgtgttttacacgtgggaatggaaaacctgcgttcccactaatggcttgagaaaatcccttttcagatggtaattacaaaggccgaccatgcctttccaaatgccccctaattggatggaacccctttacgcctttaaacgggggggttgtct

SEQ ID NO: 6107 - DNA, 1753 bp, Oryza sativa
  misc_feature (599)..(599): n is a, c, g, or t
  misc_feature (838)..(838): n is a, c, g, or t
  Predicted polypeptide sequence is orthologous to G1488
gagctgacctctctccgccccgcctccccttccgtctctccgcgctccagctccacgccaattaaaccctactcctcttgcgttgcgttatctgcggttccgtctcccactactcgcgcacacgtagaaacggaaggagaaacaaacaaaaggcgccgagtaacgcagatagagagttgtttccgcaccgagcgcgtccgcggcagtgtgtgtgtgtagcggtagcgcacgcgcggctcgcgggcgcgccggttgcaccagctgtgcgttgcggcgacgatggaggtgacggccgagttcggcggcgcctactacggcggcgcggcgggccgcgagaagaaggcgctgcagcaggggtgcggggaccacttcgccgtggacgacctcctcgtgttgccctacggcgaggaggatgaaacaacaagggagggtgaggccaccggcggtaaggaggaggctgccggctttgggaacgcgtcggcggactcgtcgaccataacggccctggatagctgcagcaattccttcggcctagccgacggcgacttccccggcgagctgtgcgagccgtacgatcaactcgcggagctggaatggcntatccactatatgaacgagggagacgacgcattcgccaccgaggacctccagaagctgcagctcatctccggcatcccctccggtgggttctcgacggcgagcgtcccgtcggctcaagctcaagctgcgtcggcggctgcctccatggcagtgcagcccggcggcttcctgccggaggcccctgtccccgccaaggcacgaagcaagcgctcccgcgctgcgcctggcaactggtcgntccgcctgctcgtgctgccgccgcctccggcctcccccgccgtcccggcatccatggccatctcgccggcggagtctggcgtgtcggcgcatgcgttccctattaagaagccgtcgaagccggctaagaagaaagacgcgccggcgcccacggcgcaggcgcagctctcgggcgtgccggtgcactcgggcggctcggcgccagcggccgcggccggggaagggaggcggtgcctgcactgcgagagcttacaagacgccacagtggaggacggggccgatggggcccaagacactgtgcaacgcgtgcggggtgcggtacaagtccgggcgactggtgccggagtaccggccggcggcgagccccaccttcatggtatcgaagcactccaactcccaccgcaaggtgctggagctgcgccggcagaaggagatgcaccagcagacgccgcatcatcaccagccgcaggtggccgccgccggtggagtggggagcctaatgcacatgcagagctccatgctgttcgacggagtgtcgcccgtcgtgagcggcgacgacttcttgatccaccaccacctaaggacagacttccggccgcccatctagagatgagtcgtgtgctagaattgatcaattagcccatgaataatctaaaagaaacccttgaaccaaaaaaaaaacagaagaactgatattttcttaggagtttccccagtttttgtctcttttcccttcgtttagtttgtgcgcttttgctcagctcgtcgaatttttcgtgtcaattttgtttatgatgctctttaagtttaccaccttttctagccgggagttgatttctctagcttctacttatcttcctctctatcttgccatttaatttgtaacgcatttcaaggtacttaaatctcttcttcc

SEQ ID NO: 6108 - DNA, 1092 bp, Oryza sativa
  Predicted polypeptide sequence is orthologous to G1493
atgagcagcggggcgccgccccacgccggcagcggcggcccgccgccgccggcggtgctcgcgctcccgcacgggatggtggtcgtcggagacgaggccgtgcagcgcgccgtcgtgctcaggcttggagtgaacttccgagcgacggtttgctcggagatcaacgccgccgtggagatgctgcgtgagagaacgaaagaattcgatttcgcggtgatttcagaagagtcgattagaagcttaaggccagagatcatgaagtttttaggcgaggagacagggctgaggctgctcggtatatgtctttttttcgacctactgttttgtatcgctgccggcggcatcacctcacgatggcagcaacggctcgacggcggcggcgatagcctcgtcggtaagaaggacgaccaacgggaggaaacatcgacggcgcgccgagaagacccagtgccaacaaaaatacttgaactgatgaaattgaggattgatccgatgaatgatccagaactaacacgtaataccgtttctagttatctccagaaatataaggcgtatcttcttaaacaagaacaaaaagaccaacaattacctattgatgacaataccaatactagttcaatcaaaagtcaacaaggatctgcatctcttcaacaacaaattatgaattacggtgaaaatgatagcatggacaatcaatcaataattctatcacaaacccgctacaatgaacatagtaacaagcaaccaaagttgttgacagccaattatcatgggcctaaaaacatgcatcatcatcacaaaaacaccaacatgcaaccttccaatgtactgcggcctcctaacttgatcaatgcaaagggattcaatatgtcctttaacaaggaagagatcaacgaagccatatatcagagccaactaacaacacgtcgagtttcagccactcatgctattgcaaaagcacaagccagctggagagtaacaatgacgaaagatatgcaccccatatctcaactacaccaacaagatgatgaaacaacacctgatgattcttctaataatacaaatagcatatatgaaaaatgtaagctttga

SEQ ID NO: 6109 - DNA, 2608 bp, Oryza sativa
  Predicted polypeptide sequence is orthologous to G1493
gagtcttctctcttctctctctctcgtctctctctcccccacctcttcttccctttcccccgcctccctctcctcttcgtcgtcacccgccgcctcccgctgaatccgcggcttgggaggagacgccggagtcgggggcgtggacgggggttggatctgcttgccttgatggtggcgattggagcgtgaattcgtgaggggggcgtggtggtggtggtggtggttatacggttttcggtttcgtgggcgggggagagatggcgccggtggaggatggcggcggggtggagttccccgtggggatgaaggtgctggtggtggacgacgaccctacatgcctcgccgtgctcaagaggatgctcctcgagtgccgctacgacgcgacaacttgttctcaggctacaagagcattaactatgctgcgagagaacaggcgtggttttgatgttataattagcgatgttcatatgcctgatatggacggattcaggttacttgaacttgttggccttgagatggatctcccagttattatgatgtctgctgattcaaggacagatatcgttatgaaaggaataaaacatggagcatgtgactacttaattaaacccgtcagaatggaggagttgaagaacatctggcaacatgttataaggaaaaagtttaatgaaaacaaggagcatgagcattcaggtagcctagatgatacagatcgtaccagaccaaccaataacgataatgagtatgcttcatctgcaaatgatggagctgaaggtagctggaagtctcagaaaaagaaacgggataaagatgatgacgatggtgaattggaaagtggtgacccttcttctacatcaaagaaaccaagagttgtttggtcagttgaactccaccaacaatttgtaaacgcagttaatcatctggggatagacaaagctgttcccaagaaaattttggagttgatgaatgttcctggtttaactagggaaaatgtcgccagccatttgcagaagttcagattgtatctgaagaggattgctcagcatcatgccggaatagctaatccattctgcccgcctgcttctagtggtaaagtaggctcactgggaggacttgatttccaagctttggctgcctcaggtcagatccctcctcaagccctggccgccttgcaggatgagctcctagggcgacctacaaatagtttggtattgcctggaagggaccagtcatctttacggcttgctgcagtcaaaggaaacaagccccatggggagagagaaatagcatttggtcaacctatatacaagtgccagaataatgcatatggggcattccctcaaagcagtccagctgttggaggaatgccttcattttcagcttggcccaataacaaacttggtatggcagactcaaccggcacattgggaggcatgagtaattctcagaatagcaatatagtcttgcatgaattgcaacagcagccagatgccatgctgtcaggaacccttcactctctagatgtcaaaccttctgggatagttatgccttctcagtcattaaatactttctcagccagtgagggtctctcccctaatcaaaataccttgatgatacctgctcagtcatctggttttctagcggccatgcctccatccatgaagcatgaacctgttcttgcaacttctcaaccatcgagtagtctgttaggtggtattgatttggttaatcaagcttcaacaagtcagcccttaataagtgcccatggaggggggaatctttctggccttgtaaatcgtaatccaaatgtagtaccttctcaagggatcagtacttttcatactccaaataatccatatttggttagtccaaattctatgggaatgggctccaaacaaccacctggtgttcttaagacagaaaactctgacgctctgaaccatagctatggttatcttggtggtagcaacccccctatggactctggcttactctcttcacaatcaaaaaatacacagtttggtttactgggtcaggatgacatcactggtagctggtcgcctctgccgaatgttgacagttatggtaatactgttgggctaagccaccctgggtccagttcatctagttttcaaagttctaatgtggctcttgggaaattgcctgatcaagggcgaggaaagaatcatggatttgttggtaaaggtacttgcattccaagccgctttgcagtggatgagattgaatctccaactaacaacttgagtcacagcattggaagcagtggagatattatgagccctgatattttcggatttagtggacagatgtgaaggcttcttgaatttgtaagtagggtaatcactggaaacaatttttagtgggttgatgaacggttgccgtgtttttcatttcatccttttttttttccttctgtaattggtttataaagggaataatttatgtgacagcatgtcgaatcttggtttatagaaggttgttcggtttaaacaactttggattatttagcctcatgtgacatagctcattttcctttgttcattttttgtgtacagttttctgattttgttgcaaatcttcttctctc

SEQ ID NO: 6110 - DNA, 560 bp, Oryza sativa
  Predicted polypeptide sequence is orthologous to G1499
cgctacatcaagttcctcaagcgccaggtccaggagctccagcaccagccgggaccgccgccgccgccgtatcccgccggagctgcaccggccgccgggcccagcacctcggccgtgggcccaccgggtcggccattcttgccgctgggtggaggagggcccatgatcgactgggtcggcctgaccaggccggtggacatccatgggccgacctcgtcgtcgtcctcgtcgtcgatgggcggcgccttgggtttcgggttcggctgcggcggcggcgggcagagcagccatgggatgcactgatggatgatgaaattgggatggagcaatatagctgagagagaggagattaactaagctagggatgcatggattggtggactagagaggtaattttggtaatttggttttggtcttggtttttattaattaatttgctcttgttgttggctcaggctactagctactctctctactccccactgagtagctaagctgctgccttgatgtttctcaaagtacaattaattaataagattagctagggtttgcattctaaa

SEQ ID NO: 6111 - DNA, 2077 bp, Oryza sativa
  Predicted polypeptide sequence is orthologous to G1506
ggcattccttcctccattatttctccatccctttcccctctcctcctctcctctaccttctctctaaaagactggatacagaacaaaaaaaagggaaaaaacagaaagaaaggaaagaaagaagaacacctaccaagcaagtcttggtctttgagttcatgggctgtggaattgttcccaggaatcccctctggctctgaaaagattcacaccgagcaacagttctttgatttttttccccctttgttttgctgaagaattgcttgtacagaactgcttctttcctgtttccgcttggttttccggtgtttattttgttggaattttcttgggccctttcttcttcgcttgtggaggcgaggggagaagagaggcatgggaaagcaaggaccttgccgtcattgcggagtcaccagtactcctctctggagaaatgggccaccagataagccagtgctctgcaatgcatgtggctcaagatggagaactaagggttcgctgacgaattacacaccaatgcatgctcgggatgatattgatgctgaggaacctagagctagcaagctgaaacctccaacattgaagctgaaggaacagaagcaactgaagaaaaatccaagccacatcacaatggagaatggaccattttctgatcaaaacttccgtaagatgggagatcctgacctaagtaatcgatctggttctggatcagcactatcatactcagagagttgtgccccctatggcactgctgatgcaagtgaaatgactgcttcagcacaatcacatgcttgggaatcacttgtgccatcaaagagaaggagttgtgtcactcggcctaagccttcacaaatggaaaaacttgcaaaggatcttaattccataatgcatgaagagcagctactttacctttcaggatcctcagaggaggatctaatttaccatagtgcaactcctgtggattcctttgagatgggatatggaagtatgcttctcagaccaaattcaaaatcactggaggaagaatcagaagcaagctctattcctgctgataataagtcatatattactagtgaatcttactcagggtcggtctcatttgtatatagtgaaagcaaggcaacaagcaaccaaaatgttataactgaacagccaaagaagtttctggtgcaaacatcagataatgctagaagggctaatctccatactgaaaatcaggatactctggagaatgcaaactcacctttagtttccctacatatggagggaaaagacagtgaagaaacaagagtaaagaccagtgcttcaaatcgccttacaaagtccaccatgaatcctctgaaaaggccgcatgacacccacttccaaagctccgtagaactaagaggaaccatgaggagtcctaaaagagtttctaaatatggtgatgctatgggtctaaagtgccaagcgtcgtttatgccgaaaccaggcaatggcaaagatttagcctgcagtgacagagcacttaacttattcatgttacccccggataaactatccatgctggttcctcctcagtatgccaacactgattctgatcaagacctgttgctggatgttcctcttaatgctcggcacccagaggccgagcttctttgccagccatctcaactgagctcagtagcccacagctccacctcagaggctgggaatgccggaggagaggggcgccttaagcagccctagttccagttccagttaacaagcaacttaggaacaggaagtagctgtagtttactttagtttccctggatcatggttccctttatttaccggccactgatggggcgttctgcggtttgttcatgctcttatcgtcgtcgccctggtttactaggcaatgtgcgtctgccaagttggcaaaaattgtgtgttcagctaacacttctagctgtgcttttggagtagacttgtgcttgtttgtagcatatggcttttggagaaggtatataactcaacatggctgtatggaaaagaggtaatctccttatgggtaaaatgaaaaaggaaagaaagatggaagttattaggagct

SEQ ID NO: 6112 - DNA, 659 bp, Oryza sativa
  Predicted polypeptide sequence is orthologous to G1510
taagaaagatcctaagtggcccgtagcagatgaagatcattttctctttgctcgtctggcgagtgcgtgcaagcagctgcctttgctgcaggtttgatgtttgtagggtcaaaagttatgagggcaaataatgcaaggctggcagtgcggcctgctgcctgactgacaaggcaacatggtggcttgtgagccctatgatgaatggagttgcgtaaaggcaaggcaggtgatgggcatgagcgggcaagcccactgtgatccacaaatgcaaggttggcatgttgcaagactggaggaaatgtaagccagagtgctggcacagctgcaggctgggtgggtgcaacatgtgctgcacctgatgcaggatgattgaaccttggtgtgcagggccatgagcgcatgcagctgacaagctgccagcgtgttggatgatgctgctgactttgggtgcggaatcctggactgcaagctgcaagctgcaaagctgctggtgtgggctgttggaacttggccatgctgaggatgatggtgatgctgaccctaggtactatagtgcacctagtagcattaccacccttgcggtgtattgtactgagttttaacatatagtggttctcggaagttagaaaataagctcagatatcaaaaaaaaaaaaaaa

SEQ ID NO: 6113 - DNA, 1343 bp, Oryza sativa
  Predicted polypeptide sequence is orthologous to G1510, G1779
gaacttctctcccatctctttcctcctcctcctctctgatatgtctactatctacatgagccagctacctgctactctccctctaatggagggggatcaggatcaggggctctacccagccttccatagagcaaaggaccctcctatcttgttccctttcatgatcgacagcgccgtcgagcaccaagggcaaatctatggagatcagggcttgaggaggcagcaggttttgggtgaatccaatcaacagttcaatgatcacatgatgatgggcggatcagatgtcttcctcacaccgtctccgttccgaccaaccatccaaagcatcggcagcgacatgatccagcgatcatcttatgatccatacgatatcgagagtaacaacaagcagcatgccaatggatcaaccagcaagtggatgtcgacgccgccaatgaagatgaggatcataaggaagggggcggcaaccgatcctgagggcggggcggtgagaaagccaaggagaagagcacaagcgcaccaggatgagagccagcaacaactgcagcaagctttgggtgtcgttagagtgtgctcggactgcaacaccaccaagacccccttgtggagaagtggtccttgtggccccaagtccctttgcaacgcgtgtggcatcaggcaaaggaaggcgcggcgggcgatggccgctgctgccaacggcggagcggcggtggcgccggcaaagagcgtggccgcggcgccggtgaacaataagccggcggcgaagaaggagaagagggcggcggacgtcgaccggtcgctgccgttcaagaaacggtgcaagatggtcgatcacgttgctgctgccgtcgctgccaccaagcccacggctgctggagaagtagtggccgccgctccgaaggaccaagatcacgtcatcgtcgtcggtggcgagaacgccgccgccacctccatgccggcacagaacccgatatccaaggcggcggcgaccgccgctgccgccgccgcctctccggcgttcttccacggcctccctcgcgacgagatcaccgacgccgccatgctgctcatgaccctatcctgtggcctcgtccacagctagctagctagctgatcaaaactagctagctactagtaccgttaatttgatgagggcaacaaccagagtactatgtaccactactagcaatattttgtgtgtgccttgtgatcttttgttgttttgtgttgttgaggagatcactagatcaggatgaaggagagatagtgatcacatgtctaaggacgaaataaacgagaacaaactcgctagctagctactagccgggatcaggattatattt

SEQ ID NO: 6114 - DNA, 1633 bp, Oryza sativa
  Predicted polypeptide sequence is orthologous to G1510, G1779
gaatcgtgctggacctcgcaaaattgcccctccaaccgcatcaacactcgtcgcgcgaagcgtaccatcgtctctctcatcttcctcgcggtctcatcctgatcgatctctgcgagtttatccaatatctgtactcgcaaactagctagagagatctagttagtagctaggcagttgctgcctctcatgtctaccatctacatgagtcagctctcagctgctctccctctcatggagggggagcaccaccatcaccaccaggatcatcaccaaggccacttccaagccttctccctgcagcctaaggatcccccagtcttattcccctttgtgatcagtagaagaagcagcagcagcagccctagcgacagcaccactctaagctatggttcagaccatcacttgacacagcagcagcagcatcagcatcaagccatgcttgagccccaaaatatgattggaggatcatccgctggcatctttgcgacgccgttcccgaccgtcaagagcatccgcgacgacatgatcgagcggtcgcagttcgatccatacgataccgagaagctgcaggcgagctgcgggttagccaaggtcgtcgccggcggcaagtggagcgcggtgccagcggccaagatgaagatcacgaggaagatgggtgagccgtcgtccggtgtcactggcggggctgcgacgacggtggcgccgaagaagccgaggaggaggccggcgcaggcgtacgaggatcacggccatggcggcgccatgggccaagcttttggcgtgattagggtgtgctccgactgcaacaccaccaagactcccttgtggaggagtggcccgtgcggccccaagtcgctttgcaacgcgtgcggcatcaggcagaggaaggcgcggcgggcgatgatggcctccggactaccagcgtcccccaacgccgccggccccaaggcggccgcacatagcggcgccacaaacgcagccgccgcagctgccatggaggagacggccgagtccgccaccgtcgccccgcccccggcgccgacgacgaggggtggtactctcgtcgacagcatcgggctcagctggagcaagacccatgccgccgccaccgcctcctgcagcttccggccgtcaccggtggctcccggcttcgcggcggcggtgcaggacgagatcactgacgccgccatgctgctcatgacgctgtcctgcgggcttgtccggagctgagaaagaaaagctatacttcatctctgcatgcatccatcgatcgatcgattggcaccaagctagagagaccaatcgatggagatggagagaggtgcaggctttttgcagctagtgcgttagcctgttcttgctcgctcgatcgatcgtacactgccccccagttggaatgtctcttggcgtcttgtttcctgttcgagtcttgtgatctctgttactttgtgcactgtactagagagtgagagagagagtgaggtagaaacatcaagaggagattagaggagaaagaataattaagagaaaagtgtgagctagctaggtaagatttactgtactgtgagttcaatttggagtaagctttttgggctgcttcacggctaattatgccactggctgctatatatgt

SEQ ID NO: 6115 - DNA, 2935 bp, Oryza sativa
  Predicted polypeptide sequence is orthologous to G1512
gatttggaaaattttctccacttcccctccaagttgaaagtccaccatagaccatggtctgttcttgtgctgtagcttggtgacctgccattttagccgcaatgcatgaccaaagtattccaaattcttgatccccagccccccattttccactggcatacagacgtttttccacgcgaccaagcagtgtccaccgctcacttcctcttgccctttccaaaggaatcccctgcatttgcgttcaatttcttttatcgcccatttaggcagctgaatcactgacattgtgtgtacagggagggccatcattgttgatttgatcaagcataatctgccatcgtgtgatagcatccttggcttccaaccagctaccttttttgcaagcttatcaaggattggttgcaactccatctttgttggtcttctcatggatagcggtatccccaagtatataattgggaattgctctatcttgcagcgaaggatgtcggtgatcaattggagctgctgctcgctacaccggattggtgtaattgcgcattttgccagatttgtcttcagccctgttgtgtcaccaaatcttttaggataaactcataaacatggtagtaattatatgccttggtttctccatcttaattcatttgcatgctaaacagaagtttgttactagttttatgtttcacccatttgttcttgtgatttatctcaaggccgtttacatgtggttatcctttctttgatgggaagtgtaactgacagccttaaccctattggaaaattagaaggaataattaagatgttgcttccactctttacttacacgtcgattgagtatacctgataaatgtgtagatggaatgattcttgtttggtactaatccgaataacctatatctgtgtaagtttaatcatattgatattgtggcacacaaacaatttgacaatgaaaagctgcatcaatgcaactaagctttgcacagttctactgaacttttctgcttgtgcatttttatttgtagccttggggtaccattagcaattttgtgatgtatcttggttgatctcattttcatgattcgtactattcatcagtactttgtttcttggccacaaaaacgctagctggacaactgtagaaaaacgacgtgcttggagctgtatgtatgataaggaaaggagagaaatgcatataggcaccttagttctgactgcacatatcgtctgtggatatgggctaatattatttaagaaaaaacaactccaagttgttggccgaatatttgttgtttcctgatcttatcacaagattgaatcatcatcttccctgatcactagatatgatttaaaactatataataagaaatgatgtgcttttctctttggttttgttcagtcgcttgaatacgtcaagtgctacatatggagtcaggaatctagttattccatatattattacaccacttcatcgtttgcttttcggtttattaacatagataaagaaccgattgacggctcagtttctttgaaggaaaaaaaaacacagagataatcatacttatggagcaagatcaggttgggctttggggtcggcaagctgtcttcttctccgtacaattcgctgtgtggtcactgatcatctcttattttttcttgacaaaaaatagtggtgctaatccggtcagtgtttcagcgacctggtggcgttgtccaaattaaatcgagcgtaagcagattataaatgccggattgcttaattgctttcttctttgctttcctctcaaggcaatagcaagtctattttctataaaaaacaaaggcaaactctcttcttcttgttattgtttttgcaaagataaacaaatgcaaaattcgggttgataattacgggttttgacctgtaagattcttgtatccacttcaggttgggcaatcagactagttttaccgactggtgtggtgaccggtgaccgtgtaaatccgcaatgcaatcaatcatcaatgacatttctacaatcgaaccaccgtagtggataactggatgtgatagcaacatatagatcgaagctaaactagtagtatgaccgaacaattttttttagaaaaagtaaaatttaatcaatagtagttttcttatacaatttgccctgtggttgtttatatttggtatggaggcatggagccttatttaaatcctctgctttatctgaaaatatcttgtctgatcgacgtgggaccttctggatttggacagactagttaggactaaacaacgtcctcagacagaaaaccctacggttttggtcttcttgtggttagttccactgtccatttttgctgccagcggcctatcaccagcacacgaaccggtcgcacggacaaaacggtacaacttgctttgcctgaattctgaccggtcatcgtacacgtttcggtgaccaatcatgcccggcgaaccatcgatataaggaaagattttgtttgatcgaggtggggatggatcagctttgcacgagtggaggcagcgacagcgacaagtctttggcggccggcgatgagccggcggtgagagtccgaggtgaagtggaggcggaggcggcggcggcggcggcggcggcagaggcgcaaggcggtggctgcttcgactgcaacatctgcctggatttcgccacggagccggtggtcaccctctgcggccacctctactgctggccctgcatctacgagtggctgcaccccggcggcgacgacgacggaagcaacggcgacgcgagctcgacgaggcggcgtccctgccccgtgtgcaaggccgcggtctcgccggacacgctcgtgccgctctacggccgcggccgcggcggaagttccaagagggcccgatccggctcggccatcccgcgccggccgatcgtacatcgggagcccgtcgagcggc

SEQ ID NO: 6116 - DNA, 2250 bp, Oryza sativa
  Predicted polypeptide sequence is orthologous to G1512
gaacctgcaagagagctaatctcctatatggtcttagctaccgggatctataccctgcaactgtcatcagctgggcatgaagaacagcaggcggccagctatatttatttcagcttaattctcaaagggtatatatactttggtgaagatcgatcggtgcatggttgattagagagccaactgaatgggatttcgctcagtttgatcctcatcacagtaggtgcttaattggagggagtatgaaaagctggcttgcttaattgtgcaccatgcagatcaagagcagggaatgcaagaaaatgcagcatatggtatgtaaaatgcacgatgctggtgagtaatgttttaatgccccttatttgttactttggttaattaatttctacttaattttatccagttttgcctgatcagtaccctactttaattgtttcactatataatttgcacccggttattactatattgttgtagtgtgtctatcttaccattaataagatactccctccgtccctaaatatttgacgccgttgacttttttaaacatatttgacctttcatcttattcaaaaaatttaagtaattattaattccttttctatcatttgatttattgttaaatatacttttatgtatacatatagttttacatattttataaaagtttttgaataaaacgaacggtcaaatatgttttaaaaagtcaacggcgtcaaacatttagggacggagggagtaagaagtataaggctagtttttgtaacatatatagggtatccactatatatccctctattcctttgcaatagtactgaactgctatgcttatactaggacattaattactttggttacacagttgggaggtgtcagtttagtccagtggctgtagcacaatgttgtcttttgaggtgatttttttcatcaagtttattttgcatgatactccctgatcattaagatttcttagcaacatttatgaaaccacattaaaaaaaggacgtacgcataggcagatatatagcccgtgcttcacttgaagatttgtcattcatgcctcaattttcactagctaacacagaacgtttatgtgtacaataatccatctctcttttatggtttttatgtgtgtgaccacgttcttactagatgcacgaaaattatcattttagagttttacagtttatggaatgcttgtgtgtgtgtgttgcaaatgctcagtttatggatgatctagcaacagctaaaatgatgctacggattaatattattgtttttctatctgaaacaaatagatcatcaggcaatacacacatcaattgaggaacaacagctagcacacaacttatttcatgaccacgttcttaattagtttcttactagatgcatgaaaaccatcattttagagttttacactttatgaaatgcatgacagatttcaatcctagtgatagtagaaaattttcaaataagctagctggtgcaaaatggtttctgcggccgctatgcatgtcattcccattccccagaagttgatattgttaactgttaggtgcaaacgttgcaagcaaagcgcgcatgacacacacagccagagggcttcatgcatgttattaattacgatggaacaaattactccgatcccattttagcgcatgaaaagatggtttttgctaaccagccatcttaaaatggattcatttgcaattgaacagtataaatttacatattaattgtattgttttatgctctacttccttctcacggcgagagtcctgctactatactgctggtcagtcggaccgagccatgatccggaagaccggaagggagtcattcatgatctccctcttaaaacaattaataaggctagcttgaagcttctgatcattaattaacctacgatccgtctagctatactaagctactcttcgctaatctgcttaacaactttcaggaagtttttttcaagtatgtactatggattgaatggctgcttatacatatgtactgtgaagaattaccgtgtatatgtatgcaggggcagatatactttgggggtggcgggggctcaagcctctactgttagtaccaggactatgagagttctacgaaacctccactaaattttttattttgccatacgtatatgagaagagggttatagttttatttaattagtttgttcagattccttgttattttttcatggatctaccaccgtgtttatgaataaattttggtactccc

SEQ ID NO: 6117 - DNA, 1619 bp, Oryza sativa
  Predicted polypeptide sequence is orthologous to G1519
gaagcgcggacgaggcgagaactccttggagctctgaactctctatcgcgtgaggaggtcgacggcgagagagatgcgcggcggcggcggcggggatgcgggcaccagctcgaggggcggcggttccggcggggcccccgcgcgtccgcggcggttccctgaggcggcgcagccggagatcatgcgggcggcggagaaggacgacggctacgccgcgcacgtcaccgaggcctgccgcgacgccttccgccacctcttcggtaccagggtcgccgttgcttatcagaacgagataaaattgcttggtcagtctctttattacttgctaacaactggttcaggccagcaaacacttggagaagaatactgtgatatatctcaggttgcaacctcgcacggacttccgcctacacctgctagacggattctattcattttgtaccaaactaccgttccctatcttgctgaacgcatcagctctagaattgttgcacgtggtattgccctcgaggactctcagcttgatgaccattctgaaagtgatagttctagtataggcactgcagcacaaccatccccaattaggaacagtccttcaagaagcttgagtttttctcatttgtcaaggttgagaggcagagtccataccttgtgggaatgggttcttcggaaatggccttcgatgctaccatttgctcaagattttatacagttaactatccggacaaaccttatgttcttctattttgaaggattgtattatcatttaccaaagcgagcagctggcattcgttatgtattcattgggaagccattgaatcagaggcccaggtatcaaatcttgggtatttttctgttaattcagttatgtattcttggtgctgaaagacttcgaagaagtaatttatcaacaatagctagttcgattaaccaaatctcatctggaggctatccttcatcaagaggtcgaggtgtccctgttctaaatgaagatggaaatataatcagcgacatccgccatgggaaaactgcagatttggctactagttcagaggcatccagtggtaagagcaaatgcaccctttgtctcagtacccgtcagaatcccactgccacaacctgtggccatgtcttctgctggagttgcattatggagtggtgtaatgagaagcctgaatgccccctatgcagaactccgattacacattcgagtttgatttgtatatatcattcagatttctagcaaatgattactagcaaggggtcatatcattctccagtggattcattaaaatgatactgaatccccacattttggcgagaactcttcttctgaagtgttttagtgtaccaaaagaggagagtagaaaccatccaatgaggctgaagatcaatgctgccattcaactgtattgtagagctcaaataacaaaacaatcaaacagaacaaaattttcattagagctcaaacggatacccatgtatatgtacattgtagacacaacttgattttgtagggtagaacagtggctgactggaatcattagagcaaaatgtatcgacctgaaattctgccgggaaatttaactatttgccaatattagattcgacaattattc

SEQ ID NO: 6118 - DNA, 3804 bp, Oryza sativa
  Predicted polypeptide sequence is orthologous to G1526
ggttttctccatccccaatcctctcctcctcctcctccgcctccgcctcaatcccttcctccatccacccgcctccgttgttctcgccggcggcgacgacatgcacggcgactggccggagtcgccgtcccaggaggtgctctacgccgacgagatcgccgccgtccgcgcggttcttggcgcgggcctccccgaggcccgcgtcgtcgccgcaatctcccgctgcggaggcaacgccgagcgcgccatcaacgcgctcctcgatgacgccaccgccggcgtcgaggacaaacccgagcccaagaagggtaaaggtgccaagacggctgctcctccggtgaaggcggaacgcgacgctggtggcgccgccccgaagccgccgccgcctccggtgaaggttgaggtcctcggcgacgagcccctggggagccaagaatcgaacggctgctccgcgagggtcaagaaggagcgggaggacgagctgctcgtcaaagcgccgcctccgatgccggatcgggtcaaggaggaagacggcgtcgcggccaagcgaggcgcggcgacggcgaacgccgccggcataagcctggtgccgaggccgaagaagaggtctcgcgtgcacgacgaggcggacaccatcgacctcacggcgacccacccggtgccgtacctgaacccgaggccgatccgggcggtgccgccaccggaggccatggagatgctcgagtcgcggcgtgtgcgtgccaggccgcctccgccgtcgagtgatctgaggatggtggtggcgccgcctgatgccgagttcggcgagttccccgaggagcgcgactggttcctcgtcggcaggtcgtacgtcaccggcctgtccaccaaccgcgggaggcggaggctggacgccggcgagctcgtccatttctcgttcccctcattggagaggacctatggtgggatcaaggtgtcgaacaagaaggcggctgctttggcggagatcgtgcgcttctccaccaatcgagctggagagattgggaagctatctacagaatggaccaagtgcctcgtgccactggtaagctcatccaaggtgaagattcaggggaagattgtgtttcccacggtggaattgagattgatgcaggagattttgttgtatgttagcttctacatccaccgttctgtattcaccgcaagcggcaacaactcatcatgggacctgcttgctcctgcaaatgttgattattccactaaccctctttacaggctgttcagattgctcaagctaagggcattcaccaaggctgatatcactcctgaggagcttgctgcaggaaagagatcgcggaatctaaggggtgatgacaatgatgaagatgaacccatggctatagttggattggaaaaccgacgcacagctggccaaacatttcctgagcaaggcactgatgagcaagctatttcagaggctgcattaaacaaaattgttggcactgctgaaacatatgacttggagagcccccaagcactcttgtctccgttctaaaaccataccagaaggaagctctgttctggatgtctcaattggagaagggtattgatggtgatcaagccaaaaaaacccttcatccctgttggagtgcctacaaaatcgtcgacaagagagctcctgcagtgtatgtcaatgttttcactggcgaggcaacaacccagtttcaaagtgtaactcagtcagcaagaggagggatactagcggatgcaatgggtcttggtaaaactgtcatgactattgctctaatactatcaaacccaaggggggagttagaacaagataagaggggtactagagatcgtgacaccaaggcacaaacttcgagatcctctgtaagaggaggcacacttataatctgtccaatggcattgctaggccagtggaaggatgaattggaggcacattcaacaccaggagctctttctgtgtttgtctactatggtggcgacagaaccactgacctgagattcatggctcagcatagtgttgtcttgacaacctatggtgttcttcaatcagctcacaagaatgatggcagcagtatctttcacaggatagattggtatagagttgtgctcgatgaagcacatacgatcaaatctcccagaaccaaagcagcacgagcagcttatgaattaacttctcattgcagatggtgccttacgggtacaccattgcagaataatttggaggaccttttcagtcttctttgcttcctacatgtagaaccatggggtgacgcaagttggtggaataagctgattcaaagaccttatgagaatggtgatgagaggggattgaaacttgtcagagctattctgaggccactcatgctgaggagaacgaaggaaacaaaagacaaaatgggaaatcccatactagtcctcccaccagctaatattgagattgtggagtgcgaacaatctgaagatgaacgcgatttctatgaagcgcttttcaggagatcaaaggttcaatttgataaatttgtagcacaaggcagtgttcttaacaactacgctaatattcttgagttactccttcggctaaggcagtgctgcgaccacccttttctagtgatcagtcgagctgatactcagaagtatactgacctcgatgagctagcacagaggttccttgatggggtgcaacgtgattccgcgagacgcagtgcgccaccttcacaggcgtatgtagaagaggttgttgaagaaatccgccagggcgcaactactgagtgtccaatctgccttgaatcagcttctgatgatccagtgctcacaccatgcgcgcaccggatgtgccgtgagtgcctgctctctagctggaggacgccttctggaggaccatgcccactttgccgaagccccattaccaaatctgagctgatcacattgcctagtcagtgtcgattccaggttgaccctgagaataactggaaggactcatgtaaggtgataaaactcatcaagatcctggagggccttcaggagaagagggagaagagcattgtgttcagtcagttcacttccttcttcgatcttcttgaggttcccttcaatcagaaagggatcaaattcttgaggtttgatgggaagctcagccagaaacacagagaaaaggttctgaaggagttcagtgaaagcaaggacaagctggtgctacttatgtcactcaaggctggaggtgttggacttaatttgactgctgcctccaatgtgttcctaatggacccatggtggaatcctgcagtggaagaacaagctatcatgcgaattcaccgtatcgggcaaaagagagcggtccaagtaaggcgcttcatcgtcaaggatacggtcgaggagcggatgcagaaggtgcaagcgtgcaagcagaggatgatctctggggcgctgaccgacgatgaagtccgctcggctcgtatcgagcaactgaagatgctgtttacatgagaagtcttgatcatgagtttgcaggatgttgtacagttcatattttgttccctggagacttgctagcattttaggggaaatgatccaatgttttaagggttcggacttgtgaatggggatggaatgggtgtgaaactatgtgcccattcgattttgtggatatatctccattctggtctgaacattttgtatatagtggctcttcttaacatgaaaggcctctaccctttctaaatcgtgatctattgtgctgaaatggctgttggtgttaaccagggagtaaaaaatctctactgaggcttcctttcatcc

SEQ ID NO: 6119 - DNA, 2698 bp, Oryza sativa
  Predicted polypeptide sequence is orthologous to G1526
catggacactgtcctcttgtccgtaagtgtctacatcaacagctcaatgtttcatggccaaaagcaatcgacacccaaggctgctcgggctgctaccgaggattccacgtttcatccgctgcctgcacttttcaagttaactggtctttccccctttaagaaggcagcatttactccagaagatctctattccagaaagcgtccgcttgaaacaaagagcagtgcacctgccacaaagttgactactgagaagttgagattatcgtctgatggaaacgaagatgatcatgctgaaagaattgtttcagattcagaattggatgatataattggaatctcagacagttctgctttggaggaaagggacccccctgatgctctgcagtgtgatttacgcccttatcagaagcaggcattttattggatgatgcagcttgagaaaggcagttcttctcaggatgcagctacaacgctgcacccttgttgggaggcatataaactcgaggacaagagggagcttgttttatacttgaatgtattttcaggcgatgccaccactgaatttcctagtacactgcaacttgcaagaggagggattctggcagatgcaatgggactggggaagactattatgacaatagctcttcttcttgccgactctagcaaaggatgcatcactactcagcattctactcacatatgtgaagaagctagtggactgggtgaattgccagttcagcctcatgatgatgtgaagaagctagctatccctttctcttttagtaagcttaggaaacctaaaaccccgcttattgcaggcggcaatctaattgtctgcccaatgacactacttggtcagtggaaggcagaaattgaagctcatgctacaccaggttctgtaagtatatatgttcattatgggcaaaacagaccaaaagaagcaaaccttattggtcagagtgatattgtcctgactacatatggtgttctgtcatcggaattttcaaacgagaattcaacagaaagtgggggtctgtactctatacattggtttagagttgtgctggatgaagcacacatgataaaatctcccaaaagtttaatatccctcgctgctgctgctcttacggctgatcggcgttggtgtcttactggtacacctattcagaacaacttggaggatatatacagccttttccggtttttgagggttgaaccgtggaggaactggtctttgtggcataaacttgtgcaaaaaccatatgaagaaggcgatgaaagaggtttaaagctagtacagtccattttgaagccaataatgttgagaaggaataaaaacagcacagacaaggaaggaagaccaatccttattttacccccagcaaatatcgaagtcaaatactgtgatttgtcagagactgagaaggatttctatgatgctctgtttcgacgatctaaggtgaaatttgatcaattcgtggaacaaggaagggtcttgcacaattatgcttcaattttggagttgcttttgcgccttcggcagtgttgtgaccacccatttcttgttcttagtcgtggagatacacaggagtttgctgacctaaacaaacttgcaaagcgtttcttgcatggtggtaatggtgctgtgaatggtgactcttctcttccctccagagcttacattgaggaagttgtccaggaactgcagaaaggtgaaggggagtgtcccatatgcctggaagcctttgaggatgctgtattgactccctgtgctcaccgtttatgccgagaatgtctcttgtctagttggcggagtgcatcagcaggcctttgtcctgtctgtagaaagtctatgagcaagcaggatcttattactgctccaactgacaatcgttttcaaattgatgtcgagaagaactgggttgagtcttccaagatttctttccttctacaggagctagaagttcttcgcacttctggtgcaaagagcatcatttttagccagtggactgcatttctggatctcttacaaattccactttccagacataatttctcatttgctagactggatggaaccttgaatcttcagcagagagagaaagtaatcaaggagttttctgaggacaaaagcattttggttctgcttatgtccctgaaagctggtggtgttggaataaacctaactgctgcatctaatgcatttgtcatggatccttggtggaatcctgctgttgaagaacaagctatcatgcggatccatcgaattggtcaaacaaagagtgtttccatcaaaagattcatcgtcaagggcactgtcgaggaacgaatggaggctgtgcaggctcgtaagcagcgaatgatttctggagctttgacagatcaggaagtacgcagcgcacgtatagaagaactgaagatgcttttctcctgacaaaccaagagtcgccattcgtttactgaaagccaagaataggaaggtaaaacgaggggtaagaattccaaatgttgcaaaaactcgaaattcagatatcatacgccttctggcattttgctgttgttgtatacctttcttgtgtatactaatatgtatgaatagtggcgtggaagaaagattgagagctgacagaagaggtaattcattgcatatgtatgtacaacatgggcttaattaatggtacccgtaacgtaaccgacc

SEQ ID NO: 6120 - DNA, 820 bp, Oryza sativa
  misc_feature (432)..(526): n is a, c, g, or t
  Predicted polypeptide sequence is orthologous to G1526
ttttttttttttctccctagctccattcacatacttctcaacattgcatcggaattcggaggaatacacatatacatacataaactttcttttagttttagcccgctaatatggtatacaaaaataagcaaaaggaaaaggacaggatgccggatgcaatgcaccactgtacatacctgctgtgcatgttaaccacagttaaccacaaaaatacatgcacgcatgaatgtctcctactgcctcctgaagccagcactttgtttactgacactgaggcactattacgaaatgataaacgctactactacctattgtcagcaagaggcacctattgcatttcatttcattcccatcatcatctcctcgatgctatccttcacgatcagcctcaccactttcacctccttggtctgcccgatccggtgcaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaactgtctccgtgtaaatagtgccggacaaaatgccaaaacactccataatgcacacgtaaatcaaatagcagtaatccaggaacaaagcaaacctaccgggaccgcaaaaaccaacgataaggaatacaccagtaataaataacaacatacactgcgccaaaagtcatagcctaacgttaagtacacaacaaaacaaaaaaaggcacaacaatacgctccttctcgctgtgtccttacgatctctcactgcacctaaatacacacaaagacacaacaagaaccaaacaga

SEQ ID NO: 6121 - DNA, 3742 bp, Oryza sativa
  Predicted polypeptide sequence is orthologous to G1535
gggttactcctcttcctcgctcgctcgctcgctgccttagccttgacctccatcgatattgcaaccataaagaggaggaggaagaggaggcgagaaagagagagagatcgtcttcttctccagccagccagccagccgtgattgatctcaagggggaaggcagctgcagggatcaagaagaaggagaagaagtgatcaaggaaggaaggccacggaacaaccgacagggcaggagggcgctggccggatcgccggagaaggaaccactagctagctagctagctactcctattgaagatatcgccggccggacatatgcgcaggatgttcggggactgccaggtcctgtcgtccatggccgccatggccggggccgcctcctccgccgacgcgctcttcgcctcgccgctcatccccaaccccgctctcgccggcttcatgtcctcctccgccgccatgcccttccaccacttctccaacgccgccgccaccttaatacctaaggaggaggggttgatgggcggcctccatgtggccaaggacgaggggatggacctcgagatggacatggagctcagtggcggctccggcagcgcccacctcgacggcctcctcagcttcgccgacgtcgacgacgaccacaagccgcagcacagcggccatgaccagccgcccgacgccgcccagcccagcggcgccgcggggggcaacgccaagaagaagcgctaccaccgccacacggcgcaccagatccagcagatggaggcgctgttcaaggagtgcccgcatccggacgacaagcagcggctgaagctgagccaggaactgggcctcaaacctcgccaggtcaagttctggttccagaatcgccggacccagatgaaggcgcagcaggacagggcggacaacgtgattgtgcgcgcggagaacgagaacctcaagagcgacaacttccgcctccaggccgccatccgcaacgtcgtctgccccaactgcggccacgccgccgtcctcgccgacatgtcctacgaggagcagcagctccgcatcgagaacgccaggctcaaagacgagcttgaccgcttggcctgcatcgccacccgctacggcggcggcggcggacggcagccggtgctgtcgacgtcggccctgagctgcatctcggcgccgccgccggtcctcatgccaccgctcgacctcgacatgaacgtctactcgcggcacttcgccgagcaggcgccggtcatgggctgcggcgacctcatcccgccacccgtcgtgccgcagcacgatggcgcggcggcgtacatgggcgccatgatggcgcccgtgcaggagcaggacaagcagctggtggtcgacctcgccgccacggcggcggaccagctcgccaggatgtgccgcgccggcgagccgctgtgggtgcggcagcgtggcgcggaggtgatggccgtggaggagcacgcgcggatgttcagctggccggtggacggcgcgaagcagggagacggcggcgcggtggcgagggcggaggggacgcgtgacaacgcggtggtcatcatgaacagcatcaacttggtggacgccttcctcgatgcgaacaaatggatggagctgttcccgtcgattgtttgcaaggcaagaacaatccagatcataaaccacggagctgcgtctggtcacctcggcagtggaactctcctcttgatgcaagcagaggtgcagttcttgtcgcctctggtggcggcgcgcgaggtggtgttcttccgttactgcgtgcacaacgccgacgaggggagctgggcgatcgtggatttcccggcggaagggtttgaggaggggctcctccaagcctcggtggtcaggtgccggcggcggccgtccggctgcatcatccaggacatgcccaatggatactccagggtggtgtgggtggagcacatggagatggtcggggaggagaagccgctgcagccggtgttcagggactacgtcgccagcggcgccgccttcggggccacgcgctggctctccatcctccagcgccagtgcgagcgcctcgccagtgagctcgcccgtaacatcgccgacctcggagtgatccgcacccctgaggcaagaacaaatatgatgaagctgtcgcagcggatgatcaccactttctgtgctaacatcagtgcttctggaacccaatcttggacggccctctcggattcaacccaggacactatcagggttacaactcggaagaacactgagcccggacagcccagcggtgtcatcctcaccgctgtctccacaagctggcttccttttacccatcagcaggtgtttgagcttcttgcagatgaacaacagcgctgccagcttgagattttgtcaaacggcggctcccttcatgaggtggcacatattgcaaatggatcacatccaaggaattgcatctctcttcttcgcattaacgctgcaagcaactcgtcacagaatgtggagctcctgctgcaggagagcagcacccaccctgatggtgggagcctggtggtgttcgcgacggtggacgtggacgcaattcaggtgacgatgagcggcgaggatccttcctacatccctctcctccccctgggcttcgccatcttccctgccaccagcccatcacctgctgctgcacccaccatcagctcaagcaccaccaccaccactggcaatggcaatggcgaaaccagtagcactcctccaagaaacagcagcagcaacaacaacaatgcagatgagctgctgcctcccaatggctgcctcctcaccgtcggcatgcaggtgctggccagcgccgtaccttctgccaagctcaacctctcgagtgtcactgcgatcaacagccatgtctgcaacgccattcaccagatcacagctgcactcaaaagttcagcaggtggtgctgggggtgagccggcgtccgatcagtagcaaaggagacctggaggagaggggatcggagcaacatgggatcagacaccaaaatgcctcccaatttatttcgctaacatcgcagtttgtttttctgttagctctcggtctggctggttcatcaggtgcaagggagggtttgacaagaagccaacactaacagctactcaaatctctcctctcttcccgccatatttctgcctctcaaaatgacgaaaatacccccaaccagccaacaagcaaagccatggggggcattttgatcattttgggaagctacttctgctgagaaagaaagaaagaaagaaagggtcttgtcaagctctcacttgcaccaaccagctgattcatgaatttgctgacatcagctctgcaggcattttggtcgtgcatcggtttcttgctactccatccatccctctttaggttcttcctccctttcctcatcaaaagtgagaactgcatgtgaagaaggttagctccttgttttgaatttttgtaataataagatggaagaagaagacttggtagcttgagtgtgtggtttgtgttaagatcgagctagactttgtgtaaggttgaagaagaagaagacattaagcagattgttattaggagatgagataagagaaaggaggagaggagaagtcaagagcgaaccagttgtgacccttcttcacactagaagggggtcttggttcgggaattgacttgttacctctctgcactctttgtctgtaacctttgccctatcttattattactactagtattgttc

SEQ ID NO: 6122 - DNA, 942 bp, Oryza sativa
  Predicted polypeptide sequence is orthologous to G1537
atggagacgacgacgacgacgttgggcggcggcggcggcgggcgggcgggaggcttctccgatccgccgtctccgctctcgccgccgctgtcgccggcctcggcggcggcggcggcgctggcgaacgcgcggtggacgccgaccaaggagcagatcgcggtgctggaggggctgtaccggcaggggctgcgcacgccgaccgccgagcagatacagcagatcacggcgaggctccgggagcacggccacattgagggcaagaacgtgttctactggttccagaaccacaaggcccggcagcggcagaagcagaagcagcagagcttcgactacttcagcaagctgttccgccgcccgccgccgctgcccgtgctccacaggccactcgcgcggcccttccctctcgccatggcgccgacggcgatgccaccgccgccgccgccgccggcgacgacgacgacggccgcatgcaacgccggtggtgtgatgttcaggacgccaagcttcatgccggtcgcgacaaataacgccagctactacccgcagcagcagacgccgttgctgtacccagggatggaagtgtgtccgcacgacaagtccacggcgcagccaccggccaccaccaccatgtacctgcaggcaccgccgagcagcgcacacctcgcggcggcggctggccgcggcgcggcggaagcggaaggccatggccgccgcggcggcggcgccggtgggcgcgagaccctccagctgttccccctgcagcccaccttcgtgctgccggatcacaagccgctccgcgccgggagcgcctgcgccgccgtgtccccgacgacgccgtccgcgtccgcgtcgttctcgtgggagtcggagagctcggacagccccagcagcgaggcgcctccgttctacgacttcttcggcgtccattctggaggccgctga

SEQ ID NO: 6123 - DNA, 624 bp, Oryza sativa
  Predicted polypeptide sequence is orthologous to G1537
tttttttttttttttttttttttttgcaataaattgagaaactgcatatttgattgttctatttcctctgtgctttgattggttaggatgtcattttctgatacattgccatcattcggttcaattttttgcccccagaccttgtactgacatgttgcttccataccattacgatacggctacacccagaaaaaaaaatcaagattactttcactttacatcagtacttgactaacttaatactttccctttcccaagtccaggtccaggtcaacgttcttgtgagttgtgattatccctgatgtggtgttttaattcatgtgcacataataggaggtttttgtgtcatgaatttatttccttacatgagaaccaagcagttcattttgcagagcccaaaggaagaacctcctctggtcaaacaatgcccccttatattatccctctgtgcctgattctcttcatcatccaagctagtcattccatgggagctcagatcaatgagacaagcattcctcaagggtctgaaatcaacacagctgtgccccaaagttgggtttcccctctaggggcattgcgcgtggggtttaaacccaagggggaggatttccaatggtgtgtcgc

SEQ ID NO: 6124 - DNA, 1170 bp, Oryza sativa
  Predicted polypeptide sequence is orthologous to G1538, G1545
gacagactcggacaccaccggtcacttgaattgtcaagctagctagccttctcatcagcctggctctcagtctcaaagaaagcacaaaggtagctagcttagcatcgattgaagctgaccagagagatagttaagaatttgccatagcttagtgtttggtgcatacacacaactgctctcgttgtttttgctcttttgggttcgctcggaagatgagccgtgaggaggatgagaagctgctgttcccttcgttcgccttcccggcggagtgcttcccggaagccgccacctccggtggcgagcagaagaaggctcggcagcggcggaggaggaaggtgaagccggaagcggcggcagcgttggctggagagagcggaggggatgagcaggcgaagaagcggcggctgagcgacgagcaggcgcggtttctggagatgagcttcaagaaggagcggaagctggagacgccgcgcaaggtgcagctcgccgcggagctgggcctcgacgccaagcaggtcgccgtctggttccagaaccgccgcgcccgccacaagagcaagctcatggaggaggagttcgccaagctccgctccgcccacgacgccgtcgtcctccagaactgccacctcgagaccgagttgctgaagctgaaggagaggctggcggatgtagaggaggagaaggcgaagctagcagctgtcgccgcggcgacgaccggcggcggtggtggcggcggcggcggcagcagcagcccgacctcgtcgtcgttctccacggtgacgtaccacccggcgctggcggggcagttcggcgtggaggcggcggccgaggaggccgacctcacctacatgagtgagtacgcgtacaacagctacatgctggagttggcggcggccggctactgcggcggggtctacgaccaattcagctgagcgccgccactcgccggggccggcgccgacggaggattaactagctacagtagctgttaattaatggatcgatcaattgcagggtagtaattcagtagtggtggtgtttattagtagtatcaatgatcgatatatcatcagtcgtgttgccctaacgaaaaatctttagcggtgactttgctaagccatgtagattattaaattggatgtctttgtaagtatatgtgtttagaatacc

SEQ ID NO: 6125 - DNA, 1173 bp, Oryza sativa
  Predicted polypeptide sequence is orthologous to G1538, G1545
cggacgcgtgggtggtggtgcgtggtcctcttctccatccagagacaatccagttcagttcagtttcctctctccctcctgtcctcacctcacgcttgacaagagagagagagagagagagagagagagagagagagagagagagagagagagagagagaaaggctgaactgagctgagctgatcgagctagtgtgcgagacggcatggaccgatacggcgagaagcagcagcagcagcagatgtttgcctcctacgtggacgcctccctcctagcagccagcggtgaggtgcagggcgagaggccgagagcgcggaggaggaggaggcgtggggcgaggtgcgttggcggcggcggcggtggtggcgaggtggacggaggggacccgaagaagcggcggctgagcgacgagcaggtggagatgctggagctgagcttccgggaggagcggaagctggagaccgggcggaaggtgcaccttgcctccgagctcgggctcgaccccaagcaggtggccgtctggttccagaaccgccgcgcccgccacaagagcaagctgctcgaggaggagttctccaagctcaagcacgcccacgacgccgccatcctccacaaatgccacctcgagaacgaggtgctgaggctgaaggagaggctggtggtcgccgaggaggaagtgaggcggctcagatcagcggcggggagccacacggcctccggagaaggcggagacatcatgggcttaggcggcagcggcgcctgcgtcgccgggagcccgagttcgtcgttctggacgggtacctgccagccgccgagtttcggcggcggagatcccttcggagacgatgacctggtgtatgtcccggagtacggcggttacgctgataacagtgtggttgagtggttcagcctgtatggattgatctaacgaagatcaagttgatgatggcatgtgcggggaatttagttagtcatagtgttaattaagctgtatggtgatcgatcgaactgatatggtcagctttaagtgtgtgtgtttaattatgtacataaagtgattaatggcaaaacctggccagctagctagtaatgtattaatattagtagttcgcttaaaaaagatcaagatgtgtgttcaaaaaaaaaaaaaaaaaaaaaaaaaaaaaaaaaaaa

SEQ ID NO: 6126 - DNA, 1482 bp, Oryza sativa
  Predicted polypeptide sequence is orthologous to G1539
ggtttctatttgattattactatgttcaattcgacggaatcttagaggaggaaaatccaaatgaatggatgattgatctaatcgcagctgatataccacctatgaggcacacggatgatcctggcgcaatatatgccaagtgctatgacgcggtgcgggtgtactcggtcgaggtgaagcaaatcaagtgtgggttgcggtggcctatcgaggtgtttggccatgtcgccgtgcgagacagcgtcgatcgcaagcgcaacctcgtcttcaatcgtggccgggacgattgccaaacgctcacggcggaggtgatcgatcgaccttacctcaaatcagctacctgaaaatttgctcgcacacgcacattattattgcaacatccagtgctaacgttgccttaatcagctctagctaaacattgctcacccttgcacaacactatttttctcccaagtttttcctgctaacgatgtcatcttgttatttgcgtggtacttactagttcttctgctgttatggttgtactagcttgagcaatatagatatgcagtacatactaccacatcagtattcagatagcattgcttttgtttcttagcatatgcgtgttaaatactctacagataaattgatgtcatctattaaaaaacggaggtagtacaacttaaagtagctacactatggttccccttgttttactgtgtttcatatttgaaaacaaatttgtcttggatcgaaatatatgtgtataacacatatggctgtaatcaatatttgcaggactcctctttggtgttaacagggcctagtcgatatgtcttggcaatggacaatccggactttgaagttgagctaaaggtcaagggaattgcggagactgaagacaaggttttgagctctcatgcctttacattcaactgcatctatgacgatggtagtagtgttaagaggcgcgtggcttccaacaagcgcagcacggtgcagatcacgtttgctttaattccagagacagtggaggcgacatttgaggttaaagtcgttgatgggtcattggatccttccctacgcccacatttctttgcttctactcaccaccatcccagcacggaatgtgtgttgcttgatcctcgagagggtgcaacggtgatcagcgacaataatagtgtcaaacttactcgatctgttgtttccgttgaagtgctggggggattgaagcttactgcagaggctctagatgatgaaaaagctgttgttcctaggacaacaattatcttcgaaccacaaagggatggtagagtgtatggatttcttgatcttaattgttgtaagatggtggttaaagtttcctggtctcgactttccatttgttgactgaacattattttgtagccggtgctatgttgatatgtaggaacttgtgctatccttttttatgattaatgttagctatgtactgatgtatatgatcttttgccatctact

SEQ ID NO: 6127 - DNA, 870 bp, Oryza sativa
  Predicted polypeptide sequence is orthologous to G1540
atggatcacatgcagcagcagcagcggcagcaggtgggtggagggggaggagaggaggtggcggggaggggtggtgtgccggtgtgccggccgagcgggacgaggtggacgccgacgacggagcagatcaagatcctgcgggagctgtactacagctgcggcatcaggtcgcccaactcggagcagatccagcggatcgccgccatgctgcgccagtacggccgcatcgagggcaagaacgtcttctactggttccagaaccacaaggcccgcgagcgccagaagaagcgcctcaccacgctcgacgtcaccaccaccaccgccgccgccgccgacgccgacgccagccacctcgccgtcctctccctctcgcctacagcagctggcgcgacggctccctctttcccgggcttctacgtcggcaatggcggcgccgtgcagacggatcaggccaacgtcgtcaactgggactgcaccgccatggcagccgagaaaaccttcctgcaggactacatgggcgtgagcggcggcggcggcgccgccgcggcggccccgacgccgtgggcgatgacgacgacgactcgcgagcccgagacgcttccactcttcccagtcggcggcggcggcggcgacggcgcgcatcgtcacgccggccacggcggtttcccgtccaacttccagcgctggggttctgctgctgctaccaccaacaccattacggtccagcagcatttgcagcagcacaacttttacagcagcagcagcagccagctgcacagccaggatgggccggcagcaggcacatccctggagctcactctcagctcctactactgctcatgctcaccttaccctgcagggtccatgtga

SEQ ID NO: 6128 - DNA, 1174 bp, Oryza sativa; identical to SEQ ID NO: 1973
  Predicted polypeptide sequence is orthologous to G1543

SEQ ID NO: 6129 - DNA, 742 bp, Oryza sativa
  Predicted polypeptide sequence is orthologous to G1554
aatattctcctcacataagaataattcttttcgacatcacaatttagcccaaaaattatacaatgtgatgtaattaacacctctcatattctcaaaccctctacaacaacaactcaaattactcacatgggtaactcccgtacttaatctcatcctccaaaaaaaaagcccaaaaaaagctctcaaccactgtacagaaataggcctaagttcttcggtcactgctgctgtgcagcacctggagacaattaattaatggtgctcaagatgatgatgatgcccttgccccattctgcatctcccagctatagctccccgacttcccgtcctcctcttcctcctcaccgccgtcgcagctatcgccggcggtcactgacacggcgtggctcgacgacacggtgagctggagggggccctgcggcgagccagactgcgatgtgctgtgctgcgaggtggtgtattgctccggtggcagcggccatagacggccgccaaccgtctgatggtcaccgccaccatcaccgccgtcggatgcccgccgcgtgtgcagccggtacttctgcaggtggcttttgacttcatcattagtgaggccatcaaccttcatcagctccctaatctgcttgggagttgcagcttgtgggccaccgaggcgctggagcgcggcgacgaaccggcggtggagctccggagaccaacaccgtctggccttccgttgcaccgcctgctgccgctgcgctac

SEQ ID NO: 6130 - DNA, 1947 bp, Oryza sativa
  Predicted polypeptide sequence is orthologous to G1554
cttcttcgtcttctgacctaaccctagacgaccaccaccatctgacggcggtggctgcggcgtcggggcaggcgacgcagaagcttcaggagttcttgtcacgtctcgaggaagagaggctcaagatcgacgccttcaagcgtgagctccctctctgcatgcagcttctcaatcatgctatggaggcgtacaggcagcagctggaggcgtaccagatggggagccagcatagcgccgcggcggcggcggcggcgagggcgccgctggtgctcgaggagttcataccggtgaagaacatcgggatcgacgtcgtggcggcggataaggcggcggcggcggggggcaacagcgtgtcgtcggagaaggcgagctggatggtgtcggcgcagctgtggaacgcgccggcgtcggcgtcggcggcggacacggcggcgaaggggccccagacgcccaaggagcactcggagcaccacccgctcgacacgagccccaagctgatcaccgccgccgcgctgccggagctcgcgctcgcgcccgcggagaaggcggcggacgcgatcaccatcgccgccggcgaggtcgacaagaagccgtacgcccacgacaacggcgtcgtggcgagatcgagagaagcccagaacggcgggaagccgccgtcgacgccatcggacgggcaggccgtcccgccgccgccacagccccaccggaaggcgcgccgttgctggtcgccggagctgcaccgccgcttcgtcaatgctcttcagatcctcggcggcgcccaagtggcgaccccgaagcagattcgcgagctgatgaaggttgatggattgaccaatgatgaggtgaaaagccatctccagaagtacaggttgcacacaagacggccgatgccgtcgccggcgccgccgacggcagcgacgccgcagctggtggtgctgggaggcatctgggtgccgccggagtacgcgacgcaggcggcggggccggccatctacggcgcgcacccggcgacgcagccgcactacacggcggcggtggcggcgcaggagtactaccaccaccaccaccaccacctgcagcaccaccccgccgccgccgccctggtgcaccaccgcgccgtagccccgcccccgccgctgccgcctcagcagcagctggcccctccctacagcgccaagtcgtcggcgtcggcgaggctcgggtccccggactccgacggccgtggcagcggcggcggcggcggcgccgccgcctccggagccggaagggacatgtccgagagcatcgaggaggaaggcgagggcgaggagcgggaggacgacgacgacgacgacgagatggcggcgaccaacaacgcccacgccgtcgacggcgacgacgacaacgacgagatcaacaccaccaccaccacgagcgcgggagcgattaactactaattaatcaaccaaaccaaccaatcaaatcaccacgcgtcgtaattaattactcattagtaataatactagctagtagcttaattaatcgcgctaatccgggagattaattagcgtcacctggaaaaagggaaaagtgattttttgttggcgcgcgcgcgcggagaacgggagccgagccgagccgagccgaccagagaaggagcaggagcttgagcttgtctcactcgttgatgtgatgcatatgtatggaactatggatcgatggataatgtgagggctttactttgcttttgcttttgctggtttttttttctccctcttgtttttcttccttttttgggactctcagctgttcctgatttaataatccggtagtactagtagtaaatatcaaaattatgtgatggtggagagattaaatatgagctagatgtaattgtttgggagattatgtttgttgttgttgttaagttgagaattgtgaagagccaccaataatgcataatgcagg

SEQ ID NO: 6131 - DNA, 1473 bp, Oryza sativa
  Predicted polypeptide sequence is orthologous to G1554
gattaatccgtccacaatcaaaccacttccatctctcaattctcaagcacacacacaatccaacaagcttctcgaagaattctcgatcgaggtggagtggtggtgtatgcgcgatggggctggatgtgggggaaatcggcgtcggcgcggcggacctgagcctggatctcaagatgttcgccgccaagagcttcggccgcgtcaggggcaaggacaccaccaccaccgccatgggtgactgcatccggaggctcgaggaggagatgggcaagatcgaggtcttccgccgcgagctccccctctgcgtccgcctcctcgccgacgtgattgatgtgatgaaggaggaggtggagaagaagggtggtgatcgtaaggaggatgaggaggacgccgccggcgacaagagcaactggatgagcaccgcgcagctctggactgggaattccggcggcccagacgccgccgccgctgatccagagaagcaggacaaggtgaggatctcgtcggaggcgaagtccaacggcggcgcgtttgtgggctctggcgcgccggctttcgcgcggccgaagcagagcttgatgaggaaggaggacatggcgtacgacgtcaggatgccggatctgtcgctgctctcgccgcctgcttccgccgccgccgccgacgaaagccgccgtcaggtcgtgggcttctcccaggccgcggcgagggctgccgccatggcggcgtctggccccgctctcagcctccagccccagcctcagccggcggcggcgcagcagcagcagcaggcgaggaagacgaggcggtgctggtcgccggacctccaccgcaagttcgtcgccgccttgcagcaactcggtggccctcaagttgccactccaaagcaaatcagggagctgatgaaggtggatggactgacaaatgacgaggtcaaaagccatcttcagaagtaccgcctgcacaaccggccgagagtgccaagctcaacaattgtgaaccaaccgattgtgctcatgcaagggctctgttacattcctcaagagcaaagcagctcccagtctggatcccctgagggtcctctccatttctcaggctcaggcatggccggtggcggctcatcggcggcgacggtcagctgcgaggaggaggatggcaggtctgagagctatggctggaaatgatccaagatgatgttgcatcagaaattttcatcacagctttggtgggttaggttaattgcggcgcggcgatgaaaaataataccagatcttcagggaggagtttgagaggagagactagtgtaggtgtttgtatacagtgagatcgagccttgagtgcttgagatgaaactgatggtgagttggttgttgtcatgtatatcgaaagagatgatactagctacagttttgcggcgagttttgccggttaaaggattcgggcagagctacagttttcgccctgagaattttaccc

SEQ ID NO: 6132 - DNA, 2217 bp, Oryza sativa
  Predicted polypeptide sequence is orthologous to G1560
cggcgtgatggacctgcctcgtccaatggagggcctcggcgaggccgggccgccgccgttcttgtgcaagacgtacgaggtcgtggacgaccccggcacggacaccgtcatctcgtgggggttcgccggcaacagcttcgtcgtctgggacgccaatgcgttcgccgccgtgctcctcccgcgctacttcaagcacagcaacttctccagcttcgtccgccagctcaacacctacgaaggtcgatccggatagatgggagttcgcgaacgaggggttcttgcgggggaagaaggagctcctgaagacgatcaagcgacgccggccgccgccgtcgagccccccgtcgtcttcgtcgtcgtcgtcgtcgtcgcagcaccagcagcagccggcggcggcgtgcctggaggtggggcagttcgggcgcgacggcgtggtgaaccggctgcagcgcgacaagagcgtcctgatcgcggaggtggtgaagctgcggcaggagcagcagacgacgcgcgcgcagatgcaggcgatggaggagcgcatctcggcggcggagcagaagcagcagcagatgacggtgttcctggcgcgcgccatgaagaacccgggcttcctccagatgctcgtcgaccggcaggccggccagcacggcgcccggaacagggtgctcgaggacgccctctccaagaagcgccgccgccccatcgagtacctcctcacccgcaacggcgagacctgcgccgccggcgagtcggcagctatgctggcggcggacggcgtggcggagccggacggcgacaccaccccgcgcggcgacggcggcggcggcggcggcggcgacaccgagagcttctggatgcagctgctcagcctcggcctggaggagaagcagcgagaggacggcgtcgccggcggcgtccaggagagtaacagcggcggcgctgacgtggacaacgacgaggaggatgacgacgatgacgtggacgtgctcgtgcagagcatatatcacctcagccccaagtgaaaggtcgagaaggttccacggcgaaaacgaagggtacgtttcgtttcgtagggtgacgtaatcgcaacagtagcgagtagtaggaatgtaggggtagcactgcacttgtctttctttccatttttttatagtttcggacatcttgtcgccgccctgcaagttgccaaaaaaagcagccaagccccactgccacaggcgacggaaggttcaagaagtcgagaagcttctcccgcgggggaagcttctagaggtgtccagtaagacagcacagtagctgcgggtgttcaagaagctgggaagcttctagatgtcctctaggacggtggcttcgaatgttcttcttctggaatttgcacctagtatcagctaattatgtgcgctgtattttgcccatgctactgccatatgcaactggtgcctcttatcccccaacagctactgctgcccttttaaaatttgaaagttacggagtaatttcagctgatttttaagtttcttcattagtagtttactttctgtattggttgtcaaatcttaaataaagttctacttataaatatcttggctatactagttcattttccccttgtcttttgtcatggaaggctgcctgttttgtcgtgtggtgacagttctgaacttttcatctatactggagtgctacgtggagtatatacatacaaagtgctccattttgtttgagccgtgccgtgagcgcgtgtccttgaccagggaaaaaaaatgttttgctttcaggttgcagaggacaagaggatgtcggtgccaaagatattttcaaacatactaaccgaaaagggcaccaaaatatcatcatctgaagatcttaacagtatcaagaaagtggttcccagctcatcaaatctaggagtactacgtggtaggagtatcaggctccacctgtacctggtgtcttaattaaggaaaaaagaacagagaaacgctcggagagatgattcagaagcttgacagcgagtatttcaggagtacgggtgtcgcttgctgcgagatttcacaacaggagactgtctgtcacggcgttgctgtaccacctctttaaaatggatcgtgggacaggacagttgacacgtagagtaacactcgtactacccgtttccgctaaatgtcaaaatcttgtacggagtactatctggattaaaattaaagtttatctatg

SEQ ID NO: 6133 - DNA, 2561 bp, Oryza sativa
  Predicted polypeptide sequence is orthologous to G1560
gagaagcttctccgcggccagtggcgacgctaccctacgcggcgtctagaaccttccacacctctcccgacgcctctcgacgtacggcgagggtatttttatctctccgaccaccctccgccctcgctcttcttccccccgcacacgaagaatttctcgcttcgtttcatccccaccattttttttttgtttgacctcgaaagggaaagcagaagaagaaaaaaatatcccaaaatatccccgaaattccaccacctgtagcagcagcgatcgcgtgtgttcttggttccaattcgtcgcctgatactccgattcgagttcttgatcaaagttgctggggttaatttgggttcttggttgtgaaaggcgggagggggggtcatggacccggcggcggcgggcattgtgaaggaggagatgctggagtcgcagcagcagcagcggcaggaggatggcggggcggcgccgcggccgatggaggggctgcacgaggttgggccgccgccgttcctgacgaagacgtacgacctggtggaggacccggccaccgacggcgtcgtgtcgtggagccgcgcgggcaacagcttcgtcgtctgggacccgcacgtcttcgccgacctcctcctcccgcgcctcttcaagcacaacaacttctccagcttcgtccggcagctcaacacctacatggaacaagatactggatgaagtacaagaaccagattgtttttgttctagaagactcaactgatcaccttcaaatgatataatatactgatgggcttcagaaaggtcgatcctgataggtgggagtttgcaaatgagggttttctcaggggccaaaggcatctcctgaaaacgataaagagaaggaagcccccgtccaatgcacctccgtcacaacaacagtccctcacatcttgtctggaagttggtgagtttggattcgaggaagaaattgacaggctgaagcgtgataagaacatcttgatcacagaggtagtaaagctaaggcaggagcagcaggccactaaagatcatgtgaaagccatggaagataggctacgagccgctgagcagaaacaggtccagatgatggggttcttggcaagagcaatgcgcaacccagagttcttccagcagttggcacagcagaaagagaagaggaaggagcttgaggatgccatctcgaagaaaagaaggcggcctatagacaatgttccattctatgaccctggggaaacaagtcagactgagcaacttgattcgccgtatttgtttgattcaggtgtgcttaatgagttaagtgaacctggaatccctgagctggagaatctcgcagtgaacattcaggatctggggaagggtaaagtagatgaagagaggcagaatcaaactaatggtcaggcagagctcggagatgacttctgggcagagctgttggttgaagatttcacaggcaaggaggagcagtcagagttggatggcaaaattgacggcatcgacgaactggctcaacagttggggtatctgagctctactagtccaaaatagagttgattttgtgattgttcatccaacaactactgctgcttcagtgcttttgaagatcatcttgaacaaactggaatgttggctgtgtacatccgtttggatgtagaggccggtttaatccattatctaaaaaaaatctgcaggaatgtggattagagtagtgattggatctttgccatcggggctgaatattgataatgccgatttttcattccattttttcgaatatatgtttctccatttcagccctgctacttgcttctgaattgctctgttgcttgttaaacagatccaattgactagtggaaatatgaccaactacggaaggtgttcatggtgtttcccagactatggacgccactgtctagaagctgtataaacagtctgtttgccgagcgcgggtggaggcgatggccgggaaggcggcgacggcgacggcggcggaggcggcggcgagggtttacccgtggagggagaagcttgcaaagtacaagggggagctgacgaagggggtgtgggggtactgggagctcggggcatggaagccgctcggcctcagcgcccggaagcgggcgcgcctcaggaaggaggtcctcctcgccggcgaggactggacctacgaccctccccgcggcgagatgcgcaccaagcggaagggccacaagtgcgaccgcatctccgccgagaagcgtgcgaacacggttgagctgatgaagaagatgccccagatgctccttgactacaagaaacgtagatgggagaaaaagatgaaagaggaggagagtggaaagagctgagctcaagctactcgataagaatgctgctctgcctaaataagtttgaatctgatatagtggcttcaaatgatggctggaggtgatctgtttctttcccttgttggccaccagctttcctgctgcctaaggcactttgtagtgctgatatttgattgcttctatagttcccaacacttgggtcaatgaatcatgatcttacccaggctcaacttc

SEQ ID NO: 6134 - DNA, 1994 bp, Oryza sativa
  Predicted polypeptide sequence is orthologous to G1560
gaattccactgcttccagaagcgagcgagctctcctttcctttctcctacgcctaggcttctagaagcttcctttccaaataggggctaatctcctgagctcgaagctctcctcgtcagcttcaggtggtcgggtgctgcctcctcctcctcctcctcctcctcctcgtcctcaaatctccccgagagttcgtgctttgccgcgagcagcgagctgcgatctcgcctgaatccttcgtcggcgggggggatgaattgatcacgcggtgtgcgctttctgattctgtcgggttcctttcagatgcacgagcacgtcggtgtccgcctcctctttgcttgatttgcttccgctgctgctgttaggtgcgcgagagctcgtgatggggtgaagcgtgtgttcacaggattagattgcgctcgcctgattcgctgcatcttgttcttcttgctgccgcctacgcgacttgatttcgtcacgccaaagccgtgacaggctgattgctaccttgcttggcgacctgtgctttaaattccaccattgtttgctggtgctggatgagcaaattcttggttcgtgtggctctagttggtagttcttgattgaggtgaggttctgagctgccatgaactaccgagtggtgaacccggtgaaggtggagagcgggccgtcgacgggcgtggcgaatggccagccgccgaggccgatggacgggctcgccgacggcggcccaccgccgttcctcaccaagacgtacgacatggtggatgacccgaccacggacgccgtcgtgtcgtggagcgccaccaacaacagcttcgtggtgtgggatcctcacctctttgggaacgtgctgctgccgaggtacttcaagcacaacaacttctccagcttcgtccggcagctcaatacctatggcttcaggaaggtggatcctgacaagtgggaatttgcaaatgagggttttctgagaggacagaagcatctccttaaaggcataaagcgtcggaaacctccgaattcatctccaagtcagcaatctcttggctcattccttgaggtagggcacttcggatatgagggagagattgatcagttgaagagggacaaacatctgttgatggctgaagtggtgaagctgaggcaggagcagcaaaacacaaagtcagacctgcaagctatggaacagaagctacaaggtactgagcaaaagcaacagcacatgatggcattcttgtcacgagttatgcataatcctgagttcatacgccagctgttctcccagagtgagatgaggaaggagcttgaagagttcgtctcaaagaaaagaaggcgccgcattgaccagggacctgaacttgatagcatgggtaccggttctagccccgagcaagtgtcacaggtaatgtttgaaccacatgatccagtggattcacttttcaatggtgttccatcagatcttgaaagttcatctgttgaggccaatggaggcaaggcgcaacaagatgttgcttccagtagctctgaacacgggaaaatcaagccatctaacggagagttaaatgaggatttctgggaggacctgctgcacgagggtgggctcgatgaggataccaggaaccccgctatagatgatatgaacttgctgtctcaaaagatgggctacctcaactcaagcagcaccaaatcgccacagtagtagctctggtctgatcttgctgcagctccaacgacccttgagtacttgttaatcaagcttgtcattatacttatccgctttgaggatgatcaatttgagtaggtctcctcccccatggtgatgatcttatggtagcatcagctgtacatactattgccgcaataattaccatcgtattctgttcagctttgtggaattagttttggatctgaatgtatggtactttgacagtggacttgagggtgctgtatgtacatataacagtctaactaaatgcagttgtgcgttgtaatgatgt

SEQ ID NO: 6135 - DNA, 2272 bp, Oryza sativa
  Predicted polypeptide sequence is orthologous to G1560
ggctgccaagctcgccggattcttttcttggattggagcagattggggggtgacgatggagaagatgatgccggggatggtgaaggaggagtggccgccgagctcgccggaggagggggaggcgccgaggcccatggaggggctgcacgaggtcgggccgccgccgttcctgaccaagacgttcgacctggtggccgacccggccaccgacggcgtcgtctcgtggggccgcgcgggcagcagcttcgtcgtctgggacccccacgtcttcgccgccgtcttcctcccacgcttcttcaagcacaacaatttctccagcttcgtccgccagctcaacacctacgtgagtccccccaatttccattgccaccactagtgttgttccctgcttgtcttcagttgttgggaaattgtgtgttctgttttcttgttttggatgttgttgttcagttcttggtccggacgaattacctgaacaagcgatcacatttctacagtttgagatttcaggttggattgttagataattaaaatgggtgtgttctcacttttgtggttgccattatgttttgtgccacatcgtgtgtgttgagtattgataggaatcttgacactagaattaaatggatggagcattgtaaaattttcagtgcaaattgtaaacccggcggtattggttaaataaatcggttgtattgtgcatttttccactcagtgcaagaactttgtgcatgcacaaatgcacaattatgtagcaatggagctagaaactgggatttacttattggtgctgacctgttggttgtagaaaattacgatggctacaattgttcaacggactgttttgtggacttgacattatttgcccaaactcagctatgtccaatccttttcagacacatgcatataaaccctcaattcctgaaatgttctcaatgattcagaaagaggaaaaaaatctccatggacgaactactcagtttctgacatgctgttttcttcaatttgttactgtgtagctagatggatcaagacagcggatgaagctacaagaatctgcttgtttgttctagaagactcctttgatcaccatcaaaaaaaagaaaaagtgatgtagtatactgctacctgttctcttaataatgctatgataaattttgtcgcaaaactatgtgaaaccaaccgttttacatactttgtgtgacttgctatcctaattgagttttgtctgtggcttctgtacttgaactaactatacctgtaatattctttgtgtttgcaatttgcagggtttcagaaagattgatcctgacagatgggaattcgcgaatgatggtttcctgagaggccagaggcatcttctaaagatgattaagaggaggagaccattgtcttatctccctggatctcagcaggcacttggcacctgccttgaggttggtcagttcggattagatgaagagatcgacaggctaaagcgtgacaagaacatcttactcgcggaggttgtgaaactaaggcacaagcagcaaagcacgaaagccaatatgcgagccatggaagagaggctgcaacatgcggagcagaagcaggtccagatgatgggtttcttggcaagagcaatgcagaaccctgacttctttcaccagttgattcaccagcaggataaaatgaaggggctcgaggacacattctcgaagaagaggacgaggtcgatagacatagtgccatttctcaaccccggggaggtcagccagggcgatcaactcgagtcgacattgctgtttgatccaaggccatttgctgaactgaatgatgagcctgcaaagtctgaactggagaatttagcactgaacatccagggtcttgggaagggcaagcaggatgtcaacaggactcgaaatcagccacgaaatcaggctagcaacgaaaccgagttaaccgacgacttctgggaggagcttctgaatgaaggagcaagagatgatgctgggattccagggatggagcgaagaagacctagatatgtcgatgcattagcgcagaagctgggttatctaagcaatagtagccaaaagtagatcaagtggctccgatttgtccaaccatttttgtgatagctcttattgtatatcggtgtaattgtattatagtgatagttttatagcgataggtccaatttatattgcggatccggcgtgctgtgtagtatatgtctggtgatgtaaagttgagccatcattcttaatggtatatattgacaattttttgc

SEQ ID NO: 6136 - DNA, 1956 bp, Oryza sativa
  Predicted polypeptide sequence is orthologous to G1560
gcagtagcattcaccttctccgccctcccccctccgccgcctccgccgctcccccaccttccagaaccttcctttcccgaaatagccacccctaccctaccctaccctacccacccccgccaagatccccgccgccggcgagctcgagcccttggtggtgctccggcgggcgttgtcgcggtcggatcagctgctgctggtgctggtgatgccgctctctctttcttgcgtgtacttccgggtgggaggttgatggcgatggtgaggtgttctttggcgcggttgccctcgcccccactcttatctcctctcctcgcccatgctacctaccttcctcccccgccggagctgctctgctgctcgtactagcgtgggagctgcctcttcttgttgagccatttcttgcctacaaggacagggtgcctcgccgtcgccattgccggcgtcggagccggacaaggaggttcagtgtactgtaccgtggttttgggccttctgagctatggatgatccaatgctgaatgcggtgaaggaggaggagagccacggggacggaggagggttggaggtggtggcgggagaggatggggcggcggcggtggcggcgggggtggcgccgaggccgatggaggggctgcacgacgccgggccgccgccgttcctgaccaagacgtacgacatggtggacgacgccggcaccgacgccgccgtgtcgtggagcgcgacgagcaacagcttcgtggtgtgggatccccacgccttcgccaccgtcttgctccccaggttcttcaagcacaacaacttctccagcttcgtcaggcagctcaacacctatggtttcagaaaggtggatcctgatcggtgggaatttgcaaatgagaattttctgcggggacagagacatcttctcaagaacatcaagcgtagaaaaccaccttcccatactgcttcaaaccagcaatcccttgggccataccttgaggtgggccactttggatatgatgctgagatagaccggctgaagagagacaagcaattattgatggctgaggtggtgaagctaaggcaggagcagcagaatacaaaggcaaatctgaaagccatggaggataggctgcaaggaaccgagcagaggcaacagcagatgatggcattcttggcgcgtgtcatgaaaaatcctgagttcttaaaacaacttatgtcccagaatgagatgagaaaggagctccaagatgccatttcaaagaaaagaaggcgtcgcatagatcagggacctgaagttgacgacgtcggcactagcagtagcatagagcaagagtcaccggccttgtttgatccccaggagtcggtggaattcctcatcgatgggattccctccgatcttgaaaactcagctatggatgctggaggtctggtggagccacaggatttcgatgtcggcgcctccgaacagcagcagatcgggccccagggggagttgaacgacaatttctgggaggagctgctgaacgaagggcttgttggtgaggagaacgacaacccggtcgtcgaggacgacatgaatgtgttgtcggagaagatgggttacctcaactcaaatggcccaacggctggggaatagctaatttcattcaaattataccacattgctgtcagctttcgccatgtgaatttaactgaattttagttgaatttctgcttgctactggcatgcctccctccctgtgttactgaccgtagtgatttgttcgttgttaggccatatagcctgccagtcatgtaaaatgagtaaaggtgttgatgatccacaaatgttctgttccgtgttgtcagatggtctgcctgtatttgtagtcgtgcttagtgtgtgcaatgttgtaatgatatctaatattaatctgtacttctcgtaatgacatctgatcttaatctgattgcagaagtgctttgaattgc

SEQ ID NO: 6137 - DNA, 328 bp, Oryza sativa
  Predicted polypeptide sequence is orthologous to G1591
taatgataatatatatataatataatgatgataatgatgatgatgatgatgatgatgatatgatgatgaactgttgcagctgatggatttgctgattggctggcaaagcagctgggcaatgatttggctgcgagaaaaggaaggagtttgcaactgtgggattacatgctggtgaagtatattagcatggagtttgctatacatggaataggatacctgttatatctatgtatttccaaggattattgtgttgaggctctgcgacaatattatcagatgaataccagtagccctgtgctcgtttgttaacgtaaaaaaaaaaaaaaaa

SEQ ID NO: 6138 - DNA, 612 bp, Oryza sativa
  Predicted polypeptide sequence is orthologous to G1591
atgcctcagaccccttcgacgcggtggtgcccgacgccggagcagctgatgatcctggaggagatgtacaggagcggcgtgcgaacgcccaacgcggcagagatccagcaaatcacggcgcacctcgcctactacggccgcatcgagggcaagaacgtcttctactggttccagaaccacaaggcccgcgagcgccagcgcctccgccgccgcctctgcgcgcggcaccagcagcaaccctcaccgccctcctccacggtgcctccggctcccactgctgctgctgccggtgccgtcgtgcaggtgcaccccgcggtgatgcagctacaccaccaccaccaccaccatcacccatacgctgcggccgccgctgcccaaagtcatcacctgcagcagcagcagcagcagcaagctgagtggccggcggcggtggactactgcagcactgcatcggcgtcagcgtcggcaactgctgctgacatggcgatcccgccgtgctgccggccgctgaaaacgttggagctgttcccgaccaagagcaccagcggcggcctcaaggaagattgctgcagcagctccaagtcctcctcttgctccacctccaccaattaa

SEQ ID NO: 6139 - DNA, 2016 bp, Oryza sativa
  Predicted polypeptide sequence is orthologous to G1635
gattttccccttcctgccttgcctcctcgtctccttctctgctgctctccaagctcttcctgcttccatcaggttgtctcgagaaagattggagtttttggtggtttgggttgtgcggttcttgcttttgttggcgcaagcgcatggctggttctgggacatagtgagctgagatagagttcttgtgttcggtggagtttggctttggtgaatcttcgattcaagtctggagatggcgcgttttcaggaaaccaaggcgaggaatgatcaaggacctgttgctgatcatgttgggcaccgaaacctcatggaaaacctcacagatcctctggattccagtggcatggacatgatggacgaagcgcgaattcctaaggcgcggaagccatacacgataacgaagcaaagggagaaatggaccgaggacgaacataagctgttcttggaagccctgcagctccatggccgagcctggcgacgcatccaagagcacataggcaccaagactgccgtgcagatcaggagccacgcacagaagttcttctccaaggtcatcaaagaatcatctggggacaattgcaacagcttgggtgctgcatcatcaattcagattcccccgccgcggccgaagcgtaagcctgttcatccgtacccacgcaatctagggagcacagccagcaagaacgtccctgcactgaaacagctagagaagcctcagctgcaggtgcagtctctctacgaccaggacaatgggtcgccgacgtcagtgttaacagtaccacagatacgggctgatacactgggaagtgagagtggtgggtcgccaacctcgacgattgatattgaagagagatgtcctacaccaagcatagcaactgctgagttagctatggagttgcctcctacaaatgacgaggaggtcaagggcaatggcgatcatgaagaagttacatgtgacagatcaggagttccagtccttaggctatttggcaagagggttatggtgaatgatttacatcagatgtcagcccctgatgccgggaacctgcaaactgtggcagacatggaagtggacgcttcagctgagacaccaactagtggaactgggaaattctcttcccatggtgcagcagaagcaaatacatggaacccatggctgactaacacacagcagtttctgtattatcttcctaacggacaaattttctccgtgcattctgctctcccatgcttcacctaccataatgagggtgttacttgcacccagttttcaaacccacaggtggtagcctcagatcagcagcatcaacaccaaacttctgaagctgtagattacaagggtatacagagggaaggatcttggacggagtcaaatacatcctcaagcagtgtgcctgaaacagcaactcataattcagagactacagaatcatatagaaacggaaacagaaacgaagatgaaatggtaccttctccagattcaagaaaatgtgtgagcccaggttccaactgcaggcgaggctttgtgccgtacaagagatgtgttgctgatagtgaggcgctgctgaagtcacaggcgcctcaggaggaggcagacggagagatgacgaggctgtgcttataaatttttggagcctcgtagatcactgcaactatagatgcttgctactaatattttgttcacagatgagtaggaactgatgtactgcaggaggggctgctttcctgttacaagaggcagattgaaaccgcgttagtactccacaaaacagggagtggccgtggttcttgtctggccatgtacagttcaaatattctatgtttccattttcctcgtcgtgtgtttgtaatttcgctcccattgcgggagcgttcagaggtcaatggctgtcatgcaatgacaagtattttgatagagttgtagaagggttgtactgatgtaaattatacagtaacttattatctgtaagacaataacaggcgagctaaagaaaacaacgttggaaagctttgttc

SEQ ID NO: 6140 - DNA, 1146 bp, Oryza sativa
  Predicted polypeptide sequence is orthologous to G1635
atgggtggggactgcaaggactctctgaagaatcgcatccggatattcactgaagcagtagtggtcatggtatgcccagtccttctctcgttcgcgctaaagaaggtggacctgacggccaatcgaagcaaacaaatcgtggacagcatttccccgattggagcgttaactctggaagctggcatactccctttcctcggcctctgcctctccacggtgctcggagagaggctcgcgtggctcgtattggcctcgaagctgctcatccacctatgtgtcattctcctcatggctctagcctttgtgattctgctgctcatcagcaagagtaacattgtctgcctaagcatctggatccccttcgtccccttcatcctatggctaggctacaactccgtgaaggatgaggagcatgagaacgccgacgacgccacgaaatcagcccaccacgggaagctggaaatctcggttgatttctctgctagtatcacctcccttctgttcctgggattaaaaggtcttgcgttggagggacaggccagcgccatcaaggggctggatgctcacctttccgactccctcatcgtcagtttcgtgacctgcgtcctgggtgtagtcttcatgcttgttggaacggctccaccggtgtacggcatgggccgcttggtggattccttgaggatcttggatacctctctggcaatagcgttcggggtgatcgtcgtgctaatcacaattgcacctctgaaggaggcggcgtggttagtatccatcccgtggatcctttcctttttcgtgtggttgttcatccgtttgttcgaccacgacgagggagaggacagggatgtgaagccggtgtctctagagctgaccaaggccgcgttcacagggttcttggccgtctccataccgagcttcagcaatagctccaccagcggcggctacacccacgctttcatagtgcttactgggtcagctgtcctcgctggcctcgcgtggaggctgatcacgcacgtgaagaagccgtcgcgagccatggtctgggctgaaaatgtagcttcttcgtgtgcgcacatctgtgttgcggcggctgttgttccatttgcaagcatatccatgacggtgctcaggtctctcgaaagttag

SEQ ID NO: 6141 - DNA, 2083 bp, Oryza sativa
  Predicted polypeptide sequence is orthologous to G1635
tgagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcaggtaggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggccgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtacttctattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 6142 - DNA, 2082 bp, Oryza sativa
  Predicted polypeptide sequence is orthologous to G1635
tagtgcgacggggcctacgtaacgctcgcttctttgcctcctcgttcccttctcctcctcatctccccccatctcgtcgtcctcatcaacaacatcgaggagaaaactcgcaaagattgcggggtttgggaggcgctgattttttggctttggtgtggcgatcctgtggagtgtggtttggtttgggaggagttcggttttttcagaatggagatggcctgtttgccgggaaacgccatggcaaccgacgaaaacggtgccgacgatcgcgccggcggcgagagcaccgtggatcatctcaggagccatatgaactacggcgacatggatttgtcaggggaagagcacgtgccaaaggcgcgaaagccgtacacgatcacgaagcagcgcgagaagtggacggacgaggagcacaggctgttcttggaagccctgcagctgcacggccgcgcatggcgccgtatacaagagcacataggtaccaagactgccgtgcaaatccgtagccacgcgcagaagttcttctctaaggtcgtcagagaatcttcggggagtaacaccggctcgggcggcgcgtccgccgcggcggcggcggcggccatccagatccctccgccgcggccgaagaggaagccggcgcacccgtacccgcgcaaggtggacggcgcggccaagaagcacgtcccggcgctcaggcagctggagaagccgccgttgtggatgcagtccctgtccgagcaggaggagggctcgccgacgtcggtgctgacggcggcgcagataggcaccgaggccctgggcggtgggttctcgaataactcgagcggcagcgggtcgctggctccgtcagccgccggtacggatgagcatgtcgacggtggcggctcgccggcgtcgtcggtggacagagaggacgggtgcctctcaccgagcatcccgactgctgagttggctatgcaggcgccaaatactaagatgtcaattgcaaccacggatgccaaagaagcatcctcagaagcatcagtcttcaggctattcggaaagagcgtagtggttaaggattcagaccagctgcacctgcttaatggcagtaacattgcaacgagtggttcagttgagagagcaaccagaaacatactagtaccttcttttgctgctgccccagaagggagctcgtcgaatccatggccgagcagcatgcaacagtttctctacttccttcctcgatcggatggtttcgccgcgcaacctgtcatgccatggttgagctacaacgggagccttccatgcgcgctgttctacccggcggcggcggcggctgcgaaccagcagtgccaccgtgattcagagggcgtagagttcagagtctcgcagagggaaggatcgctgacgggctcgaacacggcctccagcgtcgtgcttggatcgtcggcggcggtaccggcggcggcggcggcggctcagaattcggacgtcgcggagtcccgtggccaagggaacagcagggaggcggcggcctcgccacggctgaccaagtgcgagagctcggcgtccgtcaccctgctgcagaggggcttcatgccgtacaagaggtgcgcggcggagagcgagctgctgcgatcggaggccgccggaggagaggaggccgtcgccgacggtgagctgacaaggctgtgcttgtgacaactgactcgtcgcacggacacgtcacgccacagtactactattcgtaggtgacaaataacaaatctgacatgagattaaggcgggaagaagaggcatgtcctgctgttaggatgttgctcgagaccactttagttttccagaaaatggaagagcaattctggtttttactcgtcgatatagtattgtataatctgtaagataacaacttttgtacttttttttttactttgcctgtaattttatccccaactcgaatacgttcagagttgagtggctgtcaatgttgccttttatcaacctgaatctcggacaggggttgccataggctaactacatgtaatctaggcttgtatctctccacaaaatgcaatggaaagacgaggaaatgttggatgc

SEQ ID NO: 6143 - DNA, 1795 bp, Oryza sativa
  Predicted polypeptide sequence is orthologous to G1638
gaaggcccaatcaccagctgccactctcaagaacctgactttggatcgctatcccttttgcttcttattagtgctcagggaaagaaagctatagcagtagctaaataagccagagagaggctaagagagagagaggtgaggggagagaagaaatcctcgcagaattcgagcaagaaccgagggagatcgatcgcctcttgtcctcgttccgaggcagagatcgacctgaagtgagctgagctgcggcaaggaggaggaggaggaggaggaggagaaggagattggagatgatgatgagggatgtgtgcatggaggtgctgcctccgatggaccactacgcgtcgagggggaactggttcatggcgcgcaagtggtcgccggaggagaacaagcagttcgagcgggcgctcgccgggctggacctgcggtgcccggactgggaccgggtggcgcgcgccatcccgggcaggtcggcgctcgaggtcatgaaccacttcagggacctcgagctcgacgtccagcagatcgagaatggcatggtgcccttcccggtctacggcgccgccgccgccggcggcgcgttcacactgcagtgggatggcgcccatggcgtcggggacttcaggaacgcgtaccggttcggcggcggcggcggcgggaagcggcacttcggccgtacgccggagcaggagaggaagaaaggcgtgccatggacggaggaggagcacaagttgttcctcttaggactgaagaaatatgggaaaggggattggaggaacatatcccgcaatttcgtgcagacgaggacgccgacgcaggttgccagccatgcgcagaagtatttcatcaggctcaactccggtggcaaggacaagaggagatccagcatccatgacattaccacggttaacctgacggatgaccggcctccctcgccatcacagtcctccttgatcagcaatcagtccaacacatcaactctgaccgcagcggttgcccccttctcatcgacggccgatgtcaagccacagaatgccgcgaatgcgtccttcaattcgccaagccggacacttgggatggcgggttacgggatgggattgcaagatcaaggattgcagtgtggtggtcctctacatgatcagttggccgcgagccgaagcatattgttttagatgaaaccaatccaggcagcaccatggatcagatgtctagtgtaatattgccctgcttgtagcttcatcactacctgtattgaagtaattaattatggggaatttttcggaacataacagagggggtgtggagggatctttgtgccatgttggtgactgataacctgtgatccataattgttggcaatactgagaatgtaacgaaacgaacgtcaagaacttgatgccggtggtattttcagacagtgattgctgctagtgctgaacactgatcatgcatgaagtggactttgtattcaatcatggatccagcttttgtgaggtggatgaggagaattctattcactatgttcttctggtcagtgatgcactgagaaacaccggttgccatctgattgaggggtttcagatcatgctgtacttcacacatacttatccacagttctatcaatttgctcattggtgctccccccatttgatgtttgcatagaatttatttggataaacggaaaataagtttgctctgagtcattcagcattattactactttcagttgctcatctagtcaacttttcttgtttgtagcttcatttttataataaaataataacttctttttttt

SEQ ID NO: 6144 - DNA, 1527 bp, Oryza sativa
  Predicted polypeptide sequence is orthologous to G1638
atgatggcagaggcgcttcgggaggtgctaccgctgccctacttccccgggcagccgtgctggtacttgcaggagcggcgaggtgcggaggcgtggtcggcagaggagaacaaggtgttcgagagggccctcgcacaggtcgacctggactcgccgaacaggtgggagatggtcgccgcgatgctgcccaggaagacggtcatagacgtgatgaaccactacagggacctcgagaacgacgtcggctccatcgaggcagggctggtgccgttccctcactacagcagcagcttgtccccggcgtcctccgggttcaccctgcaggactgggacggcagcgacggcgggttcaggcgcggctgctacctcaaacgcggccgcgccccggaccaggagaggaagaaaggcgtcccgtggacggaggaggagcacaagtcgttcttgatggggctgaagaagtacgggaggggagactggaggaacatctcgcgctacttcgtgacgagccggacgccgacgcaggtggccagccacgcgcagaagtacttcatccgcctcaactccggcggcaaggacaagcgccggtctagcatccacgacatcaccacggtcaacctgccagaagaagacaccagcaacccctccccatcgccgccgtccgtgctcaccaccgcctcagaccagctcggctccctcgtggacacgaaacccgttcccccgccaccgtcactcggcgcgcaacggcacttcatgtcgccgctgccgggagcgctcggcgtcagccaccacccctacggcaacgtgaagctagagcccaatgcctcgttcttggccggcggcgatgcaatgcggacacttgtgacggcggttctcagcggcggagaaccgcacaaggaggaacacagagcaccgcctccgatcatatctacgggaacgacgaggctccggccaagtcgcagtcccgtgtcagtgtgtgattggctagccagttggttgcagagttgcttcatgcgtctcaggatcgcaaagtactggacggaagggccactaaccggttactgttttgatcaggaacaccagggctttccgagaaagagaaagcgaaaggctctgcttgatcgatgcgactatacaattcactgcatgaatctttcacttgattgtttgttcggcaagccgcaccgaccagcctcagccggaggtcagtgtatctcaacgccgacgccgtcggcgatcccgattcccgaccgaatgcatggtgaaataggagatcacagaccggagataaagtggcaccggtgctactgccgctttgtgttgtgctccagcgacttttgttcgtgcgaggtggaggaaagtgccagtactggcggtggtgcgctcctttccagcatttgctctgccattgggcacggcagggagagtgaaagcatcatcgacgccatcgcgcttttggggcgtcatgtccgccctcgccttcgtgcaaatattcagattctgcaaatggacgatataattgaggaataa

SEQ ID NO: 6145 - DNA, 857 bp, Oryza sativa
  Predicted polypeptide sequence is orthologous to G1641
cccccggcgcgccgcaacccccggcgaggaccggcacccggcgtaccctggtccgaagacgagcacagttgtttctcgaggggttggacaggtacgggcggggagactggaggaacatctcgcggttctcggtgaggaccgcggacgccgacagcagggtggcagacgccaacagcgcaagaagtacttgcatgcccgcgcaagccaaacgcccggcagccacagcagactgcacatagcgcaaagagcatccatgacatccaccaacccccttgaaccaggctgtcgggccggaccgggccgaaccaccccaaccccccccctgtgtgtcctgttgcccaaaaccttgcctttttgggaattttataaaggttggaaaaaaccaaagccaaagggggggttaaggccggaattggaaccggttggttaaccaattttaataatgcccttaaccaccccacccaaaccaattaagggccataagtttaaggttaaccttgtgccaaaaaacccgttttgttccacctttggggccttccttcctggaatcccaattaaacccgttggaaccggcccttaacctttgccccggaaaaccaaggaaggccttgtttgaaggaagccttcccgctccggccaaccaccggtttttggccttttaagtttttccaaccattaattaagaattaacttaattcccaagaacttaatggggttttaaccgtggccaaccttccgttcttaagttttgtgaatccaaggccgaagaagccccggttaatatggtttttgtgcctttgttttggaaggaatgaagcctgtccgaaaccatttaaccatagccaaaaaaaaaaaaa

SEQ ID NO: 6146 - DNA, 1988 bp, Oryza sativa
  Predicted polypeptide sequence is orthologous to G1641
gacgcgcacacgggcgaaaccccaaccaagctcctcctcagctcagcttctcctgtgctctgccctcctcttctcgcaggagtgagagaagccgaggaggaggaggaggaggcttttgtttggttgagacgccacaaactccaccaagggccaatcaacgaacgcctcgatttcttttaagcggcgtctcaaggtggaggccgaatcatctgtggccactttggcatctgccggaatcgatgctgtagcatccataaataccgcccttctctgccgccccccatctcccctccccctcttcttccacctcccaagagctcgcttttgagaaagaaaggtgaaaaatcttggtcggttggcccggccagccagccagccgcctcgcggtcgcggagatgatgaaggagtcgtacatggaggtgctcccgccggcgccggcgcactacttcgtcggccaggctgcggcggcgggcgggtggttcttgccggaccggcgcggcggcggcggagcgtggtcgcaggaggagaacaaggtgttcgagcaggcgctggcggcgctcgaccggaacgacccggagaggtgggagcgggtggcgctgctgctgcccggcaagacggtggccgacgtcatgacgcactacgacgacctcgagaacgacgtctgcttcatcgaggccggcctcgtccccttcccccactacggcgccgccggcggcggcggcggctccgggttcactcttgactgggacggcggcgatgaccccgccggccttgggttcaagcgctcctgctacatggtcggcggcaagcgcgcgcgcggccctgaccaggagcgcaagaagggcgtgccgtggacagaggaggagcacaagttgttcttgatggggctgaagaagtacggcagaggtgactggaggaacatctcccgcaacttcgtgacgagccggacgccgacgcaggtggccagccacgcgcagaagtacttcatccggctcaactccggcggcaaggacaagcgccgctccagcatccacgacatcaccaccgtcaacctccccgacgacgaccacggcaacccctcgccgtcgccgccgccgtccgtgctcaccgcgcactcctcctcctccgccgccgccgtctcggagcagttcggcgtgctcgtcgacggcaagcctccgccgccgccgctcggccgtggcgccgggcaccaccacttcatgccccatccctacgcccaggtgaagatcgaggccggcaattcgcacgtcgccggcggcggccgcctcgacgactccgttctggtgcagatgcaatgcggccagctgatgcagcctctcggttgacaaccctgttcctggagcagcaacccacgaccaaccatgaaaatgctctcgtctcttggtgtgctcgaggagggagatgcaactcgtgctcttgcttccaaccatcaatggagttctgaaaacgaaatgatcgcaacagcacgaaggacaagtagtaacagcacagtagccaggcattgcgctgctgctaaattaagctccctactaccgtgtatcccggatgatgagaggaagaagaagaagaagaagaagaatcacgagatagaagaaaaagaagaagaagaagaagaagcatattggacatggcatctctgcatttcgcatctgtgtacataagaccaagaccaaggttaaataattagttcacaattgatatttgatactccattgattatctcctgtgctatgggaggaggcacaggatgggtactactaccagctagacaccgtttttgttgatgtactattagtcaagttattattgtcatgcaagtattatttggagatatagcacgtagcagcagcatattgtctctgttttttttttttgtcaaggctctctagtgttcagttgagggtattagcattggtcaccctctcattgacccttgctttattaatgataattatggtttttatctgctc

SEQ ID NO: 6147 - DNA, 884 bp, Oryza sativa
  misc_feature (1)..(85): n is a, c, g, or t
  misc_feature (695)..(695): n is a, c, g, or t
  Predicted polypeptide sequence is orthologous to G1641
nnnnnnnnnnnnnnnnnnnnnnnnnnnnnnnnnnnnnnnnnnnnnnnnnnnnnnnnnnnnnnnnnnnnnnnnnnnnnnnnnnnnnttttttttttctagattggctgccatatttttatttattaatatagtctggatcaccatatatatgcgctatctttatgaatagctaattagatgttcataacatgtgtgttccattgttcagcaggaacatcgatcagcttccggccacacaaacttatcacctatcagctgctccctcctcctttggagttgcagcttcagccatcttcatctgctgatcatcccaggccttctgcgactgcgcctgcatctccatcatccgctgctctatctcggggttgtacagcagcggaacccagaacggtgtgtcgacgttgttgttcacggcggcggcggcggtgttgttgttggagggggtcgtcgtcgtcgtcgccgccgtcggcttccatggccgcggcgatctccatcatgtggaagtagttgtcggcgtacatggagatctgctccggcgtcttgcttctgacgaagtacctcgagatgtttctccagtcgccacgcccgtacacacgcatcccagtcagaaacagcctgtgctcataatcagtccaaagcacatcgtcatcagcattgtccgggttcaacaactcaccggtcccgggcataatggncgaaatccgggtaccacccaatgggcgcgtccgagaaacaaaaaaaggcggccgattcgagctggggaacaggcccaaggccccggggaaaggggcgcccaacggcagaaccattcgggcgcctacccaaagccgtaaccgaaaagaaacacggaggctaaacaatctggcacccaacaacaaacatca

SEQ ID NO: 6148 - DNA, 1637 bp, Oryza sativa
  Predicted polypeptide sequence is orthologous to G1652, G2776
tagatagctagtagagttctttttctttggagacatggaggactcgagcctgttcatggagtgggccatggagacgctgcagcacctgcacccgctgccggcgacgccgccgcctgccggcggcgggtacgccggcgacaacgcgacttttccgtcgctccaagcgctccgcgagtcgtcggtgtcgcagaacggcatggccccgccggagccaacggcgcacgaaggccaccgagcctccaacagctggagctcgggcgacacggacagcgtgtccggtggcggcggcggcgcggtcatggagcacgacggatggtcgacgtcgccaaattcggtcaggtgcgccgctggcggcgggggcggcggcggcggcggcggcctctggcccgtgagctggaacttctcgtcggccatgacgcagccgtgcaacgatcaggccacgccgtcgaacccgccgacgacgacgagagcgcgctacggcggcggcggcgttcgatacctgccggccgccgtgtcgccatcgccatctgcacagacacggagagcctcctccaaaggcaacggcggcggtggctccggctcctcgtcggcggcgccgtacgcgcaggagcacatcatcgcggagcgcaagcgccgggagaagatcaaccagcggttcatcgagctctccaccgtcatcccgggcctcaagaagatggacaaggcgacgatcctctccgacgcggtgaggtacgtgaaggagatgcaggagaagctcagcgagctcgagcaacaccagaacggcggcgtcgagtcggcaatactcctcaagaagccgtgcatagccacgtcgtcgtcggacggcggctgccccgcagcgtcatcggccgtggctggaagcagcagcagcggcacggcgagaagctcgctgccggagatcgaggcgaagatctcgcacggcaacgtgatggtgaggatccacggcgagaataatggcaaggggtcgctggtgcggctgctcgccgcggttgaagggctccacctcggcatcacgcacaccaatgtcatgcccttctcggcatgcaccgccatcataaccatcatggcaaaggtggaggacggggtgagcgtcacagctgaggacattgtagggaagctaaacactgtgctccagcaaaacagcagaaatagcgcgcgagaaacaaaaagctgacaaacagcaacaaacgacagctgctagctagcttggctagctactcaatcaggcatgttgccattgattccagaacagtgtaaacacacactctctctcgatctgctcgtcgtgtacttgcgtgcatctggcccgtgatgcatgcatttgcacaaataaatctagcactggatacaatttatcttagtgcaataagtttaaatatatcatatttagtactagatttagttttttggacggagagaatactagctagagctacgaatgcactctctatagccgaataatcttaagatgtaccggttcaactttttttaaagatgttcataggagataagatgtgtgcatgtacatttatatcaatgagtgttttgcatgttatgagtatcatcatttgtacaatgttttttttaaaaaatattatgctgatgttgatcgattggtc

SEQ ID NO: 6149 - DNA, 1086 bp, Oryza sativa
  Predicted polypeptide sequence is orthologous to G1652, G2776
atggcctactccactaatcagataatgatactccaacatgcatggatgctcgtgggtgaagctaacagccagttaataattagtacagtagcacactcttggtaccagagcaacagtatagaagtggtcttatggtggttctggtccaggattgcacaaactccaactgaatatggattcttcggccaagcaatggcttgcagaactgacgaggagaatgatgatgatcctagagcgcttgagcatctggaccctctcagcatgcagcaactcgctgaatcccttgccaacgagctttttaaccagccccaagaacaacaggaagaacagcatggataccataacccatcactgagggtcctcccctttgtcggggatattaacaagcccgagggccacacaccagcagctgctgcaattcgtgacagcttcttctccctcaccaatggctcgtccagctcactcaacttctcggcgctggagcagcagcaggatagtggtcccatgacaaaattctgctcgccgctgtcagagatgaagagaggcggaaggagggcgacctcgagcatgcaagaacatgttatcgccgagagaaagaggcgagagaagatgcaccagcagtttacaactctagcatctatcgtccccgaaatcactaagacggacaaggtctccgttctcggcagcaccattgagtatgtgcaccatcttagggagagggtgaagatcctgcaggacatccaaagcatggggagcacgcaacccccaatttccgatgctcgcagccgtgccggctccggtgatgatgaggacgatgatggtaacaacaatgaggtggagataaaagttgaggcaaatttacaggggacgactgttctgctgagggttgtgtgccctgagaagaagggggtgttgatcaagctgctgaccgagctcgagaagctcggcctgtccaccatgaacactaatgttgtgccatttgcagattcatcactaaacatcaccattacagcacagattgataatgcatcttgtaccactgtagaacttgtgaagaatctaaaatcaactctcagaaatttttag

SEQ ID NO: 6150 - DNA, 1970 bp, Oryza sativa
  Predicted polypeptide sequence is orthologous to G1652, G2776
gcgatctccataggagtgtgatttgagctctcaagaccccccatctttggtttcgaggaattaatcgtcgagggaagaagggaagtagaaatggcgacgcagtggttctccaatatggtgatggatgagccgagcttttttcaccagtggcagtcggatgggctgctggagcagtacacggagcagcagatcgccgtcgcgttcgggcaggccggcgaggcggacgcggcggcggcggcggcggcgatgatggtgcagcagcagcagtacgcggcggcggcggcggcggagcaccggccgcggaaggcggcgaaggtgaacaccagctgggactcgtgcatcacggagcagggctccccggcggactcctcctcgccgaccatcctctccttcggcggccacgccgacgccgccgccgccgcggcgttcgccagcgcggggcaggcgcagagcgccccgtactacggcggcgcctccgccgcggccttgaagcccaagcaggagctggacgccgccgccgcgcccttctcccaggcgcgcccggtcaagcggagctacgacgccatggtcgccgccgacgtcgccaaggcccccgccgccgccgcctcccggcctgcctcccagaaccaggaacacatcctcgccgagcggaagcgccgcgagaagctcagccagcgcttcatcgccctctccaagatcgtccctggcctcaagaaaatggacaaggcgtcggtgctgggcgacgcgatcaagtacgtgaagcagctgcaggaccaggtgaaggggctggaggaggaggcgcggcggcggccggtggaggcggcggtgctggtgaagaagtcccagctgtccgccgacgacgacgacggctcgtcctgcgacgagaacttcgacggcggcgaggccaccgccgggctgccggagatcgaggcccgcgtgtcggagcgcaccgtgctggtcaagatccactgcgagaaccgcaagggcgccctcatcaccgccctctccgaggtcgagaccatcggcctcaccatcatgaacaccaatgtgctccccttcacctcctcctccctcgacatcaccatcatggccaccgctggagagaacttctcattatcagtcaaagatatcgtcaagaagctaaatcaagcattcaagttatccctgtgaaggacttgctttcctgatcaagtctaatctagatcaaatctttggtttttaatcttcctactacatttttatcattagccttgagagaaatctgaggctgatggttctaattaggtcctttccctgcttctgcttctgaagagagtttgcttgcaatccaccacagagcacaccccctcaaggatttagccattaaccacctgtttttgctgcatgggtgcagagaatttgcagattacctaaatatccacctacaagtcttctattttctctcccatcacatttttttgcatggattgagctagtcactccatgttcttgggagagggtagaaacgtaaaaaagagacctgtctttttctagggcctgtttatcaaggggagtttgactttatcaaaaaaaccttattttcatttctccccttctgcaatgttgccctttgatttcaccctgtttttctatgagaggattgaggtttttcaaacccaaataccaacctttgctggcatctcatacactatcctatcacacactgttcccaaacccaaaaggcttcaaattgtggagaaaatggtgccttccttttttcagctctgaggtggacttttgcaagctcttgattcagaagtagtgtagggtgtgtgtctctcttctcttttttagggtcatacaagctggccccagcttgattgcaccctttgcttgtagtctcctttgtgggttttgttgtaacaggatcaagatgtagctgttccctcttgtttacacaagtataaaaataaataaatgtgcttgttgtt

SEQ ID NO: 6151 - DNA, 534 bp, Oryza sativa
  Predicted polypeptide sequence is orthologous to G1655
atggcgtcctcgccgacctccacggcgccacacgaccgcaagctcgatcccgccgcctcgccggcagccaggtggcggacgaggcgggagcaggagagctactcctccaagctgctcgacgcgctgcgcctggtccgcgccgccagcggcagaccatcacccgcgtcgtcgcgcgaggtgcgccacgcggccgaccgcgccctcgccgtggcggcgcgagggcggtcgcggtggagccgcgccatcctcgcctcccgcgcgcgcgcgtgcgcgctccgccgcgtgcgcctcggcgcgccgcccccgccgcccgccgcgcgtccggcgccgcgctcgcggccgccgctggcgagcaaggcgaaggtgctggggcggctagtgcccgggtgccggaagctggcgttcccggcgctcctggcggaggcgtcggactacattgctgcgctggagatgcaggtgcgcgccatggcggcgctcgcgcaggcactccagtccgtggcacccgcgccgccgccgccgccgtcgtcgtcgtga

SEQ ID NO: 6152 - DNA, 512 bp, Oryza sativa
  Predicted polypeptide sequence is orthologous to G1655
ctgcgggcggcggcggtggcgcggagggtgcgggagctgcggcggctggtgcccggcggggaggcggtgccggccggccgcctgctgctccgcgccgccggctacgtcgcggagctccgcgccagggtggagctcctcagggcgctcgccgccctgctgacggcctcatgcgccgccgccgacgacgacggcggtgcgtgtacatgacgagacggcggcgccatggccggcggccggcgacgacggtgaacaacgacgatcgatcgactcctcccgatcctacgaatacgtagagagattcggcgtataattaagagtataaatattcagagaaattaatatatgtatatgtacgtacatgtcgtcatgcatatataggctgaggaatttcgggggttaatttttgcctcaaatactccttaatatttaagtgttcggccgattcgtattctttgtaatgtttatgtgtatacatgttatgatatttttgagcgcttgatttttttttaaaa

SEQ ID NO: 6153 - DNA, 2113 bp, Oryza sativa
  Predicted polypeptide sequence is orthologous to G1660
gaggtggcctcctccccgcgattcccgtgtgaatttgctctttcttcccggatttttcgactttcttcttcttcttggtttgctcttcttctttcttggcggtctgcacccattcggagtccgagctcatctccgagtccatggcgcctctcgccttcgatggctggaactgaaatactaggcattagcgccacttatcttgcttcgatttggtaaattttgctcgattccttcatcgtggagttgtgctgttcttcgtactggaggtgtgtcctttttaatgattgctaatattcttggaaagcaggcacgcctgccattgctgaactcgatgttttctcatcgattggtcgggatattgccgttgatagattcccctgcagtgctccttttcgtctcttccattctcctctcaaattcgccttgacattttggtcggcactgtacttttgtggtggtggccactggccaacaatgttcaggcctggaacgatcgcctgtgtggctaattcggcgcgcattttgctgaaaagtttgcgggcttttatcctgtttgctgctctaccgggtcactgctctgccagttttgtctcaatttctgtgatgctttctgtgccatagctttcaaatgttggctttggtaaggaggggattgagataggttgggttatctgagtgcacacttcactaaaaagtttggatccttttgtccattctgctgtgattccgtcggaatttggcaattttcgcatcgggtggattctccccagctaagctacgagcaatgcttctcggactagagaaaaatcagcacaacggggaggacacatcgcctgaggccaacgattccggcgagctggacgaccagaggagcatggagtgctccacctccaccgaaatgtcgagcaacagtggccacagatcaagaaaccgagctcaggacgacgacagcttcgactccgagagcagctcgtcgggcccgccgacggtgaagaggccggcggcggtgaccgccttgctgccaccgttctctaggccgacgccgtcgaagtgggatgatgcagagaagtggatttctagccccacggcgaaccgcggtggccgtgtggggagtgcagctggggctgcgccgaagaaatcggcgctggcatttcctgaacatgtaagccggcctccagccgttgctaaggtggttgctgaggtccccatcaacactggaaccttggtgaagaattcagttgctctcgcacagcctatttcatttaatcctgcacaaagtgcttcgatagttgatgaaccagctcctgcagttaggtctgtttcgatgagagacatgggcacagaaatgactcctattgccagccaggagccctctcggactgggactcctattatagcttctagtccaacctcctctcggacaccaacaccacaacgtaatgcagaaatcagtattggtgaatttggtccaaataagatggaaatgtctgaggaggaactacaaatgaatacaagaaaggaaatcatggatcttggccaacggctgggaaagacaactatagctgcatgggctagcaaggaagagaaatctacaacaagtttcgcaaatgtcataaccgacaaggctgtagaaatcgacagagaggctcgtgctgcagattgggaggaggcagagaaagcaaaatatcttgcaaggtttcagagggaagaggtaaagattcaagcttgggaaaaccaccagaaagcaaaaattgaagctgaaatgaagaggatggaggcaaagatagagatcaagagagctcgcgagcaggacaggctttcgagcaagttggcagctgcaaggcaaggcagaggcgaggagggaggccgctgagtccaggaagaaccaagaagcagcaagaactgaagagcaggcggctcagatccggaaaaccgggcacataccttcctcaatctcctgctggtgctggtgcctgtgattcttcactctgccatgatcatctgttatttgggtagaagaaaaatacttgctccttgcacgaccatgtaaaatattcgctactggttggttcatcgttcagtgatcaatgccaatgagtcgccatttttgtcc

SEQ ID NO: 6154 - DNA, 1874 bp, Oryza sativa
  Predicted polypeptide sequence is orthologous to G1660
gagcttttaactgctcgtctcatcactctccacctctctccctctctctctcttcctcgcgctcccacgccacgcagcagccgcagatctccacccgcctccggcgagcccgccgccgccgccgccgccatggagtacgagcgcatcgagaagccgttccccacccagggcggtgggttctcgccgaagcggctgcgcgcgatgttgctgggggtggagaagcggcggaaggggcaggaggaggaggaggagggggacgccggggaggtggacgacgagtacggcgcggtgcccaagtcctctgtcagatccgacgccgactccgatgcgcgcagaggaggtagcatgtgcgaagaatacaaggatgtagatgtggtgagcaccatctcagaatcttcatcctcgttggagacagggagtgggcaccgatcgcgtgacacccactccatgggttcacgagtaagggtgcctgaggaggactcctgtgactctgagagtgtggcttcaaactttgagttccataaggagcgaggggcctctgctcggtctgtgacggcggcaatcgttcctccattctcaaagcctgcaccatcaaagtgggacgatgcccagaaatggatcgccagcccgacaacaaaccgtcctggtagggctggtggagtgccacagaggaagatggaaaaaactagctttggtggcgggaggctgccggctacgaaggttgtgttggaggccacagaggagatagatactaagagggttgatccaagccaagagaaaagggaaattgggtggcaaaaagcggtgaattgggccccacctgatccatatccagaagttgagacttgtgcaaagtctgcacttgctgaagaaattacagtagctgattcagctgttacttttagtcgccatgattcatctgccacgcttcagagcgcgacaacatgcatacctcccccaccaacagtccgatcagtgtcaatgagagacatgggtacagaaatgacccctattgcgagccaggagccatcccgaacaggaacaccggtgagagcaacgagtccagattgttctcgcccaactactccacgaaaaacaataggccccaatgcaatcggtgctgttattggccatggtgaatgtagcaacgtggaattaagtgaacaagaattgcaaatgaagactaggagggagataatgctcctcggcactcagcttggtaaaaccaacattgctgcatgggcaagcaacaaggaagaggaaaaagatgcatcactttcgcttaaaggagtgcccatggaccaatctacacagaaggtaacagaaattcgtgcagcagcgtgggaggaggcagagaaggctaaatatttagcaagatttaaacgagaagagattaagatccaagcatgggaagatcatcagagagcaaaaatcgaagctgaaatgagaaaaattgaggtcgacgtggaaaggatgcgagcccgtgcgcaggacaagctgatgagccagctcgcatcggcgagacacactgccgacgagaagcgggccgcggcggagctgaaacggagccgtgcggctgcaaagacggcggagcaggcagaccacatcaggagaaccggcaggatgccgtcctccattggctgctggaactggtgctcgtagtagcgtagctaagctcaagcaactgaagcaagcaaaaagctctcctcactatgtctcgcaagacttgaagcgccatcatctgtttttaccgtgatcttgtagaatattgtcttttgattggtttcagtagatataagtcagaagaagacgagtcacttgtaagtaactatggagcagtatataagatgcaagcttcttgcctttttctgtgc

SEQ ID NO: 6155 - DNA, 1390 bp, Oryza sativa
  Predicted polypeptide sequence is orthologous to G1662
gtgaaccaaagaaccatcacttggtaccagtagtgcaacaacttgttcagtcgagaggaataccttctagccttctagtagccaggatggccatggagagagcttggaagccaagggaaattgctgacacttttggcattgagatggatgaagaggaggctgcggctgcggcgataccgcctccgcagacgccattggagcccatggagtacctgtcgaggtcatggagcgtgtcagcgtcagagatatccaagatccttttcaacgggagcaagaagagctttgccgccaagcgtctgccggagatgaccataccggaaaactctgtggtcgctgcgtccattgttcccagccatctgcaacatatagacacaagaaggaattcaatcagcagccaccacctgccaattgggaggtggttccaacacaaggaggcaagccgggtcaagcagagcagcaaagagaagctgcgagccgagaaggcccatgtacacgccatggtgtcggtggcccgggtcgcagctgccgttgctgcggttaccgcggccaccacgagctcagatatccagacctccaagatggccgcggccatggtgtcggccaccgagctattggcttcgcactgcgtggagatcgcgcagcacgcgggggcacgccatgagcaggtggcctgtgccatccagtctgcagttggtgttagaagctctggtgatctgatgacactcacagcagcagcagctactgctcttcgaggagccgcaacaatgaagcagagagtgcagcgagagatgagaagcaatgcgagtgttcttccgtatgagaagggtcactcatggagtcctgacatctggtgcaaggagggggagttactgaaacgcacaagaaaaggagatttacacaagacacgagtatctatatacatcaacaagaggtcacaggtcatattgaagttgaagagtaaacacataggaggagcactatcaaagaagaacaagagtgtggtttttggtgtgtacaacgagcttcccacatgggttgaggcagggaaacatttcacagaggagagatgctgctttggcctgagcacggcacaaggtctggtagagtttgagtgtgagaacagcacaagtaaacagaggtgggtcgatgatgtgaagaatctgcttcggcaggtcgctgcagaagagcaagtggaaaataagttgggatcagtgaagctcagttgatgtagttcatacatgtgtacactattttcatgttggcaggtggtataccatagaaggtgccttattgatgccaggcgtatatattgttgtactcttaaattgtcaggtagttttgtactgtacacacaaaatgataagatacataatagatcatatgttagtcc

SEQ ID NO: 6156 - DNA, 1206 bp, Oryza sativa
  Predicted polypeptide sequence is orthologous to G1662
atggaagggcacatgttggggaggatgaggaggagggatcacctgctgctcatggatgctgctcctcctccggcggcggtggcggcggcggtgcagacgctgatggagcccatggagttcctgtcccggtcgtggagcgtgtccgcgtcggacatatccagggtgctcaccggcggcgtcggcgcgaggcggagcaccaacttcgtggtggatcgcctctccgggatgctcatgccggagacgctcgcgctcgccgccgcctccagcacaaacctgagcccccgcaaacgctattccaggtgcaggagcgccatctccgcgcaccagcacacgatcgggaggtggttccaccacagggacgggagcagcagcagcagcagcagcagggtcgacaaggcccgcgccgagcgggcgcgcgtgcacgccgcggtcaccgtggcgagcgtggcggccgccgtcgcggccgtggcctccggcgcggcgaacgacccggacgacctcgacgacgccaagatggacgccgcgctggcgtccgccacacagctgctggcctcgcactgcatcgagatcgccgagctcgccggcgccgaccacgaccaggtcgcctccgcggtggaggccgccgtcgacgtgcggagccccggcgatctcatgaccctgaccgcctccgcagccacagctctgagaggagcgacggcgctgaggctgagagcgcagcgggaggcgaggagcaaggtggcggcggtggcgccctacgagaagaccggcagctgccgcggcgacatatggtgcaaggaagggacgctcctgaaacgcagccggaaaggcgctttgcaccggaagcgcgtggccgtctacatcaacaagaagtcgcaggtgatcgtgaaactgaagagcaagcacatcggcggcgccttctccaagaagaagaagagcgtcgtgtacggcgtcgacgacgacgtgcaggcgtggccggcgccgcacgcgtgcggcggcggcgccgtgcctcctgctccggagacggcgtcgtcggagaagtgccagttcgggctgaggacggcgcagggcgtggtcgagttccagtgcgagagcagggcgcagaagcaggactgggtggagtcggtgaagaatctgctccggcaggcggccggcgggacggctcagctcgagcactccttcgaatctctccggcttagcgcctcgtaa

SEQ ID NO: 6157 - DNA, 1790 bp, Oryza sativa
  Predicted polypeptide sequence is orthologous to G1666
gagccttgtggacagagaaattaaacagttaagttctagatttctatcgtggtgatggcatctgctcctccagttcaggaagaagccctacagccagggacgaaccacttcaggagccggcttgctgctgctgtgaggagcatcagttggagttacaccatcttttggtccacttcaaccagtctcccgggagttctgacttggaacgatggattctacaacggcgaggtaaagacgaggaagatatccaacttagaggacctcaccgctgaccagctcgtcctgcggagaagcgagcaactgagcgagctctactactctctcctgtccggcgagtgcgaccaccgggcaaggaagcccgtcgccgcactgtcgccggaagatatcgcggacacagaatggtactacgttgtctgcatgacatacgcctttcgacccggccaagggttacccggcagaagctatgcaagcaatcgatctgtttggttgtgcaatgctcagtctgcagatagcaaaacctttctacgtgcgctcttagcgaagagcgcgtctattcagacaattgtctgcatccccttcatgagtggcgtgcttgagctgggaaccactgatccggtttcggaggacccaaacttggtaaaccgaatcgttgcatatttgaaggagcttcagtttccgatatgcttagaggtaccgagttctactccttctccagacgaaacagaagatgccgacaccgtgttcgatggcctcattgaagaggaccagatggtcatactccagggagaagacgagctaggcgacgtcgtcgtcgctgagtgcgagaccaacggcgccaaccccgaaacgatcaccatggagaccgacgagttctacagcctctgcgaggagctggacctggacctcggttcttatcagctagtcccgacgtcggcacgggagacggtggctgcggcggcggcggcggctaacgatgtcgacggcgttgcatactctcacgcctcgtgtttcgtgtcatggaaaagagcgaacccggcggagaaggtggtggccgtgccgatgactgcaggcatagagtcacagaagttgctgaagaaagctgtaggcggcggcaccgcatggatgagtaatattgatgatcgtggtagcgtggcaataacgacgactccaggaagtaacatcaagagccatgtcatgtcagagagaaggcgccgagagaagctcaacgagatgttcctcattctgaagtcactactcccctccgtccgcaaggttgacaaggcatccatacttgcagaaacgataacctacctcaaagtgttagagaaaagagtgaaagagctggagtccagcagcagggagccatcgcgttggcgcccaaccgaaattggacaggggaaggcgccgtaagatcaccgggaaggaggtctatgagatcggtgtcagtggtggtacctcgtcggtacctcgtcaacaccgtacgtatatgatatgcatgtataagatcaccgggcaggaggtctctgagatggatgtcatacggtgttgacgaggtaccgtacgtatgatatatagttatcgttttcattatggaaaaaaaattccgaattacctcgtgtactataaaagacgcgaatattagggaagaatctaatatcaaataattagaaggggtgaggtttcgaatccaggtcgtctatcacaccaccttgtgaagctagccggaaaacccctaagcgtttttttacctccatgtactattggtgccatctgaattaccgcttactaat

SEQ ID NO: 6158 - DNA, 5601 bp, Oryza sativa
  Predicted polypeptide sequence is orthologous to G1672, G2802
ggttttgctcttctactgctcatcctcctcctctactactcgtcctctttgctctattcacagctagcaacaagaaggaggcttacacatgcatgtgcacggtctctgccggacgcatatgaatcaggcatgaatagggggcacatcagcagctcggagctcatcgacgccaagctcgaggaacgccggatctccacggccaagcactgccccagctgcggcaacaagctcgactgcaaaccggattgggtggggctaccggcaggagtcaagttcgatccgacggaccaggagttgatcgagcacctcgaggccaaagtgagggaagaaggctcaagatctcatcctctcatcgatgagttcatacccacgatagaaggggaggacggcatatgctacacccaccctgagaaacttccaggtgagagtgagagagctaaggtagctatagctcaaaacattgcaccccccgcattgttttgatacagatatattcctggctttttgcaaaactttatcgggttttttttgctttccatggagtgatatatattgtatgctgggattgtttcgccatgaattatgggtcgtggttttggattttgggatatggcatatattcccttgttgttcttgatgtgctctcccccctctctattcttattactagtgtttctctacatgtgctcttggccggtatatgcaaagagaattattgtttatggaaagttgtgcctagtctcatctcccactctctcctctctgtcatgatggtaagatgcttctgaagtttccaaataggtttctttcctctcttcctctttttcagagaggtttgttgcatctgtcaagaagcataggccacccactccacactatactcttggatctcacaaaactctctatactaccttgatcctgctaattattctgtttgtgctgatcgatcgatggagcaggtgtgacaagggacggcctgagcaagcacttcttccaccggccgtcgaaggcgtacacgacggggacgaggaagcggcggaagatccagacggagtgcgacgtgcagaagggggagacgaggtggcacaagaccggcaagacccggccggtgatggtgagcggccggcagaaggggtgcaagaagatactggtcctctacaccaacttcggcaagcaccgcaagccggagaagaccaactgggtgatgcaccagtaccacctcggcgacctcgaggaggagaaggaaggggagctcgtcgtctgcaagatcttctaccagacgcagcctcggcagtgcagctggtcctccgaccgcggcggcggcgccgccgccaccgcatccgccgtgacgacggcggcggtgcagcaggatcagcagcgcaggagggacagcggcagcggcagctgctcgtcgacgagggaccacgaggtgtcggcgacgtcctactcgacggccgggtacgccgtcgccgccgccgtcgagatgcagcatttgaagcatgccgccgaccatttcagcttcgcgcctttcaggaagagtttcgaggaggttggtataagtggtgatcaggtacactccaatcagcttgggaggtcggagcagcagcatgctggccaggaacaacagccgcaccggccgttgcttgcaaccacgacggcggtgcctgccacggccttcctgatcagccggccgacgaaccctgtatcaaatatagtgccaccagcaatgcagcatgcatctgtcgttcttgatcatgatcagttccacgtgccagcaatccttctccaccacgacaaatttcaggtgtgatttcatctcatcttatacattttctcctcaaataaaacatttccattatctaaaataattccctaaaattaatactaatttctctttttctagcagctgggtaatagattgggcacggtagctgttgaaaaaaaaaactataggaacacatatatgcatgcatttatgaagaatattctttacatattcagaatgttaaatttaagtaaggagtaacaaaccatctccaacaaaaaacaatttcagcttgaaaacaagcaatggactcgctaggcagtacatttcatacttcccatctagacaaacttaattagtacggcttggtctaaagtccacattttcctccttcaagctaagagtttcttgctatcataggatccctttgaattctctaaaaataaactaaaaaccattctcagctttcaatttcaataaaaagaatcaaggatttgtgataatcttaagtgtcaaaattagtcatttttagttggtcatactaaacatattgggcaataatttatacaaataattgtgatatacaaaatattaaaaaaaattctagttatggcacttctaatgttgatttgtacatatgtagggtttttcaagtcgtgtaattactatttgatatgaactatgtttttttatatatataccaaggaagttgcatatggatgaaattaagctgtctgaagatgcattttctagactataaatatagagcctagacaattctggaaggattctttgtttacccatatatatatgtgtaatctggtaatgaatctgctttgtatttccaccgttcctatatatatgtatcactttaggtaaatctatatacaattgaactgtttatttcatatatatcaagatactaatgcattgtctcagctcattcttcatctctttggtgatttacttaattatattattgtagctcctttacttttttttttcgttttgctctttactaaagaatgctttagctactgttctatcccaacataattaacaacgaacatgcaacacagcagcagcagcaacaaaagcttgacaggaggtctgccggcttggaggaactgataatgggctgcacgtcttcgagcacaaaaggagtaagtttctcttgcatttttatttgattgcctcctcagcatggatccaagccgataatttaccagtcagaggctctacgcatgcagtaaagcattcctgcacatatccaattggaattaatatatatgcatgtacgtagcaattgcatgtgagacgcatgcatgtgtcccttttaaacggttttaatctgaacattagctcaggccaaatttaatataattgtagttatttatatatactgatttaaacatataatacatgggtgggaaagctgcaagctatgtcttataggcgaggtgaggggtttagaaaagaaagactgctcaggagggtcctgaggaaacttcagtgtggggcctcatagtttctttgtcgtcctagccagcactttgaaacaggcccttcaccttgacagctttttcctctcatttgtttccctatttttaaattcgccattttaggtgtgcttttacagcaagcatgccgacgagagagagagagagagaaatcttcagtactcctagtgagatagtagatagaagaaacatcatgaatatatgcaaacaaggaccaccctttgctttgcttttgagtgccaaagggggagagccaaagaccagcgtaaaaacaagaccatactttccttgctttcatgaccgtataggtgaaaacgagagctttctctccatgtcagtagcccctctcctcgcttttctgactgtatggctataagaatagttgtttactgttatctcttgcgaaaagagcaaaagaaaaggaggaaatattattcgtttcttgctctcttttgtctcttttctatgaaatgaattcacactgacaccatgcatgaggataagagaatcattattgtgaaatttgtttgcattaatcgttgtgaacttgttcttgtattacattactaaaaattaaaatcttgacatttacaaggtagtatatacatgcacgttcaggtaatatagaacaaaagtgtacttatttttgtcaaaactccattggatgattagacatgagtagtacatccgtctcaaaatataataacttttagctacgaatttaaacaagagtatgtctagattcgtagtcaataattgctatattttcgaacagatcaaggtagtaatgatatgtgtattgcatagttattcaatgagatcgttctttgacacgttggcctcattaataatatggtgcaatgcgttatattggagatcaatcattctgaccccgactatatactccgtataagtaagtgacaaaaagagttatgccttactacttttcccctcctttgttttcgcgttgaattatatgggagattaattaataaagtactgtgacaacacaactatagtactactagtctactaccgtggtatctgctatatctctcacaagagatccgaattggctaccttgatattatttaaatgaacatttctggtatcatctggagtgtaaataagagcaagtactataaaacttgctctaaggtagtccgtacttgaacagttgaaaattttgaattatttccctactgacattttaaagtgataccgtatctttcttattcaactgttgcacttcactgagctgttcttttttgacccccccttttccatattctattgcaggaagcttcaattcctcactcccaagagacagaatggccttaccagccatactggactcctgacaaccaggatcatcatggatagtagcaacaaggctggtaaatagtgaagatcaataccaaaagaaaactaaccacattctctttcaccttgtgtggtctctgtcttcttgaatatacaacattgctttcttgaagaatgtatgtactacggttgggagaagaaatagattaaagagatctgtatagatctgcctccatgaaaaaagggagatcaaattaactgtgcaaggacactccaagatagaagagacaaagttgttgaaagaaaagaaaagagaggacaaaaaaagtttgggcaaaggtattgttgtgcttaattacatcagaatgaaggctagacatgctagatgcagtcaatattaatgcaccccaatcgaagcataattataattacattttggtttatcacagcttttgatatgcattagatatttttcaactgtaaaaagtagtattgtttgcatgtactgtgatgtacattacaccccctggccggtcccttctctctctagatgggtgtgtgcgtgtgtgtttttcaccttgcttaccttgtgcttcaaatgcatccagggggactaaattcccaacttaataagttctttttcctttctagaggcgcaaaaattgtttagcgtttgggtactgatgctacttactttgtaacgagagttgaattcatctgccatgcatgttggtttcaaggaataaactggcgttgacatgcatgatttttgtggtctatatatatcacatatatatcagattactcgatgatctaactagttagtttactgctgtacctgtacatatggatttaagaatcagagtggtgttggctatatattaagagttatgcttgcatactgatactgatgtacatatacgtaagcacagaaaattcctttgttcatgtaaaaaaatatcagctctcaatatagacatgtgttgtatttat

SEQ ID NO: 6159 - DNA, 881 bp, Oryza sativa
  Predicted polypeptide sequence is orthologous to G1718
caaaaaagaaaaaaaaggctcacctacctcgaaccctttggcgccatgcgcatcatcaacccaatccaccgatcatcgagaaggcgtcttttcctcctctatatcaaatcgagcgagaacgatagcgagagcgaggcagatggtagcaaaagcatcgcgaagaattattaagaggaaattgaagagatcgggtaatgtcgctcaccaatgctccctcgtcgatggtgtcgatcgtgacgccggtgacggacagggacagcgggcggacggtggcgggcgtgccgccggtgctcgtcggggcgtccgtctcgtcggcgccggagctgcgggggcgggcgtacctggtgcaccacgtcttctacgaggacggcagcgccagcgccgacggtggcggcgtggccccggcgtccagggcatcgatcgcggcgctgagggaggtcgaggaggaggatgacgacggcgaggaggcgtccgactgcgcgatctgcctcgacgacggggaggagtccagggagacgtgcgggagcgggaggaggaaggagatgccgtgcgggcaccggttccacggcgagtgcgtggagcggtggctggggatccacggcagctgcccgctgtgccggcacgagatgccgccggcgacggcggcggaggcggaggaggaggaggtggtggtggcgatggtgcatggggagagggtggtgatgagggggaggcgcgtggtgctgagcgtgctggtcatgggccgggcccacgatgacggcgagggcccggagcaacgcggcacggatccgattcctcctcttccgcgtgtgctcatagatgatgtggattaattaataactcctctcaaatttaagaaagggtgatctggattaactagg

SEQ ID NO: 6160 - DNA, 991 bp, Oryza sativa
  Predicted polypeptide sequence is orthologous to G1743
ggtgtgagcgcgggagcacctctcccgacgagccttcccttctcctcctcgccttcgcgtcagcccggcatggggttcccggtctgctgctactccgagctgctgctccccaagcagctgctccacctcctcctgctgctcggctacatccgccgcttcctcctctgggcgttccacgccgtcggcctcggggacctgctggatctcggggacgagcagcaggcggtgctgcaggaccacgcgcgcgagcaccgcgcgccggcgcaggcgctgccgccacagcagcagcaccgccgcgccgagttccggacggtgccggcgatggtcatcgaggaggttctgccggtggtgcggttcgacgagctggtggccgcggccccggcggtttgcggcggcggggactgcgcggtgtgcctcagcggcatcggcggcggcgacgaggtgcgcaggctcagcaattgccgccacgtgttccaccggggctgcctggaccgctggatggagcacgacgaccagcgcacctgcccgctctgccgcgcgccgctcatccccgacgagatggccagcgcgctctgggccgccgccggcgtgcccgacgcctccgacttcgacttctcctacttcggcgcgcccctcacgccgatgcccacgccgactctgctacggccgcacgagctgctgctcactggccttggcggctaccagtaaccagtgaaccgccgctgttggttcacggagttggcaatatccacctactgcacagcagggcaccggcgacccggaatgcgcagtttttacaacgactgaattggtcgtcgtgttcggggaagaccaagaacaggaggcgccttcaactgtacataggcaaaaatgagtaaagcaaaccccccgaaaaaggctagatgattagtagatttttatttttgtttttgtttttgtacagaagattccatcttccaggtttgagaagtagtgaatctttgtgctgatt

SEQ ID NO: 6161 - DNA, 1033 bp, Oryza sativa
  Predicted polypeptide sequence is orthologous to G1743
ttccccaccacgcacgcaccgcacagacgcaagctcacctcagctcagctcacaattcggctgtatccaagatcgccatgggcttcccggtgggctactcggagctgctcctcccgaggctgctgctccaggtgctcctcctcctcggccacctccatcgctttctcctctgggccttccacgcagtcggcctcggcgacctcatcgacaacccgcccggcctggcggccacggagcaggacctgatgctgcaggggcgcggcggcgggatggcggagggttgggcgtcgtcgtcggcgctccagcaccgccggcccgagttcagggcgattccgccgatggccatcgaggaggccctccccgtggtgcggttcgacgagctggtggcgtccgccccggcggcggtgtgcggtggcggcgactgcgcggtctgcctcagcggcatctgcgggcgcgacgaggtgcggcggctgtccaactgccgccacgttttccaccgcggctgcctcgaccgctggatggcccacgagcagcgcacctgcccgctctgccgcgcgccgctcatccccgacgagctcttgcccgccgcctccggcctgcctgacccctccgactacgacctctcgtactacccatccccgctgccgctggcgcccaccccgacgctgctgcgaccacacgagctgctgctcaacggcttgggcggtttccagtgagcccgccaatccaccgccccggtcaatttcgttgcaaccggcatgacagagctgcctcaactacggcacacgggcacataggcgtcctgatttgtacataggcgccaaggagaactccccccaaaaaaacacaagtaggaatagtttgctgctatataggtcgattccaccttccaagcctgcgaagttgtgaatccttttttttttgcagattactagtagtatattaaatttgttgaagcagagcagtgccacagtttggtgcttgctaatttggcaagccgtttaatccaatctccccacgctattcaaatctt

SEQ ID NO: 6162 - DNA, 1088 bp, Oryza sativa
  Predicted polypeptide sequence is orthologous to G1743
ggccctctaaaaccagacactgctgctgcgtgtctgtgtgccgcgccacctatgcacctcgcgcgcgcggcaagcgctcctcctgccggcgccttcccctgtccctcgcttgcctccagctgcagcagaggagcgcgtgtgcgtgtgtgtacggtgcatgagctttccgctggtgtgcttctgccgccagatcccgcggcccatcgtcgcgctgttcaagctgctccaggccgtggcgctggccttcgtgctgatactctgcttcctcggcctctacgagttcccctacaccgtcgaggaccacgcgccgctcatccacggccgccgccgcgatcccctcggcgacgacggcctgcagcccgaggcggtgaagcggggcctcccgctggtcgagtacatgcaactcgccgacctgtcggcggattgccacgacggcgagagcggctacccggccacgtgcagggtgtgcctggagaggttggaggcgacggacgaggtgaggcggctgggcaactgcacccacgccttccacatcggctgcatcgaccggtggatcgacctgggagaggtgacgtgcccgctctgtcggtcccacctgctgccacgtcaacgaaggggcctgcttggcagtaggcggttcggctagattgtctcgcggcacggcgccatgggggcagtttcgtcatttcaggctgtacatctcgccattgttgctggatgggtgcaggccaaccgcagactgattccgatcaggacgactaaccaccaagcagtaccggtgctaatcaattgatagttgtgctcacgcgaaaattaatggcattttggaattccacgggtgtactttaacgcatagttgcatccgacgagctaggtaacgtgcacccgtttagagcgagtacaatggcaggctacaagtaagctataagcatacgtggaagagagaagagataagagagaaggaaaacaggctatatatttacagccagcttcagcacggaatctaatacattgtgcgtgtatgagatgtaggatcatatattaatagtgtactactccctccatttcacaatataagtcattctagc

SEQ ID NO: 6163 - DNA, 675 bp, Oryza sativa
  Predicted polypeptide sequence is orthologous to G1743
atgacgagcatgagagggaaaggccgtagaagggagcggaggagaaagaggagggcagaggagaggagttgcagtgtggtgtgtggcatgtcactcactcactcactcaacaacttcttcttcttcttcttcttcttcttcttcttcttcttcttcttcttcttcttcttcttcttcttcattctcagctggactacaaagaatataatggggttcccggtgggtggctactccggcgtgccacggctgctgctccacctcctcttcctcctcacccacctccgccgcctctcctcctgcctgctccgcctcgccggcgccgacatcgacgactccccaaccgccgtcgacgccgaatatgacggcagctacagctacagctcccagtcgtcccagctgctggagctggacgaccactccccggcgctgcgcttcgacgcgctctcatcatccctgcagccgccgctccacgtcgccacctgcgccgtctgcctccgcgacttccacaagtccgcccaggtgcgccgcgcccaccgctgccgccacgtcttccaccgcgcctgcctcgacgcctgggcccaccacggccaccgcacctgccctctctgccgctcgccgctgctgccctcgtcggcgccgcccgttctcctgccccttccactccctgcctcctag

SEQ ID NO: 6164 - DNA, 700 bp, Oryza sativa
  Predicted polypeptide sequence is orthologous to G1743
caccaacctgagcacctgaccacatcaagcaaaagcaaagcaccatttcattttccaccatacaaacccatgggcttcccggcggtgtactactgcgtcatcctcccgcctccgctccactccctcctccacctcctcgagtgcatctcccgcggctgcgccctcccggccgcgctgctcttctccggcggcgacgccgacgccgaagccgagctcgccgcaccaccacccggcgccgccgccaccgccgcgcgcgcccaggccgacgggatcaagagccgcctccccgtcgtcaggttcagcgccagcggatccggctccgacggggaggaggaggacggcgccgccgcggaggcgtccccgcgctgcgccgtgtgcctggccgccgtggaggagggggcggaggtgaggcagctgggaaactgctcccacgccttccacctcccctgcatcgatcggtgggtcgacatgggccacttcacctgccctctctgcagatctctcctctgattaatctatcacttccttgttaattattcttttcctttctagtttagcttagctcaatttagcttccagatactttcagcagtttggatcttactagcatctactaccaccactaggctgtttcacataccacgtaatgatgtacacgcttaattaattattctattattatcacaccagagaaaaaaaa

SEQ ID NO: 6165 - DNA, 2240 bp, Oryza sativa
  Predicted polypeptide sequence is orthologous to G1750
gtgacccggagtacaactacaacaacggcaatcgcttatcttgggatgacaatgccaaagatgaaacatatgcatatgtgcagcacaattacagttcgtatgatcgctcttatgatcagtcttacagtcttgatgccgtttccgatgaaactacttggtttcctaatcagaactaccagcacgtgtacaaagaggaggaatctcagtatcaggaaatcttgtccagctcttgtgcagaaagtaagatttcagctcagcctatttattgttacaaccagcagtttagtgaacaaccgctacatgttcttgttgagcccccagaaacagtttattctcagaagttggagtactatgagagcttctcaacatacaaccaccataacagcaacgatgattcagatatgttgggacattcatatgacatacagctgcccgatgaacatgtgccagatgaaccatttgaaccaattaagccttcttgggctatgcattcgggatactatcagtcctgcacagatggggcatctgctgaattcgaaaatcatactttaagctccagtgaattcagtggtattgcaagcttatttgcaacttccttctaccctcaacaaacacaaatttatgggtgtcatggagatgagaatgtttccttgcagcaaaattggcagtgcaactggaatgtggtttctgaaaatgatttccaatcggtaagcgtaacggtgtctatgtctgtgaacgtgcttttttaataccctatactcttatttttatcgctccattttactcctatttgtgtactgttgaatgtgtgtcatggtcggtacacatgtagttgaagtgctaaggatggcgcacagggggcagaaccaagcggcagcagatagaccatcaatgcatttgccgcacctatcgtacctccttagttgtttgattcaatttgtttaggttgagatttgttaaactttttaggtttgttaggggctggctttatttaagggagcttggcattatctttgaaattaagagcaaattacaagtctactctctcatcccctgttctctctgcctctccccttttttggtgctgcctggtgccatctcattcaaccatgggtagtaagactgttaacctatctagctacttcccactcctatcttattagatcactccctaacgcccgaatatattatattgttcttggcctcatgggtggctgatgacgatcaatgaaaacttcagacatgtctgtgagtgatgctttttttccccttgcaaacgatagaattatgaattagtatctgttttcgttttggatgctgtaaatttaaaatgtctggacctttatagtatgtcccgtgtatcctttcacattcttctgaaatatttatttttgctatttaatatgcaatccatgacacaatttgttttgttgctcaagaatggccatcacatgatctcatttgctgaagttcaaaatggcactgcttggctgcgattttttgcggctgcagctgtgcttaatgtctgtggctgtggtgcacagccgtggctactagcagcagacgcagccacaaaaatgacagccaaacaagcccaatatatctctttcagatttagttaatacttggttgctctttgttccatatattctgatgttagtgtaacttttatccacattcatgatctaccacacttgccagtgttagtagtaattgggatttacttgccaaaagaataattctcagactccagcagataagtgaggttaactctgtctttatggtatagttttcttaacaaatcagcaatctcagtacccttgctagacgattttaatgagtgttaatagtttggttgtttgtgctttgctggtattgttgctagatttcaactgaaacaatcttgtatggtgcccgcatcacatttttatggttgaaacatgagtgtgcaactgtgcatgcgatgtctccatgttgtcttttgaactgaaatatttctccatttttatttgcagggttacgattccaaccatatgaatggctacttctggccgtttggagatcattcagcataataccacatagtctatattgttgtaatttcactcttatcttttttatgtacatttcatttaaatttacccggccaaatgtaaatgaaaaaaatatatataagaggttatgcaccaatgtatctaggttcagcatataatgtaagatcattgacgctgttgttgacc

SEQ ID NO: 6166 - DNA, 917 bp, Oryza sativa
  Predicted polypeptide sequence is orthologous to G1752, G2512
atactcgatctattatttggcggcggctgcctctgcttgcttgtgactgtcgtgtctgtgcgtgtgtgtgtacgtacatactccagtatatatatgcattgctgcatgtcgcttcatcctcaccgccgccacggcgacggcgacgtcgacggatcagcatcaggatcaggatcagcgcgcctcaccgccggcctcatcaacttcctcgaatcgcgtcgcgccggcgccatgagcaccaccaacagctcatcctctgtctctgtcccagccatggacgcccatggacaggaggaggaggaggagccgatgcaggtgcagcaacagcaggcgttccgcggggtgcgcaagcggccatggggcaagtttgcggcggagatccgcgactcgacgcgcaacggcgtgcgcgtgtggctgggcacgttcgacagcgcggaggaggcggcgctggcctacgaccaggcggcgttcgccatgcgcgggtcggcggcggtgctcaacttccccatggagcaggtgaggcgttccatggacatgtccctcctgcaggaaggggcgtcgccggtggtggcgctgaagcggcggcactccatgcgagcggcagcagcggggcggcggcgcaagagcgctgcacctgcaccggcggatcaggaaggcggaggaggggtgatggagctggaggacctgggacctgactacctggaggagctgctagccgcctctcagcccatcgatatcacctgctgcacaagcccaagccaccactccatctgatctctactcgtattcctcacacgcgcagaggatgcacatcctctgcactacacttgtactagcagtggttaacatgtggatccggttccatgctctgattgttgcttatatttttcaaggaatataaacaaatccgatcctgagtt

SEQ ID NO: 6167 - DNA, 899 bp, Oryza sativa
  Predicted polypeptide sequence is orthologous to G1752, G2512
cttcctggaaagggaataatcaaacacgccccgtcacttcgccgcacacatcacagtgatcgcagccgctaagtcaaacattcccagctcacagagtcacacacatggagcaacacagccactgctggtactacggcggcggcatggctgtcaccgcagccgccggtgccggcgcggcgtcgtcgacatcctcggaatcgcagccgtctggctacgactacgagacggcggggagcgccgaggtgtcggcgcccggcggcggcggcgggcttcatcggcgtgcggaagcggccgtgggggaggttcgcggcggagatcagggactccacgcggaacggcgtgcgggtgtggctcggcacgttcgagacggccgaggccgccgcgatggcctacgaccaggccgcgctctcggcgcggggcgcggccgcggcgctcaacttccccgtggaacgcgtgcgcgagtcgctccgcgcgctcgcgctcggcgcggccggaggctcgcccgtgctggcgctgaaggggcggcactccaagcgaaagcggcggaagagatcagagctggccggtgccacggcgacggcgaacaagacgacgacgacgacgtccgccacgaccggcggggagcacaagcagatcgtcctcgagctggaggacctcggcgccgactacctagaggagctcctctggatgtccgagcaaactagccattgatgatgatgcgaacgaacctgcaaaaacatagctctcgcgcgcgatcgatcgcgagttcaatacttcaactcgatcacatccatgccttgcaatgcagtgtgtgaactcgaccgatcagttggtagtggattccatgtgaaaaaaggctgcaacgtaactgcttcaaatcgtgacataaaattggactc

SEQ ID NO: 6168 - DNA, 1492 bp, Oryza sativa
  Predicted polypeptide sequence is orthologous to G1752, G2512
gaaccaatcagcagctaaaagtcaatccacgccaccatcgatctctctatccaatccaagcgcgcaaatcaatggcagagcatttcagccacgccggcatgtacatcggctacacggcagacgccgccgcgtcctcctcctcctcctcctcgtcttcgtcgtcttcctcctcggagatgcttcggttcgacacgggctggcccgacgagacacctgcgccatcctccgtggcggggaggaggaggagcgcgggcggtgatcatcgtcaaggtcggggacagacggaggcggcggcggcgttcatcggggtgcggaggcggccgtggggcaggttcgcggcggagatccgggactcgacgcggaacggcgcgcgggtgtggatcggcacgttcgacagcgccgaggccgccgcgatggcctacgaccaggccgcgctctcggcgcgtggcgccgccgcggcgctcaacttccccgtggagcgcgtccgcgagtcgctccacgcgctctccctcggcgcggccgggggctcccccgtgctggcgctgaagcggcggcactcgaagcgaaagcggcgcaagaaagctgaactactcgccgccgccgccgccaccgccgcgacggcgaatgccacgccgcagacgcggaggatcagcaagagcacggaattgactactgcgacgacggacgagcagaagcggttcgtcgtggagcttgaggacctcggcgccgagtacctggaggagcttctctggctgtcggagatcaatggtggtagtgaccctgctgactgatcatccaaaaggttggcaatttgcaaggcacctcttgcgaattacatttcgcgcgcatgcagttgcaatggaacgtgcaaactgcaaaaagctgcatgcaagtatgcaactgcaactggaagtactacttgaacacatgcaagtatgcaactgcaagtactacttgaacacatgcatgtgtgttattgcatcctactacttgctgtctggctctctctagagtgccaataaagtgcagacaatgcaacacatgctggagcaagcaacaatttggtggtcaccaccatattatacgcacaacatgctgaagtattttcaaggtgtgtactttgggcggggactgaactttatgtctttatcggacacaaggacctacttcccaaaagctagctagcttgatgcatgcatcttgccccatgggtacacataataatattattaaactttgtatggcatgtgcccaaattagtactatcaacatttatatgtactagtatgaccgtgattttactctcgaaattcactgtacttaacaactttctatgctccctcgagtaattaaggtaaaagagagtaactcaaaaatacgttaagctaccattaaacactttcagcttgttgttaaacggaatactagctagtgtgtacaagaagatgaactgaatgaacaaaaggaaaatctagcggggaattggctcgag

SEQ ID NO: 6169 - DNA, 716 bp, Oryza sativa
  misc_feature (452)..(452): n is a, c, g, or t
  Predicted polypeptide sequence is orthologous to G1765
ttttttttttttttttttttttttctttccatcacatatacatttaatttatttgtttagaagtatgtcttgaactagcttttgcatgggaaccaatatactctagtttttgttaaatcttttctccacataagtttatagttagcttatagctcaccattaacgttgatatgctactatcaagaagctaacaggggttctaattcctttgtcatttagtagttgcacagagccaaatgcagcacatcatcatcctcccccctggagcaaattaaaatctgggcagtgggtcgtttgtttaatagggtggccaatgcttcaagaatgcggtgaatgttattattcctcacgcccctcatccctaggagaatgtttttttgtgggcccctccatgcaactcctctccaggggaaggatcataccacatggtggtgatgaggttgtgtgtgtgncattgtatgagtacttctacattgagaagaatcattgggggacaactttttggtgatcaagagctggtgggtgccattcagccattgtatagtactccattaacaggaataaccccagagcccatggtacagaacaggaaaaagaatcattgggggaacactttttggtgtgggcaggggaaacttgccaagtaaaaaagttgctttttttacccctttgacatgaagggaagagggacatcccaaagatcagggaggatcaag

SEQ ID NO: 6170 - DNA, 680 bp, Oryza sativa
  misc_feature (640)..(640): n is a, c, g, or t
  Predicted polypeptide sequence is orthologous to G1765
ttttttttttttttttttttttttgattgccataagaacttagaagccacataagtacattatccgataatggaaaatggcggcaacgacggtaatgggtctgcggtgccagtggtgagctggaagcatgagctggtgtcacggctacagttaagtcctagcttccactttgtgccgacggacaaggagctcgtggacttccacctccgcggtaagatcaagagacgcaaaccgcctctctacctcatcaatgaggtcaatatcatgcgtcatgattctgaaatgattggtaatttaatcttctttagttgattgatcgctttgaagttatgtatatctatgaaccaattgatttgtgataacacaatatgcatgcatatagaaatacaagggctatggggaaggtatgtggtactttttcatggtgagggggccctcgaagactaaaaacacggttgagttgaccacaaaaaacattattaccgtctcacattatcaaataacttatgacgatacctacttctttatcacttcacaccagtgctattgttccatagcctattccgcatccctacccttcacaatgcgcgaccgttatatattgggtgtaaagcactccataatgcgctactcatccccntcgggcgtctcccgtccgcacccatggcgtagccacagat

SEQ ID NO: 6171 - DNA, 1405 bp, Oryza sativa
  Predicted polypeptide sequence is orthologous to G1765
gaatatctcaagagagctagctagagctccatttacaaccattacaagattgcatcagagaagatatcttcatagataattgttggagcaagaacacaagaaaacacgtaggttcaattataatcgatcgtggagatggtgaccagcaaggagtttgcatgggatcaggcggccatggatcagaagatcaagagcgacgtcggcgaggtggtgctcgccggagacgaggaagaagacggggacgtggtgctcccggggttcaggttccacccgaccgacgaggagctcgtcacgttctacctccggcggaaggtggcgaggaagtctctcagtatagagatcatcaaggagatggacatctacaagcacgatccatgggatctccccaatgcgagcacggtaggtggagagaaggagtggtacttcttctgcctgagagggaggaagtacaggaacagcatcaggcccaacagggtgacgggatccgggttctggaaggcgacggggatcgaccggccgatctactccgccgccgtcaacagcaactccggcgagtcgatcgggctgaagaagtcgctcgtctactaccgcggcagcgccggcaagggcaccaagaccgactggatgatgcacgagttccgcctcccgccggcgatcgccgccgccgacgcctccccgtgcatgcaagaagctgaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatgagcacgatgagctgcaacggcggctacttcttcaacgacggcatccatcacagccacagccaccacaagcttcatagtcaatggggctccctacaaatggcgccgccggagccgaagccggagccggagcagaagcctctgagctcgccggcgatgacgatcgccttccatcaaaacgaccatggcttccccgccgccgccgcggatttctacaaggatgggtacttggaagagattgcgaggatgatggaggtggctgatccaagtccaacaggattctatgactgtagatattgatcagtaggaacagggtttcagaatagatgctagatatgcagaattcgccgacaagaacagtgccccctttgtgtgagaggctgacatgtagggcccatgctgcagaggctgctatcactattagtcttgtacttttgttttctgatctaatatatacactccagatgggatgtgaactgtc

SEQ ID NO: 6172 - DNA, 1118 bp, Oryza sativa
  Predicted polypeptide sequence is orthologous to G1767
agaaaccgttccccccactttcccctctctctccactttttacggattaggcggcgacgatgatggcttgcgtgtgcggcaggcggttgaccgacgattgcaggacgacggcgggcgggcgatggcatgggcttcctcggcttcctctggcggcgggcgacggcgacggcctgcgccagcagcgagcgacggggatggcctacgttagcggcgggcgacgggctcgccggggtgacctccgcccgggtccagcagcggtggccgtcccccgccttgatccgacatcggcggtgggagtttgagacggagctgacttcgatggcggtgggtcgtccggactggtcgccggcgatggaggcgtggtggcgcatcgtccgtccgtgagttggtgccgcctcctgggatctgccccgacgacctaccgccaaatccaagccctcgaccatgaaggaaccgttccaggaggccggtagcctcactgctctggccttcctccgtgacggctgagatcgtgtggtggtggcggagaaaagccgagtagctgatgaagcggagaccacatagaggaggagttggaagaggataactcgccgacggcgtgagttcctgccgagcggtgggagaccggcgtgtcctgggcgcggtgcacgcggtcggcggagttatcgctggcggcattcagtgatgacgtcgccgacgacgtgcggtcgcttctccggcggtacaaggtggctggttgatgcgggactacggcagtgacatggacaacgccgccgctgccggagcattccttgcgtggaaggagcagcctgtcgtgtggacgagtgcgtggatgccttgagatcgattgatccaacaagtccaaatccgccattgctgcaaatgatcgagcctgcgattcatttgattcatttgtttaatttgattctcagttgattcctctgttctttttttttttttgaactagctgattcatttgtataactgaatattccagtgacttgtataggaggtagtgatagattatttgctttaccggttaacactgaatctcacgttcttgatgcatgttatgtatatatctgtgtcctctatgcaattatgagcttgtttgcatt

SEQ ID NO: 6173 - DNA, 2279 bp, Oryza sativa
  Predicted polypeptide sequence is orthologous to G1767
tagatggatacgctgtttaggttggttagcctccaagccgcctccgagcagcagcagcagcagcagcagtcggcgtcctacaactcgaggagcacgacgtcgagcgggtccaggtcgtcgtcgcaccagacgaacgcgtcctacagctactaccaccacagcagcaacagcggcggcggcggcggaggcggcggagggtactactacggcggccagcagccgccgccgtcgcagtactactacctggagccgtaccaagaagaatgcggcaacgccccacaccaccagctttacatggatgaagacttctcctcctcgtcgtcgtcgaggcacttccaccacggcgcgcgggtgcagcagcagcagccgccggcgtcgtccacgcccacggggacggcgccgacgccgccgctgtcgacctcgtccaccgcggcgggcgccgggcacggcctgttcgaggcggcggacctgtcgttcccgccggacctcaacctcgacttctcgtccccggcgtcgtcgtccggcggcgggacagcgtcgtcgggcgcggttgggggcggtggcggcgggaggtgggctagccagctgctgctggagtgcgcgcggtcggtggccgcccgcgacagccagcgcgtgcagcagctcatgtggatgctcaacgagctcgcgtcgccgtacggcgacgtggagcagaagctggcttcctacttcttgcaggggctgttcgctcggctcacggcgtccgggccgcgcacgctgcgcacgctcgccgcggcgtccgaccggaacacgtcgttcgactcgacgcggcgcacggcgctgcggttccaggagctcagcccctggtcctcgtttgggcacgtcgccgccaatggcgccatcctcgagtccttcctggaggtcgccgccgcggcgtcgtcggagacgcagcggttccacatcctcgacctgagcaacacgttctgcacgcagtggccgacgctgctggaggcgctggccacgcggtccgccgacgagacgccgcacctctcgatcaccaccgtggtgtccgccgcgccgtccgcgcccacggcggcggtgcagcgcgtcatgcgggagatcgggcagcgcatggagaagttcgcgcggctcatgggcgtgcccttccgcttccgcgccgtgcaccactccggggacctcgcggagctcgacctcgacgcgctcgacctccgcgagggcggcgccaccaccgcgctcgccgtcaactgcgtcaactcgctgcgcggcgtggttcccggcagggcccgccggcgcgacgcgttcgcggcgtcgctccgccggctggacccgcgggtcgtcaccgtcgtcgaggaggaggcggacctggtggcgtccgatcccgacgcgtcgtcggcgacggaggaaggcggcgacacggaggcggcgttcctcaaggtgttcggcgagggcttgcgcttcttctcggcgtacatggattcgctcgaggagagcttccccaagacgagcaacgagaggctggcattggagaggggagcagggcgcgccatcgtcgacttggtctcgtgcccggcgtcggagtcgatggagcggcgggagacggcggcgtcgtgggcgcggcgcatgcggtcggccgggttctctccggtggcattcagcgaggacgtcgccgacgacgtgcgatcgctgctgcgccggtacagggaagggtggtcgatgcgcgaggccggcacggacgactcggcggccggagccggcgtcttcctcgcgtggaaggagcagcctctggtgtgggcaagcgcgtggcggccatgatcggatcgtcgtgatcgatggatcaaagctcaccggtgagtggaacagcatggaagaaaagagctccatagctaagcaagcacgcatgcatatccaccatgcatggggtaagctagcaagctctctcgtgtgtgtcacgatcgacattaatggcggctcacacaaaggcatgtagggttttgaaacagcgtagggagctacagaaatggatcacgtacgtacgtacacattgggttgcagcgatcgaggagggagatgatagttttagttcctagatttgcatccatttttattcatcgatcgccaacaagttcttggcgagaagatgattttgatttgcttgcttccatcttcttgtttatttttccccctttcgtttgtgtttcttcttaatttgtaagggttaacgacatttttcttcactctggagaaattttacgtgcatggtttttatcatgcgtacctgc

SEQ ID NO: 6174 - DNA, 1812 bp, Oryza sativa
  Predicted polypeptide sequence is orthologous to G1767
atggataccctcttcaggttggttagcctccaccaccatcaccaccaccagcacgcggcctcaccgtcgccgccggaccagccgcacaagtcgtacccctcctcgcgagggagcaccagctccccctcctcccaccacacccacaaccacacctactaccaccactcccactcccactacaacaataatagcaacaccaactactattaccagggtggtggaggcggcggcggagggtactactacgcggaggagcagcagccggcggcgtacctagaagaatgcggcaacggccaccagttttacatggatgaagacttctcctcctcgtcttcctcccgccagttccactcgggaacgggcgcgccgtcgtcggcgccggtgcctcctcctccgtcggcgacgacgtcgtccgcgggcgggcacgggctgtttgaggcggcggacttctcgttcccgcaggttgatatcagcctcgacttcggcggctctccggccgttccgtcgtcgtccggtgctggcgccggcgccggggcagcgccgtcgtcgtcggggaggtgggcggcgcagctgctgatggagtgcgcgcgcgcggtggcggggcgcgacagccagcgcgtgcagcagctcatgtggatgctcaacgagctggcctcgccgtacggcgacgtcgaccagaagctggcctcctacttcctgcagggcctcttcgcgcggctcaccacctccggcccgcgcacgctgcggacgctcgccaccgcgtcggaccggaacgcgtcgttcgactccacgcgccgcacggcgctcaagttccaggagctcagcccgtggacgccgttcgggcacgtcgccgccaacggcgccatactcgagtcgttcctggaggccgcggcggcgggcgccgccgcctcctcctcctcgtcgtcttcatcgtcgacgccgccgacgcggctgcacatcctcgacctgagcaacacgttctgcacgcagtggccgaccctcctggaggcgctggccacccggtcctcggacgacacgccgcacctgtccatcaccaccgtcgtgcccacggcggcgccgtcggcggccgcgcagcgcgtgatgcgggagatcgggcagcgcctcgagaagttcgcgcggctgatgggcgtcccgttcagcttccgcgccgtgcaccactcgggggacctggccgacctcgacctcgccgcgctggacctccgcgagggcggcgccaccgccgcgctcgccgtcaactgcgtaaacgcgctgcgcggggtcgcgcgggggcgcgacgcgttcgtggcgtcgctccggcgcctggagccgcgcgtggtcaccgtcgtggaggaggaggccgacctggcggcgccggaggcggacgcgtcgtcggaggccgacaccgacgccgcgttcgtcaaggtgttcggcgagggcctccgcttcttctcggcgtacatggactcgctggaggagagcttccccaagacaagcaacgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatga

SEQ ID NO: 6175 - DNA, 600 bp, Oryza sativa
  Predicted polypeptide sequence is orthologous to G1767
cgagaggctgtcactggagagggcggtcggccgtgccatcgtcgacctcgtgtcatgcccggcctcccagtccgccgagcgccgggagaccgccgcgtcgtgggcgcggcgcatgcggtcggcggggttctcgccggcggcattcagcgaggacgtcgccgacgacgtgcggtcgcttctccggcggtacaaggagggctggtcgatgcgggacgccggcggtgccacggacgacgccgccggcgccgctgctgccggagcgttccttgcgtggaaggagcagcctgtcgtgtgggcgagcgcgtggaagccatgagatcgatcgatccaacaagtccaaatccgccattgctgcaaatcatcgagcctgcgatgcatcgtgcatgcaatacacaatatggatcatgcatatcgcacgtgcgggttgaatgggaagaggaagcagcgcgcgcgtgtacgtacttagggtttttcagccagcaacgtacgtgtgtagcagggagaggaggtagcaaaacacatcagatggattaagttaatcaatcaccagttattactagaaaattatttggaggaattaattggcatttattgtcttgc

SEQ ID NO: 6176 - DNA, 1978 bp, Oryza sativa
  Predicted polypeptide sequence is orthologous to G1772
gtcgcggcgatcaaaaaaacccaacccctcctctcctcgccgccgccgcccatggccagcgaccgccgctactactacttcgaagaagacgatggcgatggcgaggaggaggtggagtggctggcgatggaggccgacgaggacgacgtcggcctgctcgaggaggacgaccttcacctgcggcttcccgacgaccgccccgcggattgctgggccatcacacaagagtcacttcctgctgcccagcaacaagacctgtctatggtaatgaacttgctcaacataaagcagcaccttgcacgcacactccttatccaccaccggtggaagatgcattgcatttatgatcaccttgacagaaaggggcgggaccgcatgctcagtgaggcatgcattattttgccgaagaatagcatgtcagcagctagctcaacaagtgttacctgcaatgtgtgttttgaggacttctcaatgactgatgtctcgaccatggactgtgggcattgcttctgcaatgactgttggacagagcacttctttgcatccattaatactggcaacaagcagattcggtgcatggaggttaagtgcaaggccatttgtgatgaggacattgtgcgccgcctcctcagtctgaagtaccctgctgcatctaagcgcttcgatctcctcctacttgagtcttaccttgaggacaatgactcagtgaagtggtgccccagtgccccacactgtggccgcgcaatccaggtaggcaccggcgagaggtactgcgaggtcgcttgcccctgtggtgtcagcttctgcttcaactgtgcagggcaggtgcactcgccttgcccatgtgccatatgggagaagtggaaagctaagggccatggagactcggatagcgtcaagtggattcttgccaacaccaagagctgccccaagtgctccaagcccatcgagaagaacggtggctgcaaccttgtccattgcaagtgcggccagtgtctatgctggctctgtggtgggcctaccgggagggagcacacttgggatagcatctccggccacagctgcaaccgctacaaggaggaaaacggcgacaaggtggacaccagcagacagcagatgcagcggtacacgcactactgggaccgttacaacatccacgccggctcgtacaaggtggagcagaaggatcttgggcctgccgtcgaggagcaggtgaagaagctggagtcgaacctaacaggtccgaagatgaactgggacggtagctggctcgccatggcgtaccaatccctgctcgcatcgcggcaggtgctgtcgcggtcgtacgccttcgcctactacatgtttggcggcggcgaggtgaagacgcgcccgtcggagcgggcgagcctcgccgtggcgcagaacctcttcgaggaccggcaggagcagctggagcgccacgttgagcatctctccaaggagctcgccacggacttgctggggctgccggaggaggagatcgtcctgaagaaggtggagattgccaacctcgccaagatcgtccaggcaatctgcgggcagttgtacaggtgcatccaggacgaactcctgccactgctcgtccagcccatgaacattgccgcgtaccagccggacggccctgacaaggccaaggagttcatcggggcttgacatacagacaaggctagcttccagtttggcagctgccgctaacctcactgtgcttatcaggtaagttatatatatatatgtgtgtgtgtgtgtgtgtgtgtgtgtgtgtgtgtgtgtgtgtgtgtgtcagtatgtagatttgacttacttacgcctgagcgaaggacgtaatgttcattcgaaattaaagtgctatacttgccttattttttggttgttggggcgtattttggtttcaaaatagtattctaagcattgaccattcttctcataagatagataattctttttttttccgtgaggc

SEQ ID NO: 6177 - DNA, 1995 bp, Oryza sativa
  Predicted polypeptide sequence is orthologous to G1772
atcaaattccaaaaaccctccgcgagctccgacgacgcggccgccatggacggcagcgacgacgagtgctgctactactacgacgccgtcgacagcgatggggacgaggaggaggaggaggagataataatgctggacgaggacgacgtaggcttgctcgacggcgccgcgctgccgccgccggaggaggaggtggagcaccgcgcgatttgctgggccattacaaaagaatcccttgcagctgcgcaggagcaagacctgtccatggtgatgaacctggtgaacgttgagcggcacaacgcgcgcgccctcctcgcccaccaccggtggaagatggagcgcatctacgaccgcctcgacatgatgggccgggacgccttgctcagggacgccggcgtcgttgtgctgccggagaagagcagcagcagcggcagcagcatggccatggcgaagacgaaccccccgggaagcgtggctgtcacctgcaacgtctgctttgaggagtacccactcggctctgtctccgccatggattgtggccactgcttctgcaatgactgttggacggagtacttcgctgcggcggtgagcgacggcagcaagcagatgaggtgcatggaggtgaagtgcacggcgatctgcgacgaggcggtggtgcggctgctgctgcacgggaagcaccccggcgcggcggcgcggctggaccgccgcctcctggaggcgtgcgtggaggccagcgacgcggtgcggtggtgccccagcgcgccgcactgcgggcgcgccatccgggtggacggcgggggcggcggcgaggagcggtacgccgaggtgtcgtgcccctgcggcgccgtcttctgcttccgctgcggcggcggcgcgcactcgccgtgcccgtgccccatgtgggacaagtggggcgccatgcgcggcggcggcgaggtcggcaacctcaagtggatcgtcgccaacaccaagagctgccccaagtgctccaagcccatcgagaagaacggcggctgcaaccatgtcacttgcacctgcggccagcatctctgctacgcgtgcggcgcggcgacggggacgttgtacatgcacatctgcaaccgctacaaggaggagggcggcggcggcggcgtgaaggtggagatgaccgccggtgggcggcagcggctgcggttcatgcactactacgagcggttcgagatccacaccgagtcgtacaaggaggagcaggggaagctgggtccggccatcgacgctctggcgcggcggctggaggcggacgccacgctgccgtggtcgggcaccagggacgcccggtggccgtcggcggcgcaccggcggctgctgcggtgccggcaggtgctcccgcggtcgtacgtgctcgcctactacatgttcggcggcggcgcggcgacgcggcgcgagcgggaggaggcggcggcgcagaaccggttcgaggatttgcaggggcagctggggcaccacgtggaggtgctgtccaggacgctggcggcggcggcgcggccggccgacgcggcggaggtcgtgaaggcgaagcgcgacgccgacaacctcgcccgcgtcgtcgaggggctgtgcgccgggatgtaccggtgcgtccaggacgagctgctgccgctgctcgtcgagcccatgaacatcgccgcgtaccatccggacggcccggccatggccaaggagttcccgccggcgaccagcgtgaccggcggagcaccgccggcgacacgccactaagccacaacgtgtcgagttcattattactatacgaagcaaggttgtaaacggtcgatgggtgaagggaagcaggtggttttgggaaaaattctattgtccaaacatgtttgtggtttggcatggtggatttttggattaattactagctaagtagtataggaaatatcctatattgatacagaggaaatgatggattattttgtgctgattaattagtctaattgttcgacgttgtgc

SEQ ID NO: 6178 - DNA, 2482 bp, Oryza sativa
  Predicted polypeptide sequence is orthologous to G1777
gaaaccagtccctctttccggccgcaccaccaccgcctcccctccgtttcccctccctcacttccccttccgcgactgcgagcttctccgccgccgccgccgcccccaatcgcccgccgccccgcgccgcgattgcccctcccggtgcccctcccgcaggcgccgccgattcccccgacccggggaagccccggtttgccgcgagctgcgtcgccggtgggggtttgatttggggctgatccgatcgcccccccctagatggtgaccgacgccgaggaggtctccccgacggcgtcctcgtcggaattggagcaggaggacgatgacgatgactgctacctgagcgatcaggaggacgacgccttggaggagtccgtcctccaggtgctggaggacgaacgcgacgaggattgccattggtcctccacctccgtgatcaccaaggaatccctcttggcggcgcagagggaggatcttaggaaggtgatggagttgctagggttgagagagcaccacgcgcggacgctgctcatccactacaggtgggatgtcgaaaggattttcgagctgcttgatcagaaggggagggacaggctcttctcggaggctggtatccctctccaacctgctaataatcccggctcgccctcctcaacggaggtaacctgcaatgtttgctatgacgatgtgcccctctcggacgcctccaagatggactgcggccacaactactgcaatgaatgctggacaggatatttcattgtgaagataaatgagggacaaagccgccgtatcaagtgcatggctctgaagtgcaatactatctgtgacgaagcaatagtccgtaagctagtaaatgcaaagcggccagatattgcagagcgctttgaaaggttcttgttggaatcttatattgaggacaatgatacagtcaagtggtgcccaagcacaccgcattgtggaaatgctatacgcgtcaaaggtgatattcactgtgaggtggaatgtacatgtggacgccagttttgttttaattgctcctcagaagcacattcaccatgttcctgtgtgatgtgggagctctggatcaagaaatgccgtgacgagtcagagaccgtgaattggataacagtaaatactaagccctgtcccaagtgccacaaacctgttgagaagaacggtggctgcaatctggttgcatgtatatgtgggcaagcattctgctggttatgcggtggtgctactggcagagatcacacatggtcaagtattagtggccacagttgtggtcgattcactgaagatcagtcaaagaagacagagcaagctaggagaaacctttatcggtacatgcactaccacaacagatacaaagctcacactgattctcttaagcaggaagcaaagcttaagggcgacatccaggggaagatttccatttctgaaaacaaggattccaagataaaagattactcttgggtgataaatggattaaacagacttttcaggtcaaggcgggttctttcatattcttatccttttgcattctacatgtttggtgatgagattttcaaggatgagatgacttctgatgaaagagaactaaagcaaaacctatttgaggaccaacaacaacaattagaattcaacgttgaaagactatctggtttccttgagagggattttcaaaattttagtgatgatgaggttatggatacaatgaagcatgtcatcaatctttccaatgtggttgatagactctgcaagcaaatgtatcagtgcattgagaatgatttgttgtatccactgcgtacgcctcataatattgctccatacaaatccaagggccttgacagggcctcagagctcaatgtttgttgggattcttctgaacaaggtttgcaaccaattaactacagtcaagatgaacacaagagtcagcctggtttatctggttcatctatttttggaaagcggcaacttggctcaagttctaataacaatgggcggcctcacaagcgagaaagaaatgatgcccatggtggggttgccctttttgacctcaatgtgccagctgaagtggcagacaagatatgaaacttaaataacttacagcacattccgttgcaagtgtacagctgacccgggcttcttcagctacataaaggaaaactctgctcttttttgttgcgttagagtgtcgacatggcaagtttaaacggggggctataataccaacaatagggtagcgttcacttattctcttgtaaatcatgacaagaattggtggcaatgtgcaatgtgcacgttgcatagctcttataatgctaaatctacccctcgggcaagacgatggcattttggaagataaaattttgaaatgtccttttgcaaacatgcaaggtaatgtatgaagcatattggaagtgcctgcggatgcgtagcacctggaaattaatagaaacaaactaattgagtcgcg

SEQ ID NO: 6179 - DNA, 392 bp, Oryza sativa
  misc_feature (29)..(29): n is a, c, g, or t
  misc_feature (35)..(35): n is a, c, g, or t
  misc_feature (44)..(44): n is a, c, g, or t
  misc_feature (284)..(284): n is a, c, g, or t
  misc_feature (326)..(326): n is a, c, g, or t
  Predicted polypeptide sequence is orthologous to G1777
gggcccgggccggggtgcgggtcctggcncagccnccgagcccncgcctggatggccgggcccaggttctccgcctccgccgtgggcgagtcgccgtgggccgtgtgccggtcgtagtggtgcgcgtaccggagcaccttgcgcctcgccccgtccaccttcctcttgtccgccgcgtcgtcgtagcggttgcagcggtgcccgtcgatgctggtccagttgtgcgccagcccggtggccgcgccgcacagccagctgcaaacaacattcatgcatggtcgtcncatcaatggcgatcgaattgccaaggtgaattaagaatcttngaagtggatttttgtccctcagagggggcatcatctcgttttgtacatggcgtttataaggtaatt

SEQ ID NO: 6180 - DNA, 3376 bp, Oryza sativa
  Predicted polypeptide sequence is orthologous to G1784
gtccccccccccggctctctctcccttcactcggctcccagattcccacggcggcgaaccacacatctccgtcctctcccacggctgcgaccacccctcctttgctccgacgaccagcggcgcggatctggctgtacagcacgacctcggatcccacggcggcgactccccctcctctctgtcctctccgacgacggcgcaaggcggtgcaccatccctcctctcctcccacccccaccggcacggatcgggaggcggcgtggccggcgagcaccgtccgactcggatcgaggggcgactccctcccccttccggccggtagcgccacccccctccatctatcctcctcgtcggggcggcggctcgacgacggcgaggggagcgttgcttcgcttcggggcacggcctccccaaggcggtttggcccctctcccgcagaagccgagacggaaatagacgcaacagtccgattcggatcggagccggggggaacccggtgctatatatgccccaccaccgtcgaccgccgcagacccagggtcgtcaagtttgaaggcaacatgatgcagcaagacagcaagaggaagaggtccgtgctgccggagacggctacgttggccccgggaagcaagaggaggaggaggaaatctgtaccatcccgtcatgcggccgcgatgctacctgacgagttgctgacggaggtgtgcctgcggttgcccgtcaaatccatccttcgcttccgggctgcctgccgctcctgggacgcaatgctgtcttccgaggaatttggtcaactctacgcagcgagagccgaggagatgtcgtcagctcctaagctgctattcgtctcacctacggcaaatttcaactccaccgcggtgtacaagtgctcaccatcgaagcccaccgatgacctgctgctcacgcttgatgatgttcgcggaaactatgtggaggtgacacccgcaccatgccatggtctctccctcctgtatgatggtattgccccagcttactatgttatgaatgcaaccacacgggcagtcacacggttgccgcctttccgagatgtggcttttgccactgctggtcttgggtgcgatgcccggacgaagaagtacaaggtagtgaggctttttgaagggaacttgcttgagaaggaatttttgaagtgtgagatatacacacttgggggcgatgaaggggatatttggaggcctgccgctggtggagtacctttccggttctacagttttgctcgttctgctatttccaatgcggtgatgaacaaactgcagccacttttcttcaatggatatctgcactggttgatcaacccattgcatcacgttaaactaccaagagcttctattttatcattttctctcactgatgaaaccttcagatggatccgatcaccaccctttgtggcatctggagtgcatttggtggagcttgatggtaatctgtgtatggtccgagaccttcgtgataggtcaactgctgtttgcaagttggaaatttggaagcttaaggactataactctggtgattggtctttggatcatcgaattgatttaacagggcagttgcctagggatttacttgagccacagatagtgaaagttatcggttccgctggtagttgcagatcaggtacgaagataatcatcgccacatccaagcacaaagtttgttcctatgatcctgtttctagaactctggaaaccattacctcaatctcggagacctgcacatcctatcaaaatgagaaatctgatattagattcagtttatttaaagaatgccttaccccagtgcataaaacaagggaagagattgccttcgcaactcccttgtctaaggctactaaggagatcctactccgactcccggctgaatcagtcttgaagttcaaaccagtctgtaagcaatggcttgggctgataaagagtgaaagatttatccgtgcatactttgcacacaagaacatggacaagaggccaaaaatcatgcttgtgggtaagggctctggaaaatcacttttcaactttgttcccttaagtaaatggcttcaagaggcatccaatcaaggcacactgtttcttgacacaaaggtggtttgctccaagccttgccgtggattgaatttgatgagcttcgtggaggaggactatctgttcaacccgtgtacaggttaccacagggtctactggaacagagagtggcatcagcaccaaccatggaaaatgcctacgggttgccgtgaacaagaagacaatccttttgcagttggcaataagaatgttggtttggggttcagccaggtgattcaggatcatgttgttgtggggattttctatgaccggaaagactacaactctcgtgagtattctttaacatgttctctatggagctgtggttctggatacttcgagcaactcccgcagccacctctgcctgtgaatgacatgccacctgtctctgtggatggagtgctgtactggatgagcgaaccaaggttgggtcagagttatgaacgagccattgtgtcttttgacattgccgctaagatatttgaagtcatcccttgcccttcaagcattgcaatgtgggaccccagaagtcgctgccatgcatttgtggtggagcttctaggaaagttgtgtgctgttctttcaaattcagttgcagatgagttagatatatggaagtgggatcatggtctatggactagagcatacacaatcaatttaaaattctggccagattactcacttgcaacgaatgttgtagtgcctatggcagttgaccttacagatggaaggattctgctgaatactgggaggaagcttggtttatataatccatttgatcaaacaattgaaaacttgcttgcacttgatcaggtgtcacttgccacacctaaagtgcagcaacagcgcactggaggtcatcttaagtgccacattaccagatgcgaagatgttcctaggaagttttctccgtggaaactatctatggctccatgtgagaactttgctacacctccaagtgcctcatcagggaagaatctgttgtcctccagacaccaatatgtgaaggcactaaatagtgtgagcccaaaggttatgcctgtggttcctatgttgtatgaggagagcctaacttattatccctttgctgcccgagcgagagtgttgtttagttgaagtggtacctttgtcaaatctaccatttcatgtgtcagataggtcctccatgtttggccataccatgtcaccaagtttttataatgtaatattttgatgtttatgtcacgtagctgtcagaattatagttgtgttgcataatttatttgacttgtatttcaagc

SEQ ID NO: 6181 - DNA, 504 bp, Oryza sativa
  Predicted polypeptide sequence is orthologous to G1786
cagttttgctatactgagtatccaaaccacagtgtctggcaaaacatgtctgcagcagtctggtgggctgcaccacacaatgctgcacctgatgcaaggacacagtagacacgtggtgtgacaaggcacataagcgctaggcaaggctgacacgactgccctagccaagtgtttgggtggatgctgctactgtggatgcggaatgtctggctgcaaagctgcaaagctgctgattgggctgtttgaacgtggccaatgtctgaggatgatgcggtgatgctgacccctgagggtgactgatggtcgcaaccccagtgacccttgaccacccctgtggcaggtggtgctgtggtaatggagtgtgttgaaccagtgatgagtgggtgtgcaggaaagttgaaaaatgaagctgccagatatcatcagaggtgacatgtgaaactttgggggatataaaatagaaataaagttgtctttcatatgtaaaaaaaaaaaaaaaaaaaa

SEQ ID NO: 6182 - DNA, 462 bp, Oryza sativa
  Predicted polypeptide sequence is orthologous to G1786
tttttttctttttttttttttttttttttttttttttttcgacccaacccagtccccctcttcaaaactcaaagctttcaaaacctgaatactacagggattaccggattcaatcatgaatgaatctaccctgttcaattttcgatgcaaacctgccttacccctaccggtccctcaggcaaggaatttcatgcctccaaccctcaacaggctcataaacaaaaatcatgaacctgcccctcaacatgtcataacatcaggctaaaacaagcggaaaaatatgtaccaattgaaaccaattttgccgtcaaaccaccggcttttttccaaatgacaaccgcgaattctcaaatccctgaatgaacaactgcgtccccgttgcgggcaatggcaaccatggacctccaggtgccacaacttcctttaggagggcctttgcaattgggacaagggcttggtttg

SEQ ID NO: 6183 - DNA, 680 bp, Oryza sativa
  Predicted polypeptide sequence is orthologous to G1789, G1911
tttttttttttttttttttttttttttttttctagcaggcacaactttataatcactagcacacaagtacagaagtcttacatcactgatgtttactacataatttagctggaaggtttaacaaccacacacaatgccaaaggcaggctagtttctgcaaaatcgacactgatttgctttacaacctaaagtatgtacaaacaaggcttttcttcttttatttataaccaagcgaccacaatctttttaggcaataacaatatcaatatacttccttgattccttcagtaacttagccacagctagcagggaatataatttatatgggaatttttttcctgttgtcgggaacctcaaatgcttccacccctatcagttccatgctccctgggtattgtacttggggaacgggactcttcttgcctctatcagcttgaggtcgccctcgaggatctcataggggcggcacacctcatcggctgtcttggtgcctcccatggcgcgagacaccttgtgaaagaggtcaggcgcaccctcgccgtattaggcaagagcctcctcgaacagcttgttctcctttttgctcactctgagcccatgttgacactgttgctgttgcgggaggagctgtttgacctagaaaaatccttggattggactacggcttttctttggaagga

SEQ ID NO: 6184 - DNA, 598 bp, Oryza sativa
  Predicted polypeptide sequence is orthologous to G1789, G1911
aatatcaaaacacagcagagatcgatagatctcttctgaagtccaaaaaaaacttcagtctagctgcacactagttagcaagttacttagcgttcaacttccaaagaagacagtagctagctagtttaatcaaatccaagctgcaggatgtcttctgctgggtcacgtagctcgtcccgcaacagcaacatggcgtcagagtggagcaaagaggagaacaagctgttcgagcaggccattgcctactacggcgagggcgcgcctgatctctggcacaaggtgtcccgcgccatgaggggcaccaagacagccgacgaggtgcgcctccacttcgagatcctcgtggacgatatcaagctgattgaggcaaggcgagtcccgttccccaagtacaatacacagggagcatggaactgaccgactgaggggtggaagcatctgaggttccagcaaggaaataactccaatataaactatattccttcctgtggctagttgttgaaggaaagcatattgatatattgttactgtgttaagaagattgtggtcgattgcttggttataaataaaagaagaaagggattgtctgtatatactt

SEQ ID NO: 6185 - DNA, 282 bp, Oryza sativa
  Predicted polypeptide sequence is orthologous to G1789, G1911
atggcatccagctccaaggcctcgtcctcgtcgtcggcgtcggcggcgtcgtcggagtggacgaagcagcagaacaagcagttcgagcgcgccctggcggtgtacgacaccgacgccccggaccggtggcacaacgtcgcccgctacatgggcggcgccaagtccgccgaggaggtgcgccgccactacgagcggctccaggcggatgtcgagcagattgaggccggcggcgtgccgttctccttgggctacggcgccacgccacaggccggccgccgctag

SEQ ID NO: 6186 - DNA, 666 bp, Oryza sativa
  Predicted polypeptide sequence is orthologous to G1789, G1911
atggactcagagtggagcaaaaaggagaacaagctgttcgaggaggctcttgcctactacggcgagggcgcgcctgacctctttcacaaggtgtctcgcgccatgggaggcaccaagacagccgatgaggtgcgccgccactatgagatcctcgaggacgacctcaagctgatagaggcaagaagagtcccgttccccaatggtatgcacgatgcaccattttgtgattattggtttgcacataggctgcgcgacgaggccgcgggcgaccggcggtggcggtggcggtggcggtggcggtgcgccccttcacctgcggcggattcgcccttgccgggacgacttttgagccgcccaaccaccgagcgcccaaggcctgatgggcttatttctcccaacggcccatataccttcacgggccgtcctgcttcgctggaccaccggatgggtcacgtcgccggccccgctaaactcggtgacggcgacaaaagctcctcaaaggatgccatgggccggggtgctagcttgccgacaacactcctcgtccgatgggcagtgacatgtaccaccaccaccactcgcaggagaaatgatcaggcatacagtcgcggcgcgccgtatcggatccccgtggcgttggccattgccattgccatcctgggttaa

SEQ ID NO: 6187 - DNA, 919 bp, Oryza sativa
  misc_feature (919)..(919): n is a, c, g, or t
  Predicted polypeptide sequence is orthologous to G1789, G1911
atcggccatttggccgggggctgcaaacactcgataaccagttcagaaagagaattgctgtgtgagactcgatggcgtcgatgtcggtgagctcgtcgagggcgccgcagtggacggcgaggcagaacgagcagttcgagcgggcgctggcggtgtacgacagggacacgccggagcggtggcacaacatcgcgcgcgccgttgcggggaagtccgccgacgaggtgaagctctactacgacctgctcgtggaggacgtcaagcgcatcgagaccgggaaggtgcccttccccgcgtacaggtgccccccgcccgcgattgcaggctgaaagcacctcgatctgaacgactgcacctggagatctagctatgcggcatgaataatatcctagtctgcactctgtactacgttgatcaatcgatctcccgcgagcgtgcttatttgtaaatttatgcacgcgtgcaataatgtaattaatatatgtgtaatagcatatttgggggtaatgaatgacactcctaaagctattaagttgaagtgccaaaaaaacacgaccgagcacgcacacaacatgtcggacgtctcggaccaggcgagtctaactccaggcaagataatgctatgggacgacattcaactccctgggcaaacgccccatatgagcggcccaccaaccaggcgcgcgtacaaccgcgcgagggaaagtggccattcaattaccggatagtaccgtcagggtcacatagagacgaatctactacgaagctagtgaggagcgtaaccagtatacgtacagaacacagagacatactaacatgatgtcatttctttcttttttgccgcctctcattctcttctctctctccctcgtcatgatggctagcaatagagagaaggcaacaacaaaaggtaagacan

SEQ ID NO: 6188 - DNA, 577 bp, Oryza sativa
  Predicted polypeptide sequence is orthologous to G1789, G1911
cgtcgaagacacagcaagatctttacattagagctttcagtagtcagtgtcttaccaaggccactcttgaagatgtctgggtcccggagctcctcccccaactcgaagtctgagtggagcaggaaggagaacaagatgttcgaggaggcgctcgcctactacggcgaggacacgcccaaccggtgggacaaggtggccagcgccatgggaggcatcaagtccgctgaggagatccgctgccactacgaagacctcaccgatgacgtctagacgatcgagtccgggcgagtgcagttccccaagtacaagacgcagggatactggacctgaggatgaaccattggaagctccgatagacagaagatgaagttgtataaactagatccctaagaaagacttgctctaggaggaaccaaattaagtaatccagcattgcttagagaataaaggaagagaaggggtgtgtatgcatatagtattgggttatgagcaaggttaagtccccatgctgttgtagattctcgtctacattcgtcaactgcagtattcattaactctgtgaactaaattatgaagt

SEQ ID NO: 6189 - DNA, 1289 bp, Oryza sativa
  Predicted polypeptide sequence is orthologous to G1793
aatatgaccaggcaggagtatattgcatacctaagaaggaatagcagtggattttctcgtggtgcatcgaaatatcgtggtgtaaccaggcaccatcagcatgggagatggcaagcaaggatagggagggttgcaggaaacaaggacctctacttaggcaccttcagcaccgaggaggaggcggcggaggcgtacgacatcgcggcgatcaagttccgggggctcaacgccgtcaccaactttgacatgagccgctacgacgtcaagagcatcctggagagcagcacgctgccggtgggcggcgcggcgaggcggctgaaggaggcggcggaccacgcggaggcggccggcgccaccatctggcgcgccgccgacatggacggcgccggcgtcatctccggcctggccgacgtcgggatgggcgcctacgccgcctcgtaccaccaccaccaccaccacggctggccgaccatcgcgttccagcagccgccgccgctcgccgtgcactacccgtacggccaggcgccggcggcgccgtcgcgcgggtggtgcaagcccgagcaggacgccgccgtcgctgccgccgcgcacagcctccaggacctccagcagctgcacctcggcagcgccgccgcccacaacttcttccaggcgtcgtcgagctcgacggtctacaacggcggcggcggcgggtaccagggcctcggtggcaacgccttcttgatgccggcgagcaccgtcgtggccgaccaggggcacagcagcacggccaccaaccatggaaacacctgcagctacggcaacgaggagcaggggaagctcatcgggtacgacgccatggcgatggcgagcggcgccgccggcggcgggtaccagctgtcgcagggctcggcgtcgacggtgagcatcgcgagggcgaacggctactcggccaactggagctcgcctttcaatggcgccatgggatgatcgatgaagaggagcaacaggagctagtatagctaattaggggatcgatcgattaattaagctagatcaagtcaagtttaggttagacgaatcttgatcacggttgtgttgcaactcgtttggtcgttgatcaggttttgcttgactgggtgtgagtgacacacacgcaaggtgctgccttccggaagctgggtaatggcaggtaagggtataagctagtaaagtttgtgttgtaacttctaagttaatatccttgcttgctgttagttttgggtatagtttcagaaggatcatgccaatcctcagaggagatacacact

SEQ ID NO: 6190 - DNA, 966 bp, Oryza sativa
  Predicted polypeptide sequence is orthologous to G1793
atgaagctgcagggggcccatgcagctcgtcgcatccgagtcctctccaagctccgtcttctagggtttgcgccgcgacgagctctcgaagatttcgccgaggagaaatccaagaagaagaagattcacctcgcggcgatggccaccgtgcaacccgccgcctcggaccccgcgcctcctcctcctccggagacggaggagcagccggccgcggcggggggcgaggagatcgcggcgctcgacgagcagctggccgtcgcggacggcggcggggatgatgggaaagcggctgcggcggcggagggaggaggaggaggaggaggagggaagctggtggcggagaccatgcgcaagtacgccgcgccgcggtcgtcgcggtaccacggcgtcacgaggttgaagtggagcggcaagttcgaggcgcacctctgggacaacagcagccaggtcgagggccgcaagcgcaaggggaagcatggaagctatgttactgaagagaatgctgcaagggcacatgaccttgcagcccttaaatattggggtgcagggccaaacaccaaacttaacttcaatgtttctgattatgagaaagaaatcgagaggatgaagaccatgtcccaagatgaatttgtggtgtacataagaaggcagagcagctgtttctcaagaggaacttcatcatataggggtgtaacaaggcgaaaggatggtagatggcaagcacggattggtaggattggagaaagtagagacaccaaagacatctatcttggtacctttgaaacggagatagaggcagctgaagcttatgacctagctgccatcgagcttcgtggtgcccatgctgtgaccaactttgatattagtaactactgtgaagatggtttgaaaaaattagaagcctcatcagaggttccaaagctactagagggtccatcgaaggctgcgaagctcgctggacgatag

SEQ ID NO: 6191 - DNA, 837 bp, Oryza sativa
  Predicted polypeptide sequence is orthologous to G1793
atggccaccgtgcaacccgccgcctcggaccccgcgcctcctcctcctccggagacggaggagcagccggccgcggcggggggcgaggagatcgcggcgctcgacgagcagctggccgtcgcggacggcggcggggatgatgggaaagcggctgcggcggcggagggaggaggaggaggaggaggagggaagctggtggcggagaccatgcgcaagtacgccgcgccgcggtcgtcgcggtaccacggcgtcacgaggttgaagtggagcggcaagttcgaggcgcacctctgggacaacagcagccaggtcgagggccgcaagcgcaaggggaagcatgtgtacctaggaagctatgttactgaagagaatgctgcaagggcacatgaccttgcagcccttaaatattggggtgcagggccaaacaccaaacttaacttcaatgtttctgattatgagaaagaaatcgagaggatgaagaccatgtcccaagatgaatttgtggtgtacataagaaggcagagcagctgtttctcaagaggaacttcatcatataggggtgtaacaaggcgaaaggatggtagatggcaagcacggattggtaggattggagaaagtagagacaccaaagacatctatcttggtacctttgaaacggagatagaggcagctgaagcttatgacctagctgccatcgagcttcgtggtgcccatgctgtgaccaactttgatattagtaactactgtgaagatggtttgaaaaaattagaagcctcatcagaggttccaaagctactagagggtccatcgaaggctgcgaagctcgctggacgatag

SEQ ID NO: 6192 - DNA, 1104 bp, Oryza sativa
  Predicted polypeptide sequence is orthologous to G1793
atggagagctctttgaaagaggagaaggctgcgggcgaatcaggggatgatgagaaggcggagaggagctcccctatcaatctgaattcgttgccagcaactgcggcgtgtgcggcgaccgccccggatgaggatggcttgcactctgcagtggagtcaggagctaaggattcgaacaccacgaagggagttgagtctcttggtactggtcacaagaagatcccgaaacgtgaggtagttgatgaagttgatgttcagacctgtgccgaaggaaagaacgattcagtggtcccttcaagcagcaagaaccctatcaatgataagaatgcaaaggcaaatgtggcagagaatggacagtctgctgatggtatccctgaggatcagagagttactattcttagtgttgtcaagaaggatgagcctgctgatgatgttagagattcagttaatcctgtaacagtcgtaggttatagagatgagaagggtggaactagtggtactgctggaactacggctgtgcgacctgcaggcacccggtcatctagtttccatggtgtgaccaggcatagatggagtggaaaatatgaagctcatctgtgggacagttcgtgcagaatggaagggcggagaagaaagggaaggcaagtttatttaggaagttatgataccgaggaaaaagctgccaggtcatatgatgttgcagctcttaaatactggggccaaaatacaaagctgaatttctcggtttcagaatacgaaagggaactggaggacataagggacatgtctcgagaggaatgcgtaacatacctaagaagaagaagtagctgcttctcaagaggggcttctatttatagaggagttactagaaggcagaaagatgggaggtggcaggcacgcataggactggttgctggaacaagagacatttacctgggaactttcaaaactgaggaagaagcagcggaggcttacgacattgctgctattgagatccgtggcaaaaatgcggtgaccaactttgatcgaagcaactacatggagaagggtatgcactgtatagaaggggcaggcttgaagctgcttgcgtctaagccagaatga

SEQ ID NO: 6193 - DNA, 992 bp, Oryza sativa
  Predicted polypeptide sequence is orthologous to G1794
atgccctcagcaagatcaagtgcacgttcgatctcgacgtcgccacgcgaaatcccactggacggacagcgttcttgaatataatcttgatcgatgcggccgccggcaatggcggcgctcttcgaggccgcggagacggcggccatcgtggctgcgctgacgcgcgtcattgccgacggcgggcgtggaggcggcggcggcgtctgcgtgccgccgcccgcgccgtcgttggtcgtgccgccgcgggcgggaacaggcggcgggcggcgcgtcgacgttgcgcgggaggaggagatgcgggagatcacgccggcggggcaaacgtggccgaggcggcggcggcggtggtggtggcggcgccggcgacagcgcgcaggtaccgcggggtgaggcggcgaccgtggggcaagtgggcggcggagatcagggacccgaggaaggcggcgcgcgtctggctgggcaccttccgcaccgccgaggacgcggcgcgcgcctacgacgccgccgcgctacgcttccgcgggcgccgcgccaagctcaacttccccgaggaggtgtcccgcccgtggcagggtcacgatgtcgatcacatgtcctgctcgccgccgtcgatctcgaacgctcgctttctgggttcgtggaccttcggaccgccgcagccgccatcgcggtccgtcgcggcggcggcgacgactctgcttggtgggagccatggaggcaacggagcagagaacgggagggaatagcgcgcgagacaaaaagggctggagagatgggaatcgtcgtcccgggtactcctagtccacagaacttgaattagactcgcatttcgttttttttcggcatagtagtatttattttgttttaagttggtggtgtagccttttcttttcttcttcttttcgttcttcttggataatgctgctgcattttgttcgatattatcggtagtactgtttggtgatgttttaatatatttctaaataaaagtt

SEQ ID NO: 6194 - DNA, 1521 bp, Oryza sativa
  Predicted polypeptide sequence is orthologous to G1794
aacggaagcttagctgagttgggtttggtctcgccgctggccggagtagagcggtccatgtgctgtaccggcgacgaggtggcgggacccggagagcagcggcggcggccgctcgacgccgacgccggcggcgacaagggcgcggtggcgacgacgtcgtcgtcgttgttggcggcgccgatgctgtcgcggcggaggcaggcggaggagatggcggcgatggtgtcggcgctggcgagtgtcgtggccggcggcggcggcacgtcgttgccggcgaagaggccagccgagagagagcccgaggagggcgccgccgtggagggggtgtggtggtcgtactgcagtgagctcgccgccgccgccgccgcgccgtcgccggcggctccatttccggccggtacgctacgtgccatcgccggggcaacactcgcctgcgtcggcggcggccggcgacgaggaggagctcccgtcgccgtcctcggccgactccagcggcggcacggcgaggaagcggtacagaggggtgcggcagcggccgtgggggaagtgggcggcggagatccgggacccgcacaaggcggcgcgcgtgtggctcggcaccttcgacaccgccgaggacgccgcccgcgcctacgacggcgccgccctccgcttccgcggcagccgcgccaagctcaacttccccgagcacgccaccctcccaccgccgccgacgacgacgacggccgccgctcaccggtgcccgccaccgccgcggacggacgcgctgctggagtcgcaggagctctctcccggcgccggcggcggtgacccgtactctcagtacgcgaggttcttgcagggctccggcggcgacggtggcgaggcggcggcgcggcccggcggtggcgcctcgcaaagaacgccacccgccactacactgctctacagcttcgagggagacgctgcttccgccgcctgcctctggcagccggagagcggcggcggcgggatggggtggccggcgacttcgccggcggcgtggttggagtacggtttctacccgccgccggagcggcgcgacacggacacgtagggttaatcacgatgtgatcctgagcggaataggcggtgacgctgacaggtggggcctacttttgccaggtgcggtcaacggtcaacctgaagttgacgtggcatgccacgtaatgcggcggtcaacgggttcagacggaagtgggtcatggacggcacgagacgccgtcagaaataaatgctcgaaactgacacgatggattacattgttcgtcaaattctcagagggccacatagttgcaggagggggaattattattcagcattgtttttttcgtaaaattcatcgctccaaaaacatcacacatctcaagcttgtacgaatgaaactagtgcagtctgaagattttctttttctggttttatagaacaaaagatttttgaagaaacccaatcctatgaaaaaaaatttcttatatgaaaggaatgggcatccaaaattcctgt

SEQ ID NO: 6195 - DNA, 1161 bp, Oryza sativa
  Predicted polypeptide sequence is orthologous to G1794
atgtgcttcgacctggcagaccaacgtggaccacgcggcggcggcggcaggccggtgaagggcggcggcgacgggcgtgcggcggcggcggcggcggcgacggcaatgacggtggcgggggcgtcggagctcatgtcggggtattaccaggcgcaggagatgtcgacgatggtgtcggcgctggcgcgcgtcgtggcgggcggcggcggcggcggcggcgacggcgacggcgaccagtgggcgtggtcgtcgccgtcgccgtcgtcgtcagcggcggcggcggcggcgcgtggcgtgcaggagaggaggcgggaggagcaggcaatgcacgagctggcgggatacgcctgcgggggcgcgccatcgccggagttcgcaggatcggagcagagctcggacacccagagcgcgagcgcggcgaccatggacgagcaccactcgccggtgggcggcggcgggaacgcggaggggcccgacacgccgcggcggcggtaccgcggggtgcggcagcggccgtgggggaagtgggcggcggagatccgggacccgcacaaggcggcgcgggtgtggctcggcacgttcgagacggcggaggccgcggcgcgggcctacgacgaggccgcgctccggttccgcggcagccgcgccaagctcaacttccccgaggacgcgcgcctctacccgaccgccgccaccaccaccaccgcggcgccgcccccggcgccggtcgcggcggcatcgccttccgcggccatctaccccggcgcctcccagagcgccgagtacctgcgctaccagatgcttctgcaggggaggcttaccaccgccacccccaaccaaggcacccttcttccgttctacggcggcggcggcggcggtggctccatgaccaatccctacggaggcggtggcggcggcgccatgagcggcttcctcggctcctactactctttccctaccccctctgtttccgtggccaccgtcccctcctccacctcctccgcgccgggcaactactactcgtcccacggcggctcgcaccagagcatgtcggcggcggaggagtggaactgggagaacgccctggtctacccggcgacggcggcgtcatggtcggagtcgagctatcaccaccacccgccgccgccgcacacgcagtag

SEQ ID NO: 6196 - DNA, 651 bp, Oryza sativa
  Predicted polypeptide sequence is orthologous to G1794
atggcggcgctcttcgaggccgcggagacggcggccatcgtggctgcgctgacgcgcgtcattgccgacggcgggcgtggaggcagcggcgccggcgtgccgccgcccgcgccatcgttggtggtgccgccgctggcgggaacgggcggcgggcggcgcgtcgacgttgcgcgggaggaggagatggtcggcgtcgtctccgcgggagatcacaccggcgaggcaagcgtggccgcggcgggggtggtggtggcggcgccggcgacagcgcgcaggtaccgcggggtgaggcggcggccgtggggcaagtgggcggcggagatcagggacccgaggaaggcggcgcgcgtctggctgggcaccttccgcaccaccgaggacgcggcgcgcgcctacgacgccgccgtgctccgcttccgcgggcgccgcgccaagctcaacttccccgaggaggcgtcccgcccgcgccgcccgtggaagggtcacgacgtcgatcacatgtcctgctcgccaccatcgatcgcgaacgctcgctttctgggttcgtggatcttcggacctccgccgccgtcgcggtccgtcgcggcggcgacaacgactctgcttggtgggagccatggaagcaacggagcagataatgggagggaatag

SEQ ID NO: 6197 - DNA, 2174 bp, Oryza sativa
  Predicted polypeptide sequence is orthologous to G1796
gaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaaccccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgccaatggctatgcaaataagggcagcaatgggaaagtgcaactccaaatgatccctcactgatcaaaatgtcacatatctaatgctactaccatcgatgttgtgttctgactaatattagtgctggcatccttttttatttgtttatattttatctgaataagagatgacttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtaaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgcc

SEQ ID NO: 6198 - DNA, 1251 bp, Oryza sativa
  Predicted polypeptide sequence is orthologous to G1804
ggtttccatgaacatggacgagtttgtggctaacatatggaatgctgaagaattccaggctaccaccggaggttgcaagggtgccatggaggaagccaaggtggtagacagtggaagcggaagcggtggtgcaggaggaagcggtttatgtcggcagggatcattttccttgccgctaccgctgtgccagaagacggtggaggaggtgtggactgagatcaaccaagcccctgcacacacctccgctccggcctccgcgctccagccacatgccgggagcggtggtgttgcagctaacgaccgacaggtaacactaggtgagatgacacttgaggatttcttggtaaaggccggggtggtccgagggtcctttaccgggcaagcggccatgggatctggcatggtcaacgggccggtgaaccccatgcagcagggccaaggcggtcctatgatgttcccagtaggaccggtaaacgccatgtatccggtgatgggtgatggcatggggtaccccggtgggtacaacgggatggcgattgtgccaccgccacctcccgcccaaggtgccatggttgtcgtgagtcctggatcatcagatgggatgagtgccatgacacatgctgatatgatgaattgtattgggaatgggatgatgattgagaatggaacaagaaagcgtccccacagagaggatggctgcgccgagaagacggtggagcgccgccaacggcgcatgatcaagaaccgtgagtcagctgcacggtcccgtgctagaaagcaggcttatacggtggagctcgaagctgaactgaactatctcaagcaggagaacgctcgtctcaaagaggcagagaagacggttctactgacaaagaagcaaatgctggttgagaaaatgatggagcagtccaaggagaagatgaatgcaaataggggtggcagccagctgcgccgcagcggcagctgcatgtggtgaaacgggcatagcggtgaccggcgagtggcacactcatcctgcttctggtgtggcactagcctctgaggctctgaagaggatttgcacattaagtcttctttcagactaagtgatgtgaaggtattatggtagtagttgatatacatatatgctgtgatgcttgtaaacctgcctggacccacatgtcttgccatcgtgttcaccggtccttgctgcttatatggttacatgtcgctgtttgtacaaaacaacgatgaataaaattatacaatagt

SEQ ID NO: 6199 - DNA, 1416 bp, Oryza sativa
  Predicted polypeptide sequence is orthologous to G1823
atgagcgcaccgccgccgccgccagacgccggcggccgtcgccggccgccgccgatgacgacgctcgcgccgccgcacgggctggtggtcgtcggagacgacgccgtgcggcgcgccgtggtggcgaggcttggagtgaacttccgagcgacggtttgctcggagatcaacgccgccgtggagatgctgcgtgagagaatgaaagaattcgatttcgtggtgatttcagaagagttgatcattagaagctcaaggccagagatcatgaaatttttacgcgagacagggctgaggctactcgaggaagaaggacaactactcgaccccgtcgtcgtcgggcgatctgccacggtcaacagagagattccacaggcggcgtcgtcgtcgtcgtcgtcgtcgtctaggctgcaggcggcatcaccgcacggtgacagcagcaacggcgccccggcgacgacgaccatggcggcaacggcggcggtggcggcgatagcctcgtcggtgaaaagggcgaccaacaaccggaggaaacaacggcgcgccaaagtgcaatctggccgccagcatcggcagaggaagcggaggctcgtctggacagacgagctgcagaagatgttcagggaagcatttaaccagctctcgctgacacaaaatttgaattcttatcactctgttttgataataaagatccaagaggactatgaaaaaaatacccggtgcccacaaaaatactttaagttgatgaaattgatgattgatccgatgaatgatttaagtctaacccgagataacattgctagttatctccagaagcataagaaacgtcttcaaaaagaatatcagaaacatcagaatcttcttgaacaaaaagaccaacagttacctattgttgacaataccaataccagttctatccaacaaaaaaatatgcattatgaatcctgctacaatgaacatagtaacaagcaacccaagttgaaggaacccacgttgttgacagctaattatcatgggcttagaaacatgcatcatcatcacaaaaacatcatcaacatggaaccttccaatgtactgcggcctcctaacttgaacaatgcaaagggctttaatatgcccttcaacaaggaaggagtcgatgaagccatatatcagagccaactaatggcacatcaagtttatgcaaatcatgttgatgcaacagcacaaaccacctgggaagtaacgatgacgcaagatatgcgccccatatctcaagtacatcaacatggttgtgaaacaacacctgtcgattcctctaataatacaaatggcatatctgaaaatgttgaaacctttaagagagtttctattacatctaagagagatattgcttatgtgaactcaagtcgtaccatccggtttagtttatttgaataa

SEQ ID NO: 6200 - DNA, 1131 bp, Oryza sativa
  Predicted polypeptide sequence is orthologous to G1823
atggtaattgatgaagataaatgccatgctgattctacaagctacatgctttctgcagaactcaacttttctgtcactgtatttacaagccccataaaagcactagactttcttcagaatcatgcagaaggtgttgatttggtgctggcagatgtccacatggaagagatgaatggttttgatttccttaaagttgcaagagagcttcataaatccattcaagtgattatgatgtcaactgaaacgacaatgtacacaatgaagaggtgcgtcaaacttggagctcaatttttggtcaataagccccttgatgctggaaccattaagaatttgtggcaatatgttgacttgaaagttctaagaatggagaagatcaaggacttgcttcaaggtattggagatgaaagcacttgtgccaatgaaacgaattctcttgctgaaaacccgaagaatgatactaagaagaaatattatctcatgtggactccacatctacagaaaaagtttttacatgctcttcaaatacttggaaaagatgcttcaccaaaaaatataaagaagatcatgggtgtggacaacattgattgtaggcaaattgctgctcatctgcagaaacatcgactacggctaacaaaggatttgaagaaagcatcatttacaacggataccagcaaggatgaatcaaattctagaatagggcctgcagagagtcatcacgtgtgccgcaacgcaagtacactgcagcctcgttccaacactcaacctacagaaacaaccatgcaaatcctctctgaagacgctgaatatgacgatgtttacgccgcgatgcgaagagccttacagtatgggattgtctttgatgagtccaagcattccagtgatccttctggtgatgaggatgaacaagttgtggtaggaggagatcaagatggatgtgccaatgaagccaatgacatagactcatctggtgatcatcatcaggttgctgctgttgtcactaaaccatgcaacgcaaatgcttcacaagagataatcaacaagatgactaattctgatggtatgcaagccaccaaaggaagcaaggcagcagttttccgccttgtggattattcagaatccgatagcgattag

SEQ ID NO: 6201 - DNA, 1706 bp, Oryza sativa
  Predicted polypeptide sequence is orthologous to G1832
ccacagccaccgagcggattagtggaacaaaccctagcctgagtagattcttcctctagctttcgcgagccgtatcgtatccattggatggagccctagagcaacaagaagaagccaagaatatttgcgccatggagggtggtaattccagcaagggcgccatggagggtggtcaccgctgccgccgcccaaacgtcgacgacgatgaccagatcgaggagggagagatctgctacgactgccacgtctcgggctccgagaccgacgacgacgagcaccacagacgcgccgtgctccctccccgcgacaatggcgatggctgcgcggagcacaaacggtgccgcctcgacaatgctgctacggcgcccgcaccctctgccgggccggtgctgaccaccagcaacggaagcgccatcgtcgccatcgcctccgctgccgccgccgcagcagctgcggcgtcgacaatggcgcgggaggtgttcgcgtgccgcatctgccggaaggagttcgacacccggaaggccgtggacgggcacatgagagttcaccgtcagcaatccattgccacccccaagtataatgccgcagacaactctcgtgtcactgtggtcgctgagcccagaaccgatcttgatctttccggtccacacgggagcagcagcgcgccgccgtcgccaccagcgccggccaatcctcccaatcataatcaggccgtcggtcaccaaccagcggctgccgcgccgaacgccggcgtcgtcgtcgtcgtcgaaggggcgccgcaaaaaagtctaccatacatgtgcaagatgcagggctgcggcagggcgttccccacgcaccaggggctaggtggccacgctgccggccaccagaacaggagcaaggcagcggcggcggcggcctccgagcagggcagcagcggagcgggggccgacgggtgccacggcggcgccgacagcagcaagcatcggtgcagagaatgcggcatggagtggaagacaggtttcgcgctcggcggccacatgaggaagcaccaaactaaggagacggtgaccgtgaacgagaaggagccgaatgtcgctggcaagcacatctctcttggaccaccacctttgccggaccttactccggccgccgctgaggtaacttcgtcggaaccacttgatcagccaccactactgtcaatggtggtgggtgcagaagttgcagcaccggcgctgcttgcgctggccaacgaggcagcggcattgccgccacaggatgatcaggcagaggaagaggcggctgcagaagccgctgcaccggccgaggcagcggcattgcgaccggttgaggcaggggcagaggcggccgatgttggagcagcaccagaggagccgctgctggcgcctattgccggcatgggaaccgtgcgtattttcggttttttggttgagaagccggcacctggagacggcagtggaggagagggttcagcgcctgcatagatcgtcctagttatgatatttgattttgtgattttctttagctatcttcagagccattaggatacttgatttagaggctttctttattatgttcaccgcatagtagttaagataatttttgcttttcgatagcagaagtgttttcttcgttgtactagctagttggccgggttttcgaggttaaagactataagaaacttacagttatatatggtgtgc

SEQ ID NO: 6202 - DNA, 859 bp, Oryza sativa
  Predicted polypeptide sequence is orthologous to G1832
atccatcaggtcttccacatacattttgctgtctcgccaccggagacaggtagtatagctatggccggtcaggtgttcgtccatcacctcggcggcggctccggcggcgacgaccccacccacccatggctgtccctcaagtcgtcccatgagatggacgacgccgtggcgagctggcgcgagaagctggcggacatggccgccgccgacgaacgcgccggcaggtacccgtgcccgctgtgcgaccgccacttccccacggagaaggccgtgcacgggcacatgcgcagccacccggggcgcggctggcgcggcatggagccgccccgcgagccgtcccccggcgacctcgccctcgccgccgacgggaagcggtaccgctacgtgtgcgaccgatgcaaggcgccgttcgagacgcggcaggcgctgggtgggcaccgtgccagccacagcaccaagaagggctgctcctggcacgccaagcagctcgccatggccaagccgcccaagaacgacttcgacctcaaccatctctcacttgaggccatccaggcggcggcgcaagaggaacaagctgctcaagaggggaacaaggatgaggagcctaagaattaattaattaggaataattgaacttgcttagggttcgttcggtcggtcgatcgatcgacttcttgtgcttgcgttgcgtcggtctgggcttgtgttggttcgtagctagccaactccatggctcatgcagcatatgcacatatgtctctttctcttctttttcttttttagtttttgtttctctttgattttttgtaagctcgatcgatcgacaagaaaaataaacaaatattgcaacctggatgat

SEQ ID NO: 6203 - DNA, 432 bp, Oryza sativa
  Predicted polypeptide sequence is orthologous to G1832
aggggttatggttctcctgcctttgggcatggaaagctacttgatctatctatgcaagagaattctaggctggagaggaatagttcccgctgacgggatgacctcttgaaagtaatgcgccttcgtgccgatgatatgctggatgaactagacggaatcgcagttgcatgaggatatgtcctgaatcacctgctttgacatccaagatgatgtgcttgaacctaccgtagagccggctacgagtaggaaggtgccctcgggggaaggagctcgagaggctctccgttgatgcgagtggacatggcgggtattctaggaggagtccagcgcgacagcaattgtagatagtttagctcagcacgtcctgtgctccagtaggagacttttcggggcctttggccccccggacgaaaagtatacataacataacat

SEQ ID NO: 6204 - DNA, 200 bp, Oryza sativa
  Predicted polypeptide sequence is orthologous to G1837
tttttttttttttttttttttttttttttttttttttttggccgaaagaccgaatgatattatgaaaatggtaaatgaacttgaactggtccagaaaggataaataggaggaggggagcccgcccgaaggtggaaagcggcggccccccaaaccccaaattcctttcattttccctttttttttcccccatcccaccccc

SEQ ID NO: 6205 - DNA, 178 bp, Oryza sativa
  Predicted polypeptide sequence is orthologous to G1837
ttttttttttttttttttttttttttttttttttttttttggtttaaaacccgcaatatcagtttcgggtgcaacaaaaacttggtggggcttccctggtcgggatgctaaataccggtacccaggggtaccagacaaaaaatgggattttctactccttcaatccatgtcaagggcc

SEQ ID NO: 6206 - DNA, 417 bp, Oryza sativa
  misc_feature (56)..(56): n is a, c, g, or t
  misc_feature (114)..(114): n is a, c, g, or t
  Predicted polypeptide sequence is orthologous to G1837
aaacccttcgccaactggttttcgggcctttttttttggcttttatgcaaggatcntaccccctttttacagtgagagtttccattatactggcctgccatccccccaatgaancaggtccttatgaggttgtgtgcaccctaaatttacctgggtattaaaatagttgcatcctcatggcttcatgagtagctgtgcatcccattgctaaattttgttgctagatggttgcatatttgattatatgtttttatatttattgatattttgatgtttaggaagttttttaccattggagtgggtttatttattaaacaaatgtgattttgcatttgatttgcatcccgagcaaaatgttcttgatgttttgcaaaaaaaaaaaaaaaaaaaaaaaaaaaaaaaaaaaaaaaaaaaaag

SEQ ID NO: 6207 - DNA, 1660 bp, Oryza sativa
  Predicted polypeptide sequence is orthologous to G1838
agtctcctttcgtttttttttcctccactcctccgcctcttcttccgccgccgcgacgcgccgttgataggtctacgacgatgtcgccgccgacgaacggcgccatctcgctcgcgttcccgcccatggggccgctgccggcggacgcgctgatctacccgttcgacggcctctcctacgacgacttcgtcctccctgtcgccgccgcaccgcagcatccgctccccgtcgccgtcgccgaccccgcgcccctcctcctcctgccgccgccgtcctcctgcacctgcaacggcgccagcagcggcatgggcgccgttgcgccgcgcacgttggctctgggcgccaccaccgacggcagcgtgatgacccccaccagctggggcagcgacggcggcggcggcggctcctcctccgcgcgggccgtgcgctcgccgtcgccggtgctgccgctggtgcagggcaccggccagaggacctcctgctaccgcggcgtgaccaggcacaggtggacggggcgatacgaggcgcacctgtgggacaacacgtgccggcgagaaggccagaagcgcaagggccgccaagtttacttgggtggctatgacatagaagataaggctgctagggcatatgaccttgctgctctgaaatattggggtgctaatgctaccactaacttccctaaagaaagttacgtgaaagagattgaggagatgcaaaagatgagcaagcaggagcttgtagcctcactaaggaggaagagcagtggcttttctagaggtgcatcgatctacagaggtgtaacaggcaccaccaacatggccgctggcaggcaagaattggtcgtgttgcaggcaacaaggacttgtatctcggcacctttgcgaccgaagaagaagcagcggaggcgtatgacgttgcagcgctgaagttcaggggcgccaacgccgtcaccaacttcgagccaagccggtacaacctggaagcgatctctcagagcgacctcccgatcagcgtgtccgggaggcggcacaacagcagcagcaacagcaacaatccagcaccagaagcaggaggccaaatcactctgatgagcagcccgccgatctcccagcagtcgagcagcgcgccaccgtatctcatccacaacctcctgcagttccagccatgtggtcccccatacgcaccaccaccaccaccaccaccaccaccaccaccacaggctcttccgctgccaggatcgtacaactttgcagagccagtaggcttctactggccctacggcgatggggaggagcagaaggttcagctcaacagcaacatggttggaatggctagtggtggctttcttcatctggccaatgctgccaactgatcccagcgtctgcaattgctggtgttgtgtggttcttgtggagattccgagggagtgagattttgggtggatataggaagggggtcttttggcttttgctgctgccatggactaacaacctgaacatagataacagctggagtagtgaacttgactatgctcgttacaacaacagtgggtctaagctcaaaatgagcttgtggtatgccccagatatgcttagttgttaattaatggtttattttgaacaaaagtggttcatactttctaccatgttgtatccttttt

SEQ ID NO: 6208 - DNA, 1189 bp, Oryza sativa
  misc_feature (551)..(551): n is a, c, g, or t
  Predicted polypeptide sequence is orthologous to G1841
gtcgccggcgacgtacggacggcggcggcggccgtgatttcatgtgcggtggtggcaaggtggcgagcccgccgggaccacgactgccgcggctcgccggcgccggcggcgaggaagaagaggaggaggcggcggctggaatgctgtcgaggcatggacaggcgagggagatgtctgtgatggtgtccgcgctggcgagggtggtcgccggcggcggcggcggcgaggcggaggagtggtggccgccggcgtacggcgcggcgccgctgccaccgtctacttcccctgcatctcacgagcacgcagcagccatggcggcagggcagtacgcgccggcgacgtcgtcggcgatggcgtcaccgcgcgagcaggcctcctcgccgtcgtccggcgacgccgccggcggcggcggcggcggcggcaggaagcggtaccgcggcgtgcggcagcggccgtgggggaagtgggcggcggagatccgcgacccggtgaaggcggcgcgcgtgtggctcggcaccttcgacaccgccgaggccgccgcgcgcgcctangacgacgccgccctccgcttccgcggctgccgcgccaagctcaacttccccgaggacgccgcgctcctgccgcctccgcctccgcctcctgcgccggcgccggcgccgccgcagtcgcaggggatggtcggcgtcggcgaggagtactccgagtacgccaggttcttgcagggcgccggcgagccgccgcatttcctcgagcagataatggaggactcgcctcggccatcgacggcggccggcgcgtcgtcgtcgtcgtcggggcagtcgtcgtttccgttgttctacagcttcgctggacatgagcttggcggcaacgaagcgaaccttgcccgcccgccggagagcggcggcgctggtggtgacggtgggaggggctcctcgccgccggtgacttggccgggctatgggtggggtgcgccgccgccgtgggacccatcgagatagcgcgcgaacgaaggatgggtttggagtttggactatctccactctccacgtgtagccactgtagcaccgccacgtcttttgccaatttaaatttcccgccggaaattctctacacgttcgttgattcatcttgatttgtactcctacttaagttaaaattttgttaaattagaacaaaaaaaaaaaaaaaa

SEQ ID NO: 6209 - DNA, 735 bp, Oryza sativa
  Predicted polypeptide sequence is orthologous to G1841
atggcgttgtcggagccggacctcgcggcggagacggaggcgatcgtgtcggcgctcacgcacgtcgtcgcgtacggcggcggcggcccgccgccgagcgaggagaccgccgcgtccgcggtgacaaggacagcgccgtggcgcgcggacggcgcgcggcagggggcggtgccggcggcgaggaagtacaggggggtgaggcggcggccgtgggggaagtgggcggcggagatcagggacccgcacagggcggcgcgggtgtggctcgggacgttcgccaccgccgaggacgcggcgcgcgcctacgacgccgcggcgctccgcttccgcggggggcgcgccaggctcaacttccccgaggacgccgccgcggccgacgagcgacgcgccacggacgccgcggccgccgcggcggcggcgtcgtcggcgcccgccgcgctgctggagtcgcagccgggcgacgtcgcggactgcctcgactactccaggatcctggcgggggcgccggagcggccgacgagctccaccgtcccggacgggttcttcggcggcggcgggaacggccgcttcttgcactcgtggagcattggcacgtcgccgtcgccgtcgggctcgggctcgggcggagccggcggtggcggtggcggtggcggtggcggcgcccctgttcgtcctctgtttcatggcggtaacggctgggagcaacgcggtgacagtgcatacaacggtttctag

SEQ ID NO: 6210 - DNA, 1559 bp, Oryza sativa
  Predicted polypeptide sequence is orthologous to G1863, G2334
aagctgaaagattttacttgcgtcagctccggctaccgtggtcaatgtgcacaatatttcatttggtcctcacctcagccctgtaggcatgcaggcagcaggccttcagttactgcatcccttcggaatcgttaaatgaacagtattcaagcagccgcaggagtatgtgtccggtgtcccactgacaccgataagcagcgacaacgtcgacactcaacatatcccatcccttccttatcccaacgacctgcacgctgcattttcatcactagcatcagtgtattcaaacctgcagcttacactgaagagtgaagactgaactccacagatatgttggccgagggaaggcaagtctacttgccgccgccgccgccgtccaagcttcctcgtctctccggcaccgatccaaccgacggcgtggtgacgatggcagcgccgtcgccgctggttcttgggctgggtctcggtctgggcggcagcggcagcgacagcagtgggagcgacgcggaagcgtctgcggccaccgtgcgggaggcgcggccgccgtcggcgctgacgttcatgcagcggcaggagctggagcagcaggtgctcatctaccgctacttcgccgccggcgcgcctgtgccggttcacctcgtgctgcccatatggaagagcatcgccgccgcctcctcgttcggcccgcaaagctttccctccctgacgggcctggggagcctgtgcttcgactacaggagcagcatggagccggagccggggcggtgccggcgcacggacggcaagaagtggcggtgctcgcgcgacgtggtgccggggcacaagtattgcgagcggcacgtccaccgtggccacggccgttcaagaaagcctatggaagcctctgcagcagtcgctcccacatatctcccggtccggccggcactccacaccgtcgccaccctcgccaccagcgcgccatcgctgtcgcacctcggtttctcctccgccagcaaagtgctcctcgcccacaccaccaccggcaccacgcgcgctacttgatctcattgttatctccgaggattatgccggtgcactgtctgtaacctttttctcgtaatcacgcctcggtttgttcccaatgcatcgtcacgcattgctagtttgacagtttgctaccgctgcctctgtgtgtgcctgtgcgtgtggcagccgaggtgtttttgtttggttgggtggtgggaggcgcgccccggtgcggtggtgggcgtggcccccggctacctagtgctggttcctgcgtgtgcctgtcgaacctgtggagcgtggtcggaagtacggtacgcactgtccggtctcatatgccggggcagaggggttcggtccagtgtggtgcaggcgtgcggattgggatcacatgcagtggctactgcaacttatgcagtcctaaagacaccattgaattataaattaacgtcctagatctttccttgatactgttcacaaataacagtgaaaagttccttcctgtagcaggtactatagcaattactgtttaaaataactgtagcatttgtttc

SEQ ID NO: 6211 - DNA, 894 bp, Oryza sativa
  Predicted polypeptide sequence is orthologous to G1863, G2334
gacaactcactgccccccgtcttctttcttcattcctcttcccaccaagaaccccaaaccttacctccattgagttcgaaaccgaggagcgaggagctacaagccgagttgtcagaatggatgaggagaaggaagccgactcgccgcagccaccgtccaagctgcctcgcctctccggcgctgacccgaatgccggagtggtgaccatggcagcacccccgccgccggtgggtcttgggctggggcttggactcggcggcgacagccgcggcgagcgtgacgtggaagcgtcggcggcggcggcgcacaaggcgacggcgctgacgttcatgcagcagcaggagctggagcaccaggtgctcatctaccgctacttcgccgcgggcgcgcccgtgccggtgcacctcgtgctccccatctggaagagcgtcgcgtcctcctccttcggcccgcaccgcttcccttccctggcagtgatggggttggggaacctgtgcttcgactaccggagcagcatggagccggacccagggcggtgcaggcgcacggacggcaagaagtggcggtgctcgcgcgacgtggtgccggggcacaagtactgcgagcggcacgtccaccgcggacgcggccgttcaagaaagcctgtggaagcctccgcggccgccaccccggcgaacaacggcggcggcggtggcatcgtcttctcccccaccagcgtcctcctcgcccacggcaccgcgcgcgccacctgaccagtgaccagaccggcgcctgtttgtttgtttgtctcggcgcatgggaaaacccaaatccgcagggattatgtcatgtcctgtaactctttttttcctcgcaacttttgaagccaaaacaattctcaccgtgttcgatggc

SEQ ID NO: 6212 - DNA, 414 bp, Oryza sativa
  Predicted polypeptide sequence is orthologous to G1863
ggatggagtatatttggaaaacccccttgtgttatacctcggaccacggcgcctgcaactaggctgttcttttcactttgaatgtcttcttttctactgtcctcacttattgttgttcttcgctttatctattaccctcgggaaaaccgcgagatttgattcgaataaggtttctcaccctctggcgaagtggcataacgcccgacgacccggtgtggctgtgggcctgagttttcgaggaaacgtgctcgtagacctgcgagcaggctgggctttgtgtggaaggggttgtattttgtcaatggatctgggttggccaggtgcagatatgaacagtaccaagcaagctgtagttacaacgacaagggataaggtatccctttgacctagtgaacacgatgattattggaatac

SEQ ID NO: 6213 - DNA, 2160 bp, Oryza sativa
  Predicted polypeptide sequence is orthologous to G1868
gctggttttgcaaacatcccacacacacacaaagcagtgacagtgagtgccaatgctgagctcttgtggtggccatggccatggaaatccaagaagcttgcaagaagaacaccatggcagatgtggtgagcagcaaggtggaggaggaggaggagggcaagagcaagagcaagatgggttcttggtgagagaggcaagggcatccccaccatctccatcttcttcatcatttcttggatccacaagctcttcttgttctggaggaggaggaggagggcagatgttgagcttctcctcccccaatggaacagcagggttgggcttgagctcaggaggaagcatgcagggggtcttggcaagggtcagggggccgttcaccccaacacagtggatggagctggagcaccaggcactgatctacaagcacattgctgcaaatgtttctgtcccttccagcttgctcctccccatcaggagaagcctccatccatggggtactaccttttttattcagctcatgtgattgttattctgttctgcgtcatatcccctttctgttgtaaatagctcaagataggaataaaggaataagtacttagaaaatatgaaagaagaaaatgcaggtcatatggttgcagttgcctgttagtttcagatgtataaaggtgtcccagattggggttctgttgtgttgaggttggtagttatatcttgttgtctttcttgggacaggatggctttgtgattaattagtttgtaaaggcagtaatcgaagtccctttctggtactaaaagcagtattggctgcaaatctaggcattataatgatttgaagattgcattgatactagaaatgtactgcttttggatgtttgcatgatgctcatgtgctaatatttccagttaccaatgtggtgcttcttgagtttagatataaaactcttctcttacattgggattctgatttttttttagttgtgcctctagtcttttccacaacaagatctccaaatgtagtcataaagtgttctgattccctttaactggcgtcatgtttggtatgtacaaactaagttcttatgcagacctgggaggaatgttgctgaaatagtgcaagaatatatcgttttgaggtggtttatatatttctgacatgaaatgggcattctattttgcaccaggatggggatcattccctcctggctgtgctgatgtagaacccagaagatgccgccgcacagacggcaagaagtggcggtgctccagagatgctgttggggatcagaagtattgtgagcgacacataaaccgtggtcgccatcgttcaagaaagcatgtggaaggccgaaaggcgacactcaccattgcagaaccatccacggttattgctgctggtgtatcatctcgcggccacactgtggctcggcagaagcaggtgaaaggctcagctgctactgtctctgatcctttctcgagacaatccaacaggaaatttctggagaaacagaacgttgtcgaccaattgtctcccatggattcatttgatttctcatccacacaatcttctccaaactatgacaatgtagcattgtcaccactgaagttgcaccatgatcatgatgaatcttacatcgggcatggagcaggcagttcatcagaaaaaggcagtatgatgtacgaaagtcggttaacagtctctaaggaaacacttgatgatggacctttaggtgaagttttcaaaagaaagaattgccaatcagcttctacagaaatcttaactgaaaaatggactgagaaccccaacttacattgcccatctggaatcctacaaatggctactaagttcaattcaatttccagcggcaacacagtaaatagtggtggcaccgcagtggagaatcttatcactgataatggatatcttactgcaagaatgatgaatcctcatattgtcccaacacttctctaaggctgtgtttgaaagttcatgttggattcgcaaatgattgaaagtacgtttatggatggttctataagttcctgttgtttccttcgttatgtgttcttgtgttcctcacctttttatcttttggttgaggttggtatgttgtaattttctcctgtgctaccttgtaatatgctgaagttaaatgctcttct

SEQ ID NO: 6214 - DNA, 1810 bp, Oryza sativa
  Predicted polypeptide sequence is orthologous to G1868
ggttggcttgcactgcctagcttgttgctcatctccttggtgtatctggctgcaggattgagctcagtgagcttgagcagcagcatgcagggtgcaatggccagggtgaggggtcccttcacgccgtctcagtgggtcgagctggagcaccaggcgctgatatacaagtacttggctgcgaatagccctgtaccacacagcctcctcatccccatcaggaggagcctcacatcgccctactcgcctgcctactttggctcaagcacattgggatggggatctttccagctgggctactccggcagcgcggatccggagcccggccggtgccgccggacggacggcaagaaatggcggtgctcgagggatgcggtcgccgaccagaagtactgtgagcgacacatgaaccggggacgccaccgttcaagaaagcatgtggaaggccagcctggccatgccgcgaaagcgatgcccgcggcggtggcagcagccgctgcctctgctacccagcctagtgctccggccgcccacagtggcggagctgttgctggcctcgctatcaaccatcagcaccagcaaatgaagaactacgctgccaacactgccaatccttgctctctgcaatatagcagggatctggcaaacaagcataatgagagtgaacaagtgcaagactcagacagtctctcgatgctgacttccattagcacgagaaatacgggcagcctgtttccgttctcaaaacaacataatccttttgaagtgtccaactcaaggccagattttggcctagtatcacctgattcactgatgagttctcctcatagctccttggagaacgtcaatttgctcacttcgcagagtctgaatgaacaacagagttcagtttcccttcaacactttgtggactggccaaggacacctgcacaaggagctctcgcatggcctgatgctgaagacatgcaagctcagagaagccagctctcaatatctgctccaatggcgtcttctgacctgtcatcagcctcaacatctcccatccatgagaagctgatgttgtcaccacttaaactgagccgtgaatatagtcctattggtctcggttttgcagcaaatagagatgaggttaaccagggagaagcaaactggatgcctatgttccgtgattctttgatgggcggaccattgggagaggttttaaccaagaataacaacatggaagcaaggaattgcctatcggagtctctgaatcttttaaatgatggctgggattcaagctcagggtttgattcatccccagttggtgttctgcagaagaccacctttggatcagtatccagtagcaccggaagcagtcctagactggagaatcatagtgtttatgatggcaacagtaacctgcgggatgatctcggttcagttgttgtaaatcatccgagcatccgcctggtgtgagcttcttgatcaacaaaaaatgcaacaagatgacaggcatgaggaaacgattcaatcagtcttcaccttgttacatatcgttatgacgtcttcaagtgtgagcatttacctcggtgctttgtcattcagactaatcttgtgtttttggtatttctgctctgttatttttcctttgctttgtaaccttcaccttggatcttgacgtgatatgacgtgtggtatggatggatttggtactccattgtggcatatcatcttaaaatatcccatgctgtgacgccataatcgcggatgaatgtaatccgatccttgtcttgctttctggtagtattcaatggattgtttgtgagctgat

SEQ ID NO: 6215 - DNA, 3434 bp, Oryza sativa
  Predicted polypeptide sequence is orthologous to G1868
gattaacaagcggcgagcgctcgagctgggtgcgcgagcggttggcggcgacggccggcggccggcggcgaggtcgagcgaggaggcgggccggcgaggcgcgcggtactttgtgcctcgaaacgagtgggcctttattttttttttggttctgtttcggctcgtcgcggatttcgcacggtttgcttcgttcttggtgattttcttgaagcgtcgtcttctccaatcgatcgcttcctgtagcttctccacccttcttctgtggtggatacagatttgttcttggaagcggctgggatttcggttaacgatgccattggtttctattctaacatatgctttctcttgtctcttgtgtctcttgtgtgttcagattgggcttgttggtgtcggatttgattgtggtttcgtggctgtgatgacaatcaaacctcgtttctcgatgctgagacttgatttgttcaaggaccagaactgtgctgaccttaatttgtgcgtgtctgagccaccccaaacacaccatgtccgaatcgatttctgcgaaagttagtatgtctgcacgatgccactcgatgctactactagtatttaggtgtctttattagctttttcctcttctatgtttattggctgtttcttgcatttgcgttgttgtagtgtggctgtgaggactaactactttgtttctcgatgctgacttgattcaatcaatcaaggaccaaaaaaatttgatgacctttgtgcgtgtctgagccactgcaactcagttttttcagtcttcgcttgtgtgaagatatcatcttgccttccgtgttttgagcctgaacgataaagaagagatgtttcttggtgctgattcgactcattttaggatggaattttgacgaggctcatgcgtgtctgaagtctgaaccattgtaaaacttggatgtagttgttgttttaggtgtctgaagtctgaaccattgtaaaacttggacgtagttgttgttttttttcctaaaaaaagagaacttttttctctcgttttttctctgctgtatttgaatttgttcattttttccagctgttgtacacttgtacttcatattgggatactgaatgttaggtgcgatcaatgtagtagtgcttgcatgtttgacaaactcatggacattaactcaagttatctaaaacattgagatccttggaatagttatgctggaactattgcatggaaattttacaactcgctatatgctagaagcgaatccccgtagttcattttcctcaatcagcccagtagatttctagctaatggtatctgataaggggcaaattgttttttcaaggatacagctgaattcataagaactgaaaatcgcaattagctggtattacattgcagaagcttgagaacagaaagaagggaataacatgcatgggtaacgccaatactaaagctatcccatggtgagctcattaacgacttgatctccatttcctgaagattcacattgcatgatcctcgaggttcagtaaccaaccatatggccttgcttctggtttcatgattgaatcgtcaggatttttggagtttgtcaagatctcacctagaggtccaccttgaggcatctcccaagaacttgagatgctatcctcttgcatttgtgccatattaggtgcatggcagctgacgcgtgggtcctctggcgaggaatagaaagttgatggaactgtcatgacattggaatctttgcttttctgaaactccattttctcgtccttaggcaagctgaaattctgaaggactgactgaaggcatccacgatcatgcatcttggtgaaaggaatgcttttgttgttctgctggttgctgctctcccaaggcttcaacatggtatttgaagaaatcgattcactgtctcctgctgtattgaacttctccggtttgttctgttgcttcaactgagagaacagggacaatgttggctgttgattcgttaaatttagcagtgggccattgttttcttcagcagctttgtttcctttctctttgttcgccattgtcctgcaaatgtgtacaggtcttcaaattaaatgattattactttctattaaaactgaaataatctagttgttttcctttgtccctgactatattgcagcatttgtattccattctttataagagatttttttccaccagaaccacaacgattaccttctatcatgaaaatgtaccagaaaatcttaaaccatcaataggatatgcaaaaatggtggaaaaaaatactgtgattcagtctgtagcactaaaatacttgcacgttgagaatattaaaccaagtttaaggatgtattaacctgttcaaactatctgtccaatagctgatactgcgtggcttcatttcattaacttttgccttcttgaagctgccctgcccgacagaagatggcaatgagccagcacacggtgtctctttcacagtctttctactttggttttccacaggctctcttgaacggtggcggtttctgttgatgtgcctctcacaatacttgtggtcggccatggcctcctttgaacaccgccatttcttgccatctgttcgacggcatcttccaggttctgggtcagagtctgcatttgggaagccttgatagagaggcctccagctcactgcagtacaataagtgaacagaaaaaaacactgtccatcatgagttgcagagaaatacacagatcaatggccttacatacatacatgcacacatgatctttgcttctaacctattgcaagttaataacatggaagtgtgtatgtatgtggtgatgagcaaggccagacctgatggcaatgtgtgagcagccttggcgaatctgagcatcttctgttcatcaagaaagggggaagggtatgatgcagcagcagcctgggtgaagctaccagcagcagctctcttgatgaggctcagatcaccctccttggtggatggcactgtgagtccttgcaagcccaacacctctccaagctccatggcagcagcagagaagtcagcaaacatcttggaaggacaggaggaggggagaggaggaagaagaagaagaggagggggtgagcattgctggggacagtcacagtgaggctgaggttgagagtgaggagggtgtagtgtgtgctttctagtaggaggcaggaagtgtgtggtgatatattatgggatggtggctctttgggagactagaggtagggctaggtggtggcccttaaatagcaggagtcctttcattcttttagtggagtaactttttttgctgtcatttctttattttatttttattttattgattttttgggctcaatgtttctgtgaagtgatactgctgggtactgatggggaggagtaattggttcataaaaaggtagtagtagcagcagcatgtttattct

SEQ ID NO: 6216 - DNA, 1616 bp, Oryza sativa
  Predicted polypeptide sequence is orthologous to G1868
aaaagagccaccatcccataatatatcaccacacacttcctgcctcctactagaaagcacacactacaccctcctcactctcaacctcagcctcactgtgactgtccccagcaatgctcaccctctcctcttcttcttcttcctcctctcccctcctcctgtccttccaagatgtttgctgacttctctgctgctgccatggagcttggagaggtgttgggcttgcaaggactcacagtgccatccaccaaggagggtgatctgagcctcatcaagagagctgctgctggtagcttcacccaggctgctgctgcatcatacccttccccctttcttgatgaacagaagatgctcagattcgccaaggctgctcacacattgccatcaggtttggattttgggagggaaaatgagcagaggttcttgttgtctaggaccaagaggcctttcactccctcacagtggatggagctggagcaccaggctctcatttacaagtatctcaatgcgaaggcccctataccttccagcctgctcatttcaatcagcaaaagcttcagatcatcagctaacagaatgagctggaggcctctctatcaaggcttcccaaatgcagactctgacccagaacctggaagatgccgtcgaacagatggcaagaaatggcggtgttcaaaggaggccatggccgaccacaagtattgtgagaggcacatcaacagaaaccgccaccgttcaagaaagcctgtggaaaaccaaagtagaaagactgtgaaagagacaccgtgtgctggctcattgccatcttctgtcgggcagggcagcttcaagaaggcaaaagttaatgaaatgaagccacgcagtatcagctattggacagatagtttgaacaggacaatggcgaacaaagagaaaggaaacaaagctgctgaagaaaacaatggcccactgctaaatttaacgaatcaacagccaacattgtccctgttctctcagttgaagcaacagaacaaaccggagaagttcaatacagcaggagacagtgaatcgatttcttcaaataccatgttgaagccttgggagagcagcaaccagcagaacaacaaaagcattcctttcaccaagatgcatgatcgtggatgccttcagtcagtccttcagaatttcagcttgcctaaggacgagaaaatggagtttcagaaaagcaaagattccaatgtcatgacagttccatcaactttctattcctcgccagaggacccacgcgtcagctgccatgcacctaatatggcacaaatgcaagaggatagcatctcaagttcttgggagatgcctcaaggtggacctctaggtgagatcttgacaaactccaaaaatcctgacgattcaatcatgaaaccagaagcaaggccatatggttggttactgaacctcgaggatcatgcaatgtgaatcttcaggaaatggagatcaagtcgttaatgagctcaccatgggatagctttagtattggcgttacccatgcatgttattcccttctttctgttctcaagcttctgcaatgtaataccagctaattgcgattttcagttcttatgaattcagctgtatccttg

SEQ ID NO: 6217 - DNA, 648 bp, Oryza sativa
  Predicted polypeptide sequence is orthologous to G1868
tgggtagttgctccttcctccccctcccccgcaaacaccgacctaccatgtcccttctcccctctcctctctgagctcagctgcatccatccatccaaactactcacagatgccactcttcctcaaccaccctcccatttaatgccctccacctcctcctcaagcccaggattcgggaacctgctagccatttttgctccaggacagtacagccagatgctgctgctgcagctgctgggttgctgcggtggtcaggtcaccccggttcttgattcttgacgaaggatggcaatggcgacccctacgaccaacggcagcttccttcttggatcaggtggctatcccggtgcccagattctaagcttctcctcctcaggtcacagcggcaatgggttggattgtggaagctcagatgtggcaagaatgcagggggttttagcaagggttagggggccattcacaccaacacaatggatggagctggagcaccaggctctgatctacaagcacatcgtggcgaatgcgcccggagcgggcggctgggccctcccatcaggagaaggctcaaccaccaggggaccaagtgccccccgggggcaaccgggcccacgcccgggaaaggggcgcacacccgggcaacgggaagga

SEQ ID NO: 6218 - DNA, 862 bp, Oryza sativa
  misc_feature (1)..(59): n is a, c, g, or t
  Predicted polypeptide sequence is orthologous to G1868
nnnnnnnnnnnnnnnnnnnnnnnnnnnnnnnnnnnnnnnnnnnnnnnnnnnnnnnnnnnttttttttttggcaaaaattatgacaattcagtcagcaacatagaacaaattccacaagaaactgagatagtacaataccacattaccgctcgcttaaaaacggagggaactcaaagcatgaagtgacaaagattaaagaaaaataatacatgagctaggaaatcatacagggtgtgctctggggacaaaaacatcagtagatagcctcatggctgttccctgatgatcagaccggcggtttcacagtgtttggacagtctgggcattcaccaggcctgaagtgagcaagccattgcagaggctgcctgcaggactactaacagtgctgctgggcactgaactgaagctagtcatctgcaggactccggtgggcgattgcagctgtggacttgtagtatgtccatcagctaagaggttcaaagatggcgggtggcggcttttgcctttgtcgtctgatgcgctgctggtgttggtgaagaactcacccagaggtccaactatggacgcttcccaggagcccggtatccaacttgctcgcgtgatgcacccgccatcgatgaaccgctactaatggtcaaagagccagaagagaaagggggaaacgagtacccaggaaggaatgaagcagagcaaagcgaaccgagcaaaagagagtaaagagagaggagagcaaaaacccaagagggcagacacaagacagaacaggaaaactcaccaaccagcggaaaagagaaacgagcaacacacaaagaaaaccgcacaccccgtcggcacactccattacgacacaaataacaacgcg

SEQ ID NO: 6219 - DNA, 2284 bp, Oryza sativa
  Predicted polypeptide sequence is orthologous to G1880
aaagctggtagaaagctgcctcccctctcctctcctctcctctctcatctcccccctttggtgttgtctgtgtagcagcaaagccaaaaaaaacaacactgctccaaacacctttgctcctcatcctcctcctcctccctctcgattcctagctgtactcactcactgcatctcctcctccccttttcgtttgtttattctcttctccggcttcctcgagctcgccttagctagaagcctgtggccccgtgatctctcactgttgtggcttatatagagatagatatccggctcggttccattgatccgttcttgtggagttgtgtgatcagagctggagagattggctaggttggaggaggaaggggaattcttggttgtaagggaagaggtgggagtggtcaccggcggtgcgcgcgcggaggcggacatcatgctgagttcttgcgcgccgacggccgtgccgccgcaggatgcgtccggtgcggcgacggagccgttccggtctctgcagatcgccaccgccggtgccgccgcgaagaagaagcggcggccagccgggacacctgacccggacgcggaggtggtgtcgctgtcgccgaggacgctgctggagtctgaccggtacgtgtgcgagatctgcaaccaggggttccagcgcgaccagaacctgcagatgcaccggcggcggcacaaggtgccgtggaagctgctgaagcgggaggccggcgaggcggcgcggaagcgggtgttcgtgtgcccggagccgacgtgcctccaccacgacccctcccacgcgctcggcgacctcgtcggcatcaagaagcacttccgccgcaagcacagcggccaccgccagtgggcgtgctcccgctgctccaaggcctacgccgtccactccgactacaaggctcacctcaagacctgcggcacccgcggccacacctgcgactgcggccgcgtcttctccagggtggagagcttcatcgagcaccaggacgcgtgcaacgccggcaggccacgcgccgccgaggcgtcatcgtccccgggacgcggcggtggcgtcgtggttggtgcgccggcggcagcatcgtcgtctcagcagcagcagctttttgcggtgccggcttcgttgtcgcggacggcgtccagcgccagcccgtcgagcgacctggtggtgagcccggtggcctggcctgctactggtggtggtggtccggcaatggtgagtccccgtgctgcggcgccggctcctgctggcggtagcatcgcggcgttccaccaccggttcactgacccggcgctgtcgccaccgacgccgtgtggtggccggcgaggaggatgccacactacccacagcctggagctgcagctcatgccaccgcgcaccaccaccacctgcgcaggcggcagcctcggtggtactccagttgccaccgccgttgggtactacgcttcctcttcgccgcattcgcctgctgctgctcttccgtcgcggcagccggtcgccgacgcaatgcggctgcagctctcgatcgggttcggcggcgcacgcgatgatggcaacagcaacagcagcagcagcagcggcgaggtgtcggcctcggcgacgaggctgaaggaggccgcccacgagcagctgcgtctggcgatggccgagaaggcggccgcggacgaggcgcgcgcgcaggcgaagcggcaggcggagctcgccgaccaggagctggcgaccgcgcggcggatgcggtaccaggcgcaggtggagctcagccgcgcgcacgtgctccgcgaccacgccatacgccaggtcgacgccacgcagctgcagatcacctgctacagctgcagccacaagttccgggcgagagcggccgccatgatcagctccgacgtcgccagctacgtctcgtccgtcgtcaccgagggcggcgacgccgaggtcgacaacgacggcaacttgcaccgccgccgcctcaacgctgacgatggcatgccaaggggccattctaggacgatggcaatggacctcaactagctcgcaaaaatcactggaagaaaaaacaatctttttttttcttttcttttgtgccagattgctctccttttgttttaccaatgagctagctggtggtggtatgtgctcatgtgcatgcaccatgcaatggcgatgtattgtaattagatgcagtgatgagatcacaagctccagtgcctagtggttgtgttctctcgcatggcagattggctgggcaggaaaaagctaaaaggggtctactactacgct

SEQ ID NO: 6220 - DNA, 976 bp, Oryza sativa
  Predicted polypeptide sequence is orthologous to G1893
cggccatgatcgtcatcagctgctccggtacggttgctgcagctgcaacaaacagcaggaggaagaggaggaggaggtcacggttgccttgcgcataggcctaccggccgtctcgtcggcgtcggcgtcgccgtcgccggcgatggcgaaccatggggctagtgcttctagtacaggagttgctggagatgatggcggcggcggcgccatggccggcgtgggtgtggaggtggagagcgtgcggaggagcggcggcggtggcggcggcgggcagtactggatcccgacggcggcgcagatcctcgccggcgccacccagttctcctgccccgtctgccgcaagaccttcaacagatacaacaacctccagatgcacatgtgggggcacgggtcgcagtaccggcgaggcgggacggcggcgctgcgcggggcgcagccgacggcgatgctccggctgccgtgctactgctgcgcggcggggtgccgcaaccacatcgaccacccgcgggcgcggccgctcaaggacttccgcaccctgcagacgcactaccgccgccgccacggcgcccgcgacttcgcctgccgccgctgcgccaagcgcttcgccgtccgcggcgactggcgcacccacgagaagaactgcggccgcctctggcgctgcgcctgcggcgcccacttccgacacaagcgctccctcaacgaccacgcacgggccttcggcgccgcccacgcccacgccggcgccggcgccggcgccgaagacgacggccgcgccgccgccgccgccgccggtgtgctgcgatgaccttaatttatatatatgtgagtgcgaaattaattagctgattattggttagtttcaggttatttttttagtagaaaattaatttgtttgtgatcgatcatatatatatgtggaggactctcttaattgtttttttgtttggtttgatttgatttgatgtgtattgcatgc

SEQ ID NO: 6221 - DNA, 1756 bp, Oryza sativa
  Predicted polypeptide sequence is orthologous to G1893
gaatctctcttccatctctctctttcttccagaccgtggcatgcacggcttgacacagacgctctcgtacgtcgtcgtcgtcgccgtcgtcctcctcgtcggcataaagcagtctccactgcaaaccagctagctgtagctctcaattcgtaggtgagatcgacgcgcatcgcgccgcgtctacgtttgtatatagagggggagagaggatcggaggagccgatcgagctgaagtagggatggtgctgagggcgtgcacaatggtggaggggtcatctttcgtcgtcggcggcggcggcggcgtgccgttcttcgagtggctcaagccgcggtcctcgccgccgccgtcgccgtcctcctcgtcgacggctacgacgtcatcgtccctcaccgcccaacgacaaccgcgtggtgctggtaccatgctgtgcttgcctcttcttggcaggctcggagaggagcccgttgatgctggcgatggcggggcgatgaacaatcctcctgtcaaggaagaggtgagcaatactacagacgactatgccggtgttgatctcaacatcggcttgccggcgacgaccggcgggggtagctctgaagatgcgcccatggatgaggatgaagaagacgatgatgacgacgaggaggaggagacggaggatgatgaggagaaagcagctgggcttgaggggtgcaaggtggaggagaaagaaagagagcaagtacatagcgagggatcgaagtattacgtgtccgtgggaggaggggaagatcagagcagcaacgccggcgatgtcgacgccggcgccgcctgccgtggccggcggtattggatcccgacgccggcgcagatactcatcggcccggtgcagttcgtctgccatgtctgcaacaaggccttcaatcgatacaacaacatgcagatgcacatgtgggggcacggtcgggagtacaggaaggggccggagtcgctcaaggggacgcaggcgacggcgacgctggcgatgctgaagctgccgtgttactgctgcgccgccggctgccggaacaacgtcggccacccgcgtgcgcggccgctcaaggacttccgcacgctgcagacgcactacaagcgcaagcacggcgccaagcccttcgcctgccgccgctgcgccaagccgttcgccgtcaagggcgactggcgcacccacgagaagaactgcggcaagcgctggttctgcgcctgcggctccgacttcaagcacaagcgctccctcaacgaccacgtccgctccttcggcggcggccacttccccgtcgccgccgccgccgccgccgcacatgcggcggcggcgccgcccaagcagcagcagcgaatcatacgcttcgacgacgcaatggcgcaaatgcatggcggcggattaatgaactaacagtgttaattgttcttgatcgttagctagctatagctaattgcatgtacacttcccccttagtttacacacacacacacacccacacaaaatgcaataagattatggagctaggttgccgaggagaagctaaaggcagtgaagcagctgaattttcttctggatgatgaccggagtttgcatgcaatcgggggactgactgatcacataaggtttgttagttacccgtagcttggtaatttgcaaggaagaaaatttgtcagcttcacagcctaatgctggtttggcagccaaatgtatcaatgtatcactcgtgcatgacttaattttaagaagatctgttaatt

SEQ ID NO: 6222 - DNA, 1961 bp, Oryza sativa
  Predicted polypeptide sequence is orthologous to G1893
gatctctttctctctctcactctctctctctagtgaagttgccttccctctctctctcactctctctctagtgaacttgcctttctttcttcctccacaacctcatttacacctttagggctagatgcacacacacacacaagacacaactactttacctctccatctctctctatttataactgtagtttgccttcttctccatccattatgctatctcctcttctccttctcctcctaccttgagctagctccttactaccaatcctcttccatgggagatccctacaccaacttcttgagaggctaccaccaccaccaccgctcccaccaccccctccacttccctccgccgccgccgccgccgcctccgccctacgccgcctccttctccggcctctactcctcctacctccacccaccacctcccccttcctcccctccgatcagggaagccctccccctcctcagcctcactccctccaccacccacgacgacgatcaccaccaccgccgccatgatcaagatcatcaccaccatcacaagcaaggccaagaaaagaacagccatggcggcggcggcgccgcttcttgcagcaacaacgacgacaaacgagaatcaccatcagcagcagcagcagccgatgatcaggcggcggaggtgaccgtggccctgcacatcggcctcccgagcccgagcccctccgacgccgccgccgccgccggcaaccaagctgcagcagcagcagcagcagaagcatcggcagcaggtggaggaagcagcaggatgcaagtggaggaggaaggaggagaggaggaggatgaagacgaggcggcggcggcggcggcgacggcgacgctgccgctgggttgcgcgtccatagggatagggaagctgaccaaggggcagtactggatccccacaccgtcccagatcctcattggccctacccagttctcctgccccgtctgctacaagaccttcaaccgatacaacaacatgcagatgcatatgtgggggcacgggtcgcagtacaggaaggggccggagtcgctgcgggggacgcagccgacggcgatgctgcggctgccgtgctactgctgcgcggcggggtgccggaacaacatcgaccacccgcgggcgcggccgctcaaggacttccggacgctgcagacgcactacaagcggaagcacgggatcaagcccttcatgtgccgcaagtgcggcaaggcgttcgccgtccgcggcgactggcgcacccacgagaagaactgcggcaagctctggtactgcgcctgcggctccgacttcaagcacaagcgctccctcaaggaccacatccgcgccttcggccgcggccacgccgcctgcggcatcgactccttcgacgacctcgacgccgatgacgacccctcctccgacctcgaccacgcctccgcctccgcttcgcgagtagggtgagtgtttgatcgatatcgagatcgagatcgagctgagctaattaatttccatgataattagttaaccgtgctgctactactactatgtctgtgattctgtgtacaccacgggattggaatggagaggatatgggggtatagatgatgcatgatactgcgaattttcaagggttttttttttaattttgggggtatattaatgaattagttgatgatgaggaacaaattaattactacatttgcagcaagctagcagatgtgtgtgtacgtactttgttctctagaaagtactacgtacgacttgagttctaatcgtttggttggatggagatacagaaccctatagcggcttcattgtatgtgcagacttttcatttgatttggtatatggtcaaattggtgatacgggttaattaagattaattatctgtgtcattttgagaagatttatatctatacatatatatatattagagcactatatatgcatgcattcaagc

SEQ ID NO: 6223 - DNA, 1741 bp, Oryza sativa
  Predicted polypeptide sequence is orthologous to G1893
atctcccatcttccccacgccaccaaaccccgagaacaagaaagctatataccatctctcatgcgagtaaataattaagtgagagctctctgtgtgcgtataagtagagatcgatcggtataatcgaggactacatgaggatggggctgcggacctgcagcgccatggaaggtgaggtcgtcgccgcctcgcctttcttcgagtggctcaagccaccgccgcggccggcgtcatcctcgtcgtggtcgtcgtctttctcctcgtcgtcctcgatggcttccagggatcaagaaacagtagtacctggtgaagatggcggaggtgaaattcaagaagatcataagagcggtatgacttgtttgccgctgctcagcatgctcgaggaggggaattcgaagaggcatgagcaccctgtgaaagaagagatcatgagcagtgcacacgcagccggggtagtggagcctggcgtggagttgaatatcggcttgccggttacaggatctagcgctcaggaggtcaccatggaggaggacgatgaggaggaggatgacgacgacgtaggggaggaggagatggacgagtggaagcctatgcatggcggttgcaaggtggagggggatgaagagcagtacggcgaggcggtggcgtcggtggaagggtcgagcagcatcaccgccgtgggggatatgttcggcggggtcggggcggagagcggcgtggcgatgagcagccggtattggatcccgacgccggcgcagatcctcgtcggcccggtgcagttcatctgccatgtctgtaacaaaaccttcaacagatacaacaacatgcagatgcacatgtgggggcacgggcgggagtaccgcaagggcccggagtcgctcaaggggacgcagacactggcgatgctgaagctgccgtgctactgctgcgcggcggggtgcaagaacaacgtcgcccacccgagggcgcggccgctcaaggacttccgcaccctgcagacgcactacaagcgcaagcacggcgccaagcccttccgctgccgccgctgcgccaagcccttcgccgtcaagggcgactggcgcacgcacgagaagaactgcggcaagcgctggttctgcgcctgcggctccgacttcaagcacaagcgctccctcaacgaccacgtccgctccttcggtgcccaccacctccccgtcgccgaatccgccgccgccgccgccaccacccccgccgacaaagaccgcatcataagcttccaacggtgagaaatatcgatcggtcgaggtcgacgatgatcgatcatgatgtgtaggctgcagttacctggttcgttactaagtctatgtatacgtgagcactgctgctcgcgtatatatctacttagtaagttaaccatgcaattgtccagcatatagacaacaagttaatcaaactatagctactagctagagagtaatgtatgctgatatgtgcatgcatccgtggggatttaggaggaaatttaagcagactattagcacacaataattaaggtggctttcagccggtgccgatcgaaagctgtgagcctgtgaagtagatgaattttcttctgccagagtgtgagctgtttagtgaggctatgtccccagctttgtatcggagaaaatttctcagcttcacaggctaattaaacaggtaatttggaacctattttaatttacatgcatttattaaacgattattgatcaatgagagagct

SEQ ID NO: 6224 - DNA, 2015 bp, Oryza sativa
  Predicted polypeptide sequence is orthologous to G1893
cagctccgtcgtcgccgcgcggggcggctcttcgccgacctgaacaccaaggctgcggcgggagacccgatggacgtggagggctccggctccggctgctgcgccgccgaagccgccgcggcgggggacgacgacgcggacgtcacggtcgcgctgcacatcggcctgccgagcccgaccgccgccgccgacctcatctcggggctctcgtcagcagccgggagaagatcctccaccgcgcgtcgtgacgaggaagaggacgaggcggaggaagccggcggcgcgagcagggacgacggcgacggcggcgacgccgccgacgccgcggcgccgctagggttcgcgtcgacgccgatcgggcgtctgaacaagggccagtactggatcccgacgccgtcgcagatcctcatcggccccacgcagttctcctgccccgtctgcttcaaaaccttcaaccgatacaacaacatgcaggtcagccagcaatttcttcatttctcttcacagcttaattctgctagctgctactgttcttgcttgctctagattatcgctgctccatttaattttattcttttttgcgattctttgtgggttattgctgttcagttttgtcgcaattcaagactaataagtgattaatttacttagaattagacatagcatcatgcgtgatccccaaactgtaccactagtggtcctcttgttcgtcttcccccgtttttgtcgtcatggtatgacaaagcatatgtcttcttcagtagattgataaatcccttttcttaggctagaataaatccgatctagctagaactaatttttttttctttcaagcatatcctaattgcaatcacctaacaaataaatgataccgacagtaggcgacgcaatttttaccttttctttctaagatctggctatgaaaaatttctacagtagtagttcaggaaagctttatggctcttgaacgaacgctgcatatctagctgggtgtaattacttgctagttcttttgtcggaataatgtttgacaatgcgtctcactcgttctatatatacctcttgatcccattaacgtatgcttcttatacttagctagttactcagcctcgatcagcatgcgaacgaaaacctgcactacctttatataaaaacaaaaaactgaattttatttttgccgggttgactgaaagaattaggccgaccgaattttattaggattggtaagaagaaagcctgaacctaattaattacttaagagttatctgtttacagtgattaattaagtgatatacatatgtatctatgtaaaaatatccatatattcaccaacctctctttgcattatagatactctgctagctgctaaacctacatattatctgagaaattcttgacaaaaaacgtcccacacaacatgcagctgatcttggaattatcgtacactagtaaatctcgattatcaagtgtgtcttgccactccatagccgggctagctagcttaagaacatgaatcccgtcttttctttctctgaacattaatttgttcttttgctcgatctgtcagaccaatgaacgatgaagcatgaagctcctattccaaagtcaattttttttagaaacacagtataaacgtaatcgctcataacacgtgtacattcatccatatgaacacatacacgcacaccatatttttaatgaacgacaaagtatgaaggtcctatttccaaagccatataatttgaactacagagatagctattttttttccattcgaaaaaaaaaatccattcaatgagatagctatattttgaaactggcgacctattttcaaagccatctagtttgaaacggagggaacatgaaagctagagagcagttcagttcagttctccttcgattccatggctgctagtgctagctcgtacctttttgtttagcttatcgttgaaatacgacgagtactagcaactgctagcaagcaagctataagagaaggagatttgctccggtcc

SEQ ID NO: 6225 - DNA, 1317 bp, Oryza sativa
  Predicted polypeptide sequence is orthologous to G1893
atggaagacccctacactagcttcttcaagaacccttactactactactgcacctcggctagctccttccccaccgcgcccgccgccgccgccgccgccgctcacctccctccgccgctgccgccgccttacgctgccctgtatcctaccgccggtggcgtcggcgtcggcgtcggcgcgcatcatcatcatcagtacccgccggccgcattcttccacccgccgccggtgcaccagcagcatcaggcgccgccgtcgccgccgctgcgggaagcgctgccgctgctgtccctgtcgcccacgccggcgcgccgcggcggcgtcgtcgacgcagcggctgactcggactccgacgacgacgacgacggcgactgctgctaccaccacctgcaggatcaggagggggcggcggccgggtcgacggccacccccgccgccgccgccgcgcgcgcgccgctcttcgccgacctcaactgcatccccacctgctgcggcgacgacaacgacggcggcgacccgatggacgtggaggtcgccgggacaacggcggacatcgacgccgcggtcgccctgcgcatcggcctgcctgccggcggcacggaggccgatctcctctccgggctcaccggcgccggcgtcgaacacgaggaggaggaggaggactgcaaggtggacggcggcggcagcggcggcgacgacgaggtggtgccgctagggttctcgtcgacgccgatcgggaagctgaacaaagggcagtactggattccgacgccatcgcagatcctcatcggcccaacccagttctcctgccctgtctgcttcaaaaccttcaacagatacaataacatgcagatgcatatgtgggggcatgggtcgcagtacaggaaggggccggagtcgctgcgcggggtgcagccgacggcgatgctgcggctgccgtgctactgctgcgcggcggggtgccggaacaacatcgaccacccgcgggcgcggccgctcaaggacttccgcacgctgcagacgcactacaagcgcaagcacggcctcaagcccttcctctgccgcaagtgcggcaaggccttcgccgtcaagggcgactggcgcacccacgagaagaactgcggcaagctctggtactgcctctgcggctccgagttcaagcacaagcgctccctcaaggaccacgcccgcgccttcggccacgcccacaccgccctcgacgccgacgacgacgacggcgccgtctccgacgccgacgccgtcgtcagaccttcgtcctccatggctgcctcctccctgcagccgccgccgcgctag

SEQ ID NO: 6226 - DNA, 693 bp, Oryza sativa
  Predicted polypeptide sequence is orthologous to G1893
aaaaccttcaaccgatacaacaacatgcagatgcatatgtgggggcatgggtcgcagtacaggaaggggccggagtcgctgcgggggatacagccgacggcgatgctgcggctgccgtgctactgctgcgcggcgggctgccggaacaacatcgaccacccgcgggcgaagccgctcaaggacttcaggacgctgcagacgcactacaagcggaagcacgggctgaagccgttcctgtgccgcaagtgcggcaaggcgttcgccgtcaagggcgactggcgcacccacgagaagaactgcggcaagctctggtactgcctctgcggctccgagttcaagcacaagcggtccctcaaggaccacgcccgcgccttcggccacggccacggcgcgctcggcggcgccgccgccctcgacgacgacgacgacggcgccgtctccgacctcgaccacgactcctcctccaccgcccccgccgcccgatccctctaatcgcaaagacctgcttcggtccagcaaaaagtatctcgaagtactagtacctcacattactaaatcgtttctgatcgttggatttagctggataagatatgtattattggatccagcgattggaaacaatttggttaccataatgtatcggtaacctcgaggtatttttttattggaccagagtgaatctttcattgtaac

SEQ ID NO: 6227 - DNA, 648 bp, Oryza sativa
  Predicted polypeptide sequence is orthologous to G1902
atggaggtggcggaggggaggacggtggcggcggcggcggcaggtggtggaggattgggaggaggggcgaggacggaggcggaggggttggcgtgcccgaggtgcgagtccaccaacaccaagttctgctactacaacaactacaacctggcgcagccgcgccacttctgcaaggcgtgccgccgctactggacgcgcggcggcgcgctccgcaacgtccccgtcggcggcggcacccgcaacaaggtcgccccggcgccgtgcaccggccgccgcaagcgcgccgcccacgccgcgcacgccgcggcgccgccgccgacgacgacggcgtcgtccgcgccgctgccgctcatgccgccggcggtggcgtacgagctgccgttcctgccgccgccgccgccgctgccgctggcggccgtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctag

SEQ ID NO: 6228 - DNA, 402 bp, Oryza sativa
  Predicted polypeptide sequence is orthologous to G1903
ctgcgtgctgctccgaccaacagagcttcgtcgagaacggcttcccgggcatgagctactttgagacgtcgggctcgtcggtggtgtacccgcactaccacaagtcgacggacctgcctgagtacgtggactttgagcagatgggcctcatcaccaaggccgccgcggcagcgctggccaccttcgcccagcccttgtaaggatgatggtcgtgatgtgattgtacgttttttatatgttctttcggctgtcttgatcgatgctgcagcgcccaccagcgagctcacccgccctatcgctgcgtggctgtgtgacccacaacgttgagttcgaacgcaggctctcatgttttggtgtttgttgttgtgtacaagaagaaaagaggccgttctttttacaacc

SEQ ID NO: 6229 - DNA, 1406 bp, Oryza sativa
  Predicted polypeptide sequence is orthologous to G1909
gctccatggctttccaccttcgcttcctcctcctccttgccctctagctactagctcacactgtcacagtcaccacacagctactagaagtaagatttagctagattattcattaatctgtactaattgatattgctaagcagctgcagcagcagcagctggttggggggaggaagaagaaggagagtgttcgatcggcggcggcggcggctcaccggtccgacatgcgcaggggttcaccgtggtacgactactactactcctcgtcgtcgtcgtcgtcgtcgtccccggcgcggagcaagcgcgcgcaggcgcagctcgtcgtcgtcgtctccgccgccggcaagaagctaccctggccctcgccgcggcgtcgcgggagccatgtcgtcgccgttcctgggctcttcttcctcttccgcttcgtcgcccctctcttacctgaccccgcctaggcctcctcctcctcctcctccccttctcatggggcagggatacgccgctgctgccaatggcggaattggcggcggcggcgtcgaggcggtgaacgcggcggcggcgccgaggcagggtggcaggcacgccgggcacccgccgctgccgaggccgccgccgaggcagtgcccgcggtgcggctcggcgaacaccaagttctgctactacaacaactacagccgcacgcagccgcggtacctctgcaaggcgtgccgccgccactggacggagggcggcacgctccgcgacgtccccgtcggcggcggccgcaagaacagcaagcgcgccgccggcggaggcaaggccggcgccacagcctcgacggcggcttctgcccatgtcgtcgcgccggcggcggcgccgccgacgtcgtcgtcgttccccgatctcctgaggcagatgctgatggcgccggctaccgccggtggcggaggcggctacagcatcgaccagaccgcgtggcagcaaatggcggcgttcgcggctccacctcaggccgccaccggcgatgtcggcggcgcggtcggagcggcgtcgacggcggcgccggacgcgaactgcggcggcggcggcgtgcagtactggaacgggtggctgcaagatgacatgcccggtctagatggttcatgttaagtaacccgtgcttgtattgatacgtatacgtatacggagctacggatatatataccgaatacgtatacgtatatatatgtgtgtgtatatgcatgtatagcctatgtatgcatacatgcatacacatgcgctatgaaagtatatacgtatgtcgtatgcgcatactaaattagcgtaacaagagcctatgactgtactagtgtagtttggattcaggttattaactcgtgggtatatgttgacctactgtagttaaatttgtgtatttgtgcgactct

SEQ ID NO: 6230 - DNA, 1626 bp, Oryza sativa
  Predicted polypeptide sequence is orthologous to G1909
actaccataactaccccacccaacaccatcatctgatccatttccacaaagcttctgaaagccaacacatacctcactgcctttgccttcttctcagcttcaagaagccttttgagcttgtgatttctacatcatccatccatttcatcaccatgatccaagaactccttggagggacaaccatggaccagctcaagggcgccagcgctctgaaccacgcctccctgccggtggtgctgcagcctatcgtgtccaacccgtcgcccacgtcgtcgtcgtcgacgtcgtcgcgctcgtcggcgcaggcgacgcagcagaggtcgtcgtcggcgacctcgtcgccgcacgggcaggggcagggtggcggcgcggcggagcaggcgccgctgcggtgcccgcggtgcaactcgtcgaacaccaagttctgctactacaacaactacaacctcacccagccgcgccacttctgcaagacgtgccgccggtactggaccaagggcggcgcgctccgcaacgtccccatcggcggcgggtgccgcaagccgcgccccatgccggcgccggtcgccaagccgcccatgtcttgcaaggccgcgccgccgctcggcctcggcggcgggccagtgtcctgggcctccgggcagcaggccgccaccgcgcacctcatggcgctgctcaacagcgccaggggagtgcagggccacggcggcagcaatgtccaccggcttcttgggctggacaccatgggtcacctccagatcctgccaggcgctcccaatggcgccggcgccggcacggcggcgtcgctctggccacagtccgcgccgcggccggtcactccaccgccgccgcacatggactcccagctcggcatggggacgctgggccaccacgacgtgctgtcgagcctcggcctcaagctgccctcgtcggcgtcgtcctcgccggcggcgagctactacagcgaccagctgcacgcggtggtgagcaacgcggggcgcccccaggcgccgtacgacgtcgccaccgcgtccctcccttgcaccaccgcggtgacctcactcccgtcggcgctgtcgagcgtctccgccgccgcgccgaccagcaacacggtcgggatggacctgccacccgtgtcgctcgccgcgccggagatgcagtactggaatggcccggcggcgatgtcggtgccgtggccggacttgcccactcccaacggcgcgttcccatgagatagacgacggcgacgacgtcgtctcatgcaagcatgacattactagctagtgtagctctcgatcggtttagctttaatcatcatcgatcttgtgtggtttcggttaatcagtgtgaggactctgaggggtttaatcaagggtgttttagttactggtgtttttgttaatcagtggggatcgatcaagtaaccttttttactgtttacttattattaggtttttacctagggtttggtggtaactgggtatagtgtttaagtcgtgatcaatgcatagatggggttgtactatgagatgtgtacgtgtgttgtcggtttcgttcaggttgatccatgtatggatgtaaggtttacattccctgcaagctcgtggacgtacttatctcagctgc

SEQ ID NO: 6231 - DNA, 996 bp, Oryza sativa
  Predicted polypeptide sequence is orthologous to G1917
ccaaagctaaagctgttcggcttccacacctccaagcaggagacgatggattagcacaagcacggctaggagcaggacaggagtagtactcgactgagcgtctgagccggagaacgcgccggccggtctgcggcaacggagacggagctcgatcgcagaggaggagctaggcggccagcgatgacagagctagctcgtagacaatctgatggaggcgtgcccgctgctcattgagtaaagctcgagcttgcttccgccaagctcgacgaatgggtgcgccaaactcgcggtagtcatggcgctcgagctcctccccgcgcatgtatcttcggcgagctccgcctctccactcggagttgcttcgtccctgtgccgctgccttcgccggagaacgccgcccccactgccgcctccaccaccaccgccgtaggtgctggagctcgatttggttgcgcgcttgcggctgtcatcctctacggcggtggaatgggtattggaggacggtgtttgcaggcggcgaatctgcagctccgtcagggacgagatgtcgatgggtgtgcggtggtcctcgctgggcagatggatgagccatgcgcccatgccgaaggagagagagacagtggagaggaggaaggaggaccggactgatacatgggactaactaatctatacaggtggcatcctaatgtgcaaaaatagtgtagaaaaccactcgagggtgtcttttgtactgtattgaaagtttgagggggtcaaatgtctgtctggttttaaagttgtggggtgtgctttagacaagctaaagacttagagggtgtaaaatagacttatccctttaattctgagagagttctggatgttggtgtcggctgccgtagtgtctctagccagtgttggctgaaggaaatctgttattttggtttaagttctaacttgtaagctggaatgcccggcaaaatgctatatttgcttcaatagaagcagggtcattggctg

SEQ ID NO: 6232 - DNA, 2533 bp, Oryza sativa
  Predicted polypeptide sequence is orthologous to G1927, G2184
ggagttgactcgccatttcgccatttcgtcgagaggttgctgtgccagtcaccaacccattccggcggcggcggcggaggagaccgagatggggatggagaacccgccgctccggtggccgccggggttccgcttcagcccgaccgacgaggagctcgtcctctacttcctcaagcgccggatcgccaccggccgccccaccccctacatcgccgacgtcgacgtctacaagtcccacccctcccacctccctgagaggtcggcgctgcggacgggggacaagcagtggttcttcttcagccggatggaccgcaagtaccccaacggctcgcgggcgagccgcaccaccggcgagggctactggaaggccaccgggaaggaccgctccatctgcaacggcggcggcggcggcaccgcctcggggcgcgcggtggggagcaagaagaccctcgtgtaccaccacggccgcgccccgcgcggggagcgctcggactgggtcatgcacgagtacaccctcctcgccgacgcgctcccgcccgccgcgcgcgaccgcgaggcgtacgctctgtacaagctgttccacaagagcggcgccgggcccaagaacggcgagcagtacggcgcccccttccgggaggaggattggctcgacgacgacgaccaccaccacgaccagcttcctgctgaggcggctcttccggctccagccacaactagtggtagagctgcaacaactgaggagcatgctgactttgagcttccgggtggggatcttgatgtgctccttgcgcaaattgaaaatgatcaggatataatcgaagcgcaattggatttctcaactcatgttacttcccaagttcagattcagcatcgtgttcatcaaggttggctcagtgatgatggcggaaaatcagatgttgcggatgctacgactagtggcagtgctttgttgatggcagagaatacgtgcgctgaacttccaattgatggtctcgagcaacttctgatgcaaatatcggatgatcaacagacagttgaaatgctctctggtttctcagcatccgttccccaatcgcagcttcaacatgattatcatcagggttgtcttggtgttcatagggaggaggttggtgttgcagattctaccactgttagtagtgctgtggtgacagaagaatgtactgtccgtgagcttcaggatattgaagggcttctgatgcaaatagaaaatgaccaggaaaatgccgaatcactgccagatttctccacaccagttcatctccatgattgtcatcaggccgccttcggagattttcaaggaagccagagggctacattcaacattgcaaatctttctactatggtgcaggaaagcccaaattttgatctgcaaactggtccaagtaatcaaattactgagtctattctcaccaccgagccaatgaatggagaaacaaatgctgtggaagaaacaagtcctctgcgctctatgtcagtattgggtagttatgataggcaggatggtgatgatgaattccttgaaatcaatgatttcttcgacccagaagatttagaacagattttgggcagtacaagaagtcagaacttgattcctgctgatgatggagtgtttgatagtttgcaatactctgatgctccaatgtttctgcctggttcatttgacagaactggtgtggtggctgaaaaccattatgttgaatttggtgctagtggaattcagaaccagggatttcagcatacaactgaattattggcacataatcaagtcgctctaaatgtgcggaaccatatgaaggacaaccatgttgtcttctcacattcatcagatgctaccattattcatacagtgaatgagcaaccgcctaaccggagttcaaatgcttcacaatcatggttcaatggggctctatctgccttgctcgattctgttcctagcagtccagctatggctgctgaaaacataggtcttaacagaacactgcaacgcatttcgagctttaggtcacaacaacctgcaagagaagaagttagcagtactcttatcaacaccagaagaagaggcggtgggctaattttcatctcgttaatggttttacttgttgctatcatgtggacctttagcaatgggtctgcagtcaagcttagcaaggggttatggaagtttccctctacataataggatgcacccggttatcctggtggccagtgcttcttactacttcaagtactaattcttgttttgctatcctttcctctattcctttacattgaaaaaggcaacaatctaggaaaatattagaggattatgtggtgttagcacttactttcagaatattatgcgagagatgttaaaacaaaacaaaatgagaaaaagaaacatctgaggtgaacttctggatgtttttgtcctcatcattttgatgaaagtatatattgaatgtaattaaacgatgatggattgttgagaagtgcagttgctgtgcacgataaatgaaaaatccatttttgttgc

SEQ ID NO: 6233 - DNA, 2362 bp, Oryza sativa
  Predicted polypeptide sequence is orthologous to G1928
acacacacttgctcctcattcctctctcctctcctctcctctctctcatcaaccctagcttgatagttgattcaaccagccaatatattcgatctccccttctcttcttctctcgatcgatcgggtgatgagaagccaattgagaatttgagatcgttcgatcatcacctcgtttcttgctgagattatagccaagctccatgattccgtctatgccggtagtgacactgcaaggtgcacaccagtagatagctagtggcagcagcagcagcagcatcagtggagctagtcgtcgtcccggccggccttgccgtcagagatcgatcggtgtaagttacagggtgcaagtgcgatcgatcgccaccggcgcagcgagatctgattgatattgatccatcgccgatcgattgatcatacgttcagatatcataatcagcagcagctggtagaattcaagagaagttcgtccagatgatgctcaaggatctggccgaaattcagcagcagcagctgctcgccgccgccgaggagaacatgtcgaacctgacgtcggcgtccggcgaccaggccagcgtctcgtcccaccccgctcctcctcccgccaagaagaagcgcagcctccccggcaacccagatcctgaggcggaggtgatcgcgctgtcgccgaggacgctgatggcgacgaacaggtacgtgtgcgagatctgcgggaaagggttccagcgagaccagaacctgcagctgcaccggcgagggcacaacctgccatggaagctgaagcagcggaaccccaaggaggtggtgaggaagaaggtgtacgtgtgcccggaggccggctgcgtccaccacgacccggcgcgcgccctcggcgacctcaccggcatcaagaagcacttcagccgcaagcatggcgagaagaagtggaagtgcgacaagtgctccaagcgctacgccgtccactccgactggaaggcccactccaaggtctgcggcacccgcgagtaccgctgcgattgcggcaccctcttctcccggcgggacagcttcatcacgcacagggcgttctgcgacgcgctggcggaggagagcgcgagggcggtcacggcggcggcggcggtggcggggcagcagcagcatggcggcgggatgctcttctcgcaggtggcggatgtgcttgatcaccaggcggcgatggcgatgggggggcatgggctgatgcaagagctgtgcctcaagagggagcagcagcagcagcagcagcagttcgcgccgtcgtggctcacggcgcagcagcagcagcagcagctggaggcgatggccggcgcggggaatccggcggcgatgtacgggtcggcgaggctggaccaggagttcatcgggagctccacgccggagagcggcggcgcgcagcaggccggcctcagcttcgggttctcgtcgacgtcatccgcgccgccgcaccccgccgcctcctcggcgcacatgtccgccaccgcgctgctgcagaaggcggcgcagatgggcgcgacgctgagccgcccgtcgagccacgcccacatggcggcggcggcggcggcgagcacgcacaacagcagcagcagcgccgccaccaccaatgctcctcctcctcctcctaccagccacgtgtcgagcacttgcgtcggcgccggcggctacgggctcgccttcgaagcgtcccacttcatcgcagcagacgagagcagcaggggcgccaggtccgatcgtgacaccggcaatggcgtcgccggagccggcaacgacggcctcaccagggacttcttgggtctccgagccttctcccacggcaacataatgagcatggccggcttcgatccctgcatgtcgacgacgtcggcgtcgtcggcggcgccgtacgaccaccaccaccacagcaacaagccatggcatagctagtaaccacctcggccgccatggatgaatagcgaatgaatcatgcaagcaaatccaaacaaattttgttcgtgggctactcatcgatcgttcgacaagaactgcctgatgatgatgatcatgtcaagattatttcatagctgggtaagtgagtcgaatttacccagctctctctcttttgatgttccaattgaggtttaataattcgatgttcttttgggagggtatgggctgttcaattcatatatatggaacttttcaaattatatactgttgtttatgctagctatatatcatagttaattcatcttcctactgtaataatttttagccattctcagctcataaagctgtgtagagctactgccattagagctccatttgtaatcagttgttaccattaatcattcccttaaatttctagttcctg

SEQ ID NO: 6234 - DNA, 1626 bp, Oryza sativa
  Predicted polypeptide sequence is orthologous to G1928
tggcccgattcctactcgtcactgtgccaactgaaagcgcaggcggcagcgagaacactggattactggcaaagtggcaatgagaaaggagcacggcaagccagccaaggcaggtatatctgagcagaaggcagtaggagtgcaagtgctgcaatcgatcgccatggatggatggaagcaagcaagatggaggaggagggaggaagaagaaggacctggagaagatggtgccgcaatcgcacttgtactcgcgggtgccgcagatcttggagtgggccttccagtcggagtggacggcgtacttcttggagcacttgtcgcacttccacttcttctcgccgtgcttgcggaagaagtgcttcttgatgccggtgaggtcgccgagggcgcgggaggggtcgtggtggacgcagctggcctccgggcagatgtacaccttcttcctcaccgcctccttgctcccccgctgcttcagcttccacggcaggttgtgcccccgccggtgcagctgcaggttctggtccctctggaaccccttcccgcagatctcgcacacgaacctgttcgtcgccatcagcgtcgccggcgacagcgccaccacctccgcttccgggtctatatataggttcgatcaattgctttcgcttaattgccgagaaaattaacggagcccggatcgatcgaggagctagctatacaagaacgcacctgggttgcccgggaggctgcgcttcctcttgttgctgttgttgccgttgttgccggaggatggcggcggcggcggcggcacggtggaggcggaggaggtcaggttggacatgctgctctcctgctgctgatctgctgcctcggcggcctcttccaccaagaacaatcctcctccctcctcctcctcctgctgctgctgctgctgaagatggtgatgaaacataggagcttcgatcttttcttgctacatagcatgcagcatctgcctcaccatggaagcaatgaattttgggaggctcaagtgaagtgatgaagaggatgcattaaaactgaagaatggaggcaggagacaggagggcatgtaggatgaagggagttcagagaatctcaaggaaggaacaaacaagaaggaggaggggagggggggacaaacaaggaggaaactagggtggtcaatgactctaaagcaattttcagattcttctttctttcccttcctcctcctccttctcctctctctctctacagtctacacacactcagagcagaagcagcagcatcaccaagtgtagaacacaacaaggatgctcaagagaagagagagagagaagcaagcagctggaagctagctagccaggcaagcagcagccatgagagagagggagagagagagatcaagggattgggggagaggagcagtagcagtgtgttgcttggcaggcagcagctgaagtagccagaggggagagtggagaagcaaagctgagcaaatggaagaagagaagggcaccaaaaaccaaatcccttttcttcttcctcctctttatctgctcctgcctgctgatcctatactttactttcagggccctgtgtgagccagctaaaaagattaaaaagatttgtagagcagttcagact

SEQ ID NO: 6235 - DNA, 693 bp, Oryza sativa
  misc_feature (51)..(52): n is a, c, g, or t
  Predicted polypeptide sequence is orthologous to G1932
gcaccagtggaggtgatggggcttgctagaacggggaagggggggggggcnntttggctgttgttgggatgcacacgtttaggagtgtggtgcattgttggctttcagcaggttgcgtcaggcagcgcatctgaagctggtttcaggcctgtaagcatgcagagcagcatggtggggtgctggcaggccaggtcaagtgggtgggcaggtacagccagctttgggtgacattcaatgcagcagcagtgtccagagtgaactggtgcagcagctcttgccaggtgcagcaggctggtcgccaagtggtggcggacttgttgaggccacccggcatgtacagactggaaaaaagacagcgttcctgagccacaagttgtgggcccggtgcactgcacgtgtatgcctggcatttggaatgttggtgctccagcttgttgctgctggtgtttttttgtgcgtttggttgctgtcaatgtcttgaagacatgacccagttgcaattgccgggtagaggcggcatgcattgtgcagatcaacagggaaaccacagtttgcacttgtgctgtgtggttggttggggttagtcaggtgatgcaggctttgattccagtggattgtccaaccaatgggcctgtcataagctccccaaactggacggaagtgcagctgtcgtaaccctcaagtagtgaaaaa

SEQ ID NO: 6236 - DNA, 1397 bp, Oryza sativa
  Predicted polypeptide sequence is orthologous to G1935
ggcctcgcctcgccgatcgatcgacggacgacggccggaacatagctgtagatcgagctgaatcgccggcggcggccatgggacgggtgaagctgcagatcaagaggatcgagaacatcccgaacaggcaggtgacgttctccaagcggcgaaacgggctgatcaagaaggcctacgagctgtccgtcctctgcgacatcgacatcgccctcctcatgttctccccctccggccgcctcagccacttctccggccgccgcaggatcgaggacgtgctcacaaggtacatcaatctcccagaaagtgacagaggaggaactatccaaaacagagagtatttgatcaacatgctcacccagctcaaatgcgagagcgacgtcaccgaggatctcactaacacgagcagtaaggcgccggttaactccaacattgaggagcttcagcaagagatcaggagatgccagcaccagatgcagctcacagaggagcaattgaggatgtttgagccggacccggccaggtctgcatccatggaggacgtcgaggccagcgagaagttcatcgccggcatcctcagccgcgtcgaggagaggaagaggtatttgctgtgcagcatgggctcgttcgacgtgacggcgtcaacatctgccatgcagcatctgtatctaccgcagcagcatcagcacggggacatcactgataatgggtttggaagcgatgaggtggcctcgtgggtctctgaggggatgccgccgacaacctcgtcggtggcgtcgatattcgccggaacttcagattccatgatgtcttttagagatcaagcggtgtacgacacgatgagacaagatgcatgtgtggatcagacagtggtcccggagatggggatgtgccatgtggaccagcagaaccagagtgacgactggcaggcgtacacgtcggcggagttcctcaacgcgctaatcccgcccacgccgttccctctcgacgacgaggatacgatgggcccgatgttggcgtcatcaccgctattgatgcccggcatccatgaccagcagccgccggtggaggatatggcgacggcgggctgctcgcaagcgccggctaacgatggcaacgggttatacgcagctgaggacattgctccggttaacgttggttaattagatgcttttgtactagaaatttatggaatatatagtgttgtcatgttactagtgtgccaggaattgaagctaaggatttttagtttggaattttttttctttgatcatgatgggctgggtgtgccacaattaatgttatatgatccatataatacaccatgcacaatgtaagataatgttacgtactagcatgtaataagatattatccagtaagatcgagttatttatcatct

SEQ ID NO: 6237 - DNA, 1014 bp, Oryza sativa
  Predicted polypeptide sequence is orthologous to G1935
atggggagggtgaagctgccgatcaagaggatcgagaacacgacgaacaggcaggtgacgttctcgaagcggcggaacgggctgatcaagaaggcgtacgagctgtccgtgctctgcgacatcgacgtcgccctcctcatgttctccccctccggccgcctcagccacttctccggccgccgcggggtggaggacgtgattctccggtacatgaacctctcggagcacgacaggggagaagccatccagaatcgggaggagattcagcaagagatatattcttcccagcaacagctgcaaatcaccgaggaccgccttaggatgttcgagccagatcctgcggcgttcggcacatccagcgaggtcgacggatgcgagaagtatctcatggaattgctgacccgagtcgtcgaaaggaagaacaacttgttgagcagtcacatggcgccgttcgatgcaacgacagctgcgatgcagggtgcagatgggacgcagatgtacgtgagccaggcggacgggttggccacgttcggtggtgacgctgccatgtggggcccagatggaggcgcggatcctggccatccgatgttcagtgcatctgatccgttgatctacctcagggaccacgacgtgtacgacgccaactcacaggtggccgggctgcacggcggcgacccgtgcgcggccggcggcgccgcggcggcggcggccgcggtggggtgcgtcgacgacgacgtcgccggaggccacgccgccgccgccgacgcgtggaggcaggcgtacacctgcaccgagctgctctccacgctcatccccaccacgccgttccccctcatgccgcattgcctggggccggaggaccagtacctgtcgatggagcatggcatggtggcggcggcgcaggagccggtggaggcgtcgacggcgagctgctcctacgttcccagcgacgagaactccggcacgccggtcatggcgtacgacagcaacccgccgccggcgaacatcgcctga

SEQ ID NO: 6238 - DNA, 528 bp, Oryza sativa
  Predicted polypeptide sequence is orthologous to G1936
tggtgcaaatcaaagaactgctcctcagtggatgttgcctttacttctaggcctgtacggaagtgttacttctgctctaaaagctgcggaattcctcgagcactgttggcctactggagcgctagacagatcgagacgtcctcatccacatatcttctctcgccatttctctcgctgactctgtactctctctttcctcatccacatatcttctacagcggagtcgacgggagaaggggcagcagccgccgggcggggtcgacggcggccgtcgggctggggaggcgacgacggcttgcggcaagtggaggactcgatttgggggtttctttgttttttaaaaaagaatttgtgattcattggatctgtgttatttgatatgtgatgtaattttttttagaatttgtgatgtatttttttgataatttttgacatgaatcttatgatttgtgatgttgttactttgatttggagatgtagggagcaactcgatttggaatttatgatgattttgtgattttgatgaaa

SEQ ID NO: 6239 - DNA, 1856 bp, Oryza sativa
  Predicted polypeptide sequence is orthologous to G1938
gaagattttcttattcttcttcttctcctcctctctcttctcctcttcttgcacctcctcaccttctcctctcctctcctcttcttctccatcaccatccacccatccaactggtccaactcctccaatcgtttgcttcttcttcttcctcttctcgctgttcttggtggaggaggagattagggtttgattagggtagatagagagagaggggttgggtttggttggtgtttgtgtggagatggaccccaaattccccccacccccaccgctaaacaaaacggagcccaccaccaccaccaccaaccagcagcatcaccacgatgagcagcagcagcagcatcgcctccagattcaagttcatcctcagcagcaggagcagcaggatggaggtggaggaggagggaaggatcagcagcagcagcagcagatgcaggtggtggttgcggcggcggcgggggagaggaggatgcaggggctagggccgaagcggagctcgaacaaggaccgccacaccaaggtggacgggcgggggcggcggatccggatgccggcgctgtgcgccgcccggatcttccagctcacgcgggagctcggccacaagtccgacggcgagaccgtccagtggctgctccagcaggcggagccggccatcgtcgccgccacggggaccgggaccatcccggcgtccgcgctcgcctccgtcgccccctccctcccttcccccaactccgccctctccaggtcgcaccaccaccaccaccacatgtgggcggcagcgccgcccacggcgtccgccgggttcgccggtgcagggttctccggcgccgactccggggtgatcggcgggatcatgcagcggatggggatccccgccgggatcgagctccagggcgggggagcgggggggttggggggtgggggtggcggcggcggtggccacatcgggttcgcgcccatgttcgccagccacgcggcggcggcggcggccatgccggggctagagctagggctctcgcaggacggccacatcggcgtgctcgccgcgcagtcgctcagccagttctaccaccaggtcggcgccgccggtcagctgcagcaccagcaccagcatcaccatcagcagcagcagcagcagcaggacggggaggacaaccgcgacgacggcgagtccgatgaggagtccgggcagtagtagccgcgccacctgaatttgttcatccacgcgtcgtctcttcggaggagaaaagagaattctaggaaggacatgcagctaatggaggggggaatggaatgcttttgttactgttgggttgttcttcatgggggtttttatgtctgattttttttcctcgtgtggtgtcgaagctcgaaagaggctactactttgctccggcgacttgttgggatggatcatgatcatcttcagttgttactcctgctgctccatggatggttgccggtttatccccctccaagtgtttaggtgaaagctcaatatttcgcactcgacagtcaacacatgacatgatcttcgaaaggttgcttgatgagcttatgtatctgtgtttgtgttcatttttgcaggtgtataatagccgagagctggatggactggatcatcgctgtcgagtgagtgctttatttgttattgcaggtcgttgtgtagatattcaggtatttttgcagttagagaggtcttctttttttcctttttacgagagtgatgatccgcttatgtgcgacaaatacgatgtccgtcaaactgatcctcacccacgggctgtttctgcaacgcaaatatgatgcatatacatttttagaggcctgattttatatgcttattcttttgtggc

SEQ ID NO: 6240 - DNA, 612 bp, Oryza sativa
  Predicted polypeptide sequence is orthologous to G1938
atgagggcccacatggaggcgccggaggggcggaagatgtggggaccgccggaggatgcgagggcacgccgcgagggagaggatccgctatcagcagcagcagatgcaggtggtggcggcggcgtcgggggggggggggaggaggatctaacgcgggagctcggccacaagtccgacggtgaaaccgtccagtggctgctccagcaggcggagccggcaatcgtcactgccatggggacgggtgtcggcgctgacatccgtcgcaccctccctcccttccccaaactgcgccctctccaggttgcaccaccaccaccaccacatgtgggctgccgccgcggcgttcgccggtgccacatcgggttcgcgaccatgttcgccgcccacgtggcggcggccatgccggggctagagctaggacactcacaggacggccacattggcgtgctcttcgcccggtcgctcagccagttctaccaccaggtcggcggcgccagtgccactggtcaactgccacacccgcaccaccatcaccaacaccatcaacagcagcaggaggacggggaggatgaccgcgatgacggcgagtccgatgaggagtccgggcagtag

SEQ ID NO: 6241 - DNA, 2051 bp, Oryza sativa
  Predicted polypeptide sequence is orthologous to G1946
gaaattccccaccctcaaatccccccctacccacgggccccgatcccacgcctccccctaaccctacccatgctcacgctgtcgcgcccctgaccctcaccacgcctccccatacggatcgcctcatggaggccgccgttgctgctgcggctgcggccgccggggcggtgacgacggcggtcgcgcctccgcccggcgcggcggtcagcaacggggtggcgaccgcgccgccgccgttcctgatgaagacgtacgagatggtggacgacccggccaccgatgccgtcgtctcatggggccccgggaacaacagcttcgttgtgtggaacacccccgagttcgcgcgcgacctcctccccaagtacttcaagcacagcaacttctcctccttcgtcaggcagctcaacacctacggatttaggaaagttgatccagataggtgggagtttgcaaacgaaggttttcttagaggacaaaagcatctactgaagaccatcaacagaaggaaaccaactcatggaaacaaccaagttcagcagcctcagttgccagctgctcctgtacctgcttgcgtagaagtggggaagtttgggatggaagaagagattgagatgctcaaaagggataaaaatgttttaatgcaggaacttgtcaggctgagacaacaacagcagacaacagatcatcagctgcagactttgggcaagcgtcttcaaggaatggagcaacggcaacaacaaatgatgtctttcctggctaaggcaatgcatagtcctggcttcctagcacaatttgtacagcaaaacgaaaacagcagaagaagaatagttgctagtaacaaaaagaggaggctaccaaagcaggatggttcgttggactctgaaagtgcttcattggatggacaaatagtaaaatatcaacctatgatcaatgaagcagccaaagcgatgctaaggaagatcctaaagctagattcttcacatagatttgaatccatgggcaattcagataatttccttcttgagaattatatgccaaatggtcaaggtcttgacagctcttcatcaactcggaattctggtgttacccttgcagaggtcccagctaactcaggtttgccatatgtagctacaagctctggactttcagctatttgttcaacttcgactcctcagattcagtgcccagttgttttggacaacggcatacccaaagaagttccaaacatgagtgcggtgccttctgttccgaaggctgtggctccaggcccaactgatatcaatattctggaattcccagatttgcaagatatagtagctgaagaaaatgttgatattcctggagggggctttgaaatgcctggtcctgagggtgtattctctttgcctgaagaaggtgatgatagtgttcccattgagactgatgagattttgtacaacgatgacacccagaaacttcctgctatcattgattctttctgggaacagttcctggtggctagccctctatctgttgataatgatgaagtcgattcaggtgtactagaccaaaaggaaacacaacaggggaatggatggaccaaagctgaaaacatggctaaccttacagaacagatgggcctcctgtcatcacaccatacaggatgatgaggtacaataggacatacttagccaccatttgtcaaggtaccctgggatctcggtaataaactcccacatcatcacctacccttatgtctatgttatgttctatcattttgctgaaacaatactgaaacgtcaccctatatgtgggaggatactaatcttccacctatgaaacacggtttacccgaggggtttacctgcttgtatctaggtttggcaggcgtaagaattgatcaatggtaacttgtcaaatctgtatgatagctactttgtgttgtagctactgatagctttttttttttgttcttgcctgctctatctgattgcaactaacttctggtagtactggcagtctgccacactgtattgattccaaaattaagtaactttgactgtttcagattc

SEQ ID NO: 6242 - DNA, 1705 bp, Oryza sativa
  Predicted polypeptide sequence is orthologous to G1946
gtctagtacaccagacgacaacacacacacaaaaaaaaaaaagaagagaaaaaccgaacgaaaatcccctcgcgcagacgactactacatccttctcgtctcatcccgtcgacccgccgccgcctcaatctcgaagcctcggcgaggctagggtttctgcgtctccatgggctctaagaagcggtcgcctcagcatccggccgccgcggcgccccctcccgccgtcggcggcggcggcggcggcgaggtctccggcgatggtggcgcctcgacggcgaacgggccggtggtgccgaagccgtcggaggtggcgccgttcctgacgaaggtgtacgacatggtatcggaccccgcgaccgacaacgttatctcgtgggccgagggcggcggcagcttcgtgatctgggactcgcacgccttcgagcgcgacctccacaggcacttcaagcacagcaatttcaccagcttcatacgccagctcaacacctatggatttcgtaaagttcaccctgatagatgggagtgggccaatgaaggttttattatgggccaaaaacatcttctgaagaccattaagaggaggaagaagtcttctcaggaatcacctagcgagatacagaaggcgcctgtcaaaactgcacctggtactgaaaatattgagataggaaaatatggtggccttgaaaaggaggttgaaacccttaagagggataaagctcttctcatgcagcagcttgtagatctcaggcactaccagcaaacatctaaccttgaagtgcagaatttaattgaacggcttcaagtaatggaacagaaccagcagcagatgatggcacttctagcaatcgttgtccagaatcctagttttctcaaccagcttgtgcagcaacagcagcagcagcgcagatccaactggtggagtcctgatggaagcaagaaaaggagatttcatgctcttgagcagggccctgtaactgatcaggagacctctggccgtggggcacatattgttgaatatctcccacctgtcccagaaacatcaggtcaagtaaatccagtggaaggagccatttgttcggccaactcacaaccagttccaagtcctgcagttgccacacccatggacatgcaaacgtctaacgttgctgatactctcggttcatctgaggagcctttcgctgataactctactctacatgaatgggatgataacgacatgcagcttctgtttgatgataacctagacccaatacttccaccatttgagaatgatggtcaaatgggccctcctttgagtgttcaagattatgattttccgcagttagagcaggattgtctgatggaagcacaatataactccaacaatcctcaatatgctgatgtcattaccgaagcttgattggtggtccaggagcatacttgcagtaacattagttcttcggtgaccaacctccgggcgcatctgcaccattggcatcccgaaatggcgtcctcagggtgtaccgatgaattatgctaacacagaagaagatataactctaatctggttgaccatacagaactacctttcttgttcaaggcactttttggggacaggggacgccttttcgcagttctcgtcgtcttacactagcgatggttgctaccatcgaattcatttggtgtatatactgttgttcgtcttataaaacatgagcagttttgt

SEQ ID NO: 6243 - DNA, 1293 bp, Oryza sativa
  Predicted polypeptide sequence is orthologous to G1948
gacgacacccatccctttcccgcctcaaaccccccaaccccaatgctcagagaactccagccctctccatcaccgtccctttccggcttcgtctccccaaccggcggctcaccgccgcggcggtgttccaggaccagaccaacccaagaaacccagcgagcaagggaggcgacgacgatgaggcgtacggcgaggtggaccgtattgtgtccagccgcaccatcaagaatccggtgttcgcggaggacggctcggccaccacggtcaccgccacggagtacctcgtcgagtggaaggacgggcacgagccttcgtggatcccggcggaggccatagcggcggacgtggtggcggagtacgagacgccgtggtggacggccgccaagaaggcggacgcggcggagatcactgcgctactcgcggacgagacgctgcggcgtgaccccgacgcggaggatgcgcaggggcgcacggcgatgcacttcgccgcggggcttggatccgaggagtgcgtgcgcgcgctcgccgaggccggggccgacgtggggcgacccgagcgcgccggcggcgggctcacgccgctgcacatcgcggtcgggtacgggcgtccggcggccgtgcgcgcgctgctggagctgggcgccgagccggaggcccccgacgggcagggccggacgccgctggagctggtccaggacgtgctcgcgaagacgcccaagggcaacccggcgacgttcgagcggcggctggcgctggaggcggcggcgaaggagctggagaaggccgtgtacgagtggggcgaagtggagaaggtggtggacggccgcggcgagggcaagtggcgggagtacttggtggagtggcgcgacggcggcgacagggagtgggtgagggcggcgtgggtggcggaggacctggtgaaggacttcgacgccgggctggagtacgccgtcgcggaggccgtcgtcaacaagagggaggcggcggaaggggaggggaaatgggagtaccttgtcaagtgggtggacatcgaggaggcgacgtgggagcccgcggagaacgtcgacgccgaactcctccaggagttcgagcagcggcaatctggggtggctgctggcggtgatgctccgccgccgccgccggtcgccgggtgacagcgtgtcgccgtcgacggagggtgttcgattcttcctggttttgctgtgtttaacagaacgggataaaatgtttgtgctgctgcaaaatgtatcattagcgctttgataatttttgagttgagcagaactttaacct

SEQ ID NO: 6244 - DNA, 719 bp, Oryza sativa
  Predicted polypeptide sequence is orthologous to G1950
ttttttttttttttttttttttatagatggaggtcttagttgcgcctccgtgagttggaggctttgcaaacactacagccgtacagtcgattctcggagtttggggttagttggatttacagttactttgacgtgcttagttcaaccgaaggagttactagtactgttacaggcataacgcaactcgatgaggtaattaaattgagcaggtaattccttaattctgatgaatcatctttaaaaacttattattttagttttgttcttttggcgcttatcaagctgaaattaaaagtatgcacttttgttttaccacatgtcaggaaatctactatcctatactttcacaaggcaatctgaaaaatgatcagtgcggattttcttttgcttgttacaagaaatgtgattttttttccaatgattccaataggcgctacgcctcttggctatgcaatttatggagggattggggatactgggagctatcttcttgatcatggtgcaaaaccagataagccaagtgaaaaagggtgtacccctctccatctagcagttgaacagggtcccatgtcagtgcatttaccttattgaacatgcgcatggctgcacaacacatgtgtttaccatattatttattgctaggagaactgcaacacttgaacgttctttaaaatgcacggtatccattagtatattcgaaataggacttgaccccggtg

SEQ ID NO: 6245 - DNA, 1010 bp, Oryza sativa
  Predicted polypeptide sequence is orthologous to G1950
tcggtatatggctcatttgagacgcgcacgagatgagcagagtccggagagaaacgcaaacctgaggctcgaagcgtatttctcttctgcgccttcgcttttgcctaagcacgatgtctgctacaatggacatcgacggcgccgccgccagcgccgccgcgggcggtgggagacattcggagaaggagctcttcagcgcggcggagtccggggacgccgcggccttctcctccctctcccccgccgacctcgccgccgcgctcgccctccgcgatgaggacggccggtccctcctccacgtcgccgccgcctccggccacgcccaggtggtgagagtgcttgccgcgatgggcggcgacgcggcggccagcgttgtgaacgggaaggacgaggaggggtgggcgccgatccacacggcggcgagcagcggaaaagctgagatcatctccatcctgctcgatcaaggtgctaatgttgatttgacaaccgatgctggccggactgctcttcattatgctgccagtaaaggacggcttaatatagcagaaacactaatagcgcacagtgcaaatgtcaacaagaaagataagtttgggtgcacacccttacatagagctgccagtacaggaaatgctgaactgtgtgaattcctaattgaggagggggctgatgttgatgcagttgacaaaacaggacaaacaccactaatgcatgctgttatttctgaggacaaagcggttgctcttctgctagttagacatggtgctgatgttgccattgaggacaaggaaggctataccgtacttggtcgagcatctgatagctttagacctgcactaattgatgcagccaaggcaatgcttgaaggctgaaaatgttatgctgcacaaaggttaacgaaggggaacaaattttggtatcgaaaacctgtactaattttttttggttgaatcctgtcttttttaagtatgaaccattctgatctagaatcagatttgatcaactggacc

SEQ ID NO: 6246 - DNA, 640 bp, Oryza sativa
  misc_feature (54)..(54): n is a, c, g, or t
  misc_feature (65)..(65): n is a, c, g, or t
  misc_feature (79)..(80): n is a, c, g, or t
  misc_feature (95)..(97): n is a, c, g, or t
  misc_feature (105)..(106): n is a, c, g, or t
  misc_feature (125)..(125): n is a, c, g, or t
  misc_feature (134)..(135): n is a, c, g, or t
  misc_feature (145)..(146): n is a, c, g, or t
  misc_feature (160)..(161): n is a, c, g, or t
  misc_feature (171)..(171): n is a, c, g, or t
  misc_feature (212)..(213): n is a, c, g, or t
  misc_feature (234)..(235): n is a, c, g, or t
  misc_feature (242)..(243): n is a, c, g, or t
  misc_feature (262)..(264): n is a, c, g, or t
  misc_feature (280)..(281): n is a, c, g, or t
  misc_feature (314)..(315): n is a, c, g, or t
  misc_feature (318)..(318): n is a, c, g, or t
  misc_feature (327)..(328): n is a, c, g, or t
  misc_feature (337)..(338): n is a, c, g, or t
  misc_feature (342)..(342): n is a, c, g, or t
  misc_feature (350)..(351): n is a, c, g, or t
  misc_feature (360)..(361): n is a, c, g, or t
  misc_feature (370)..(371): n is a, c, g, or t
  misc_feature (385)..(387): n is a, c, g, or t
  misc_feature (404)..(405): n is a, c, g, or t
  misc_feature (423)..(423): n is a, c, g, or t
  misc_feature (438)..(438): n is a, c, g, or t
  misc_feature (447)..(447): n is a, c, g, or t
  misc_feature (459)..(459): n is a, c, g, or t
  misc_feature (480)..(481): n is a, c, g, or t
  misc_feature (488)..(488): n is a, c, g, or t
  misc_feature (509)..(509): n is a, c, g, or t
  misc_feature (532)..(532): n is a, c, g, or t
  misc_feature (553)..(554): n is a, c, g, or t
  misc_feature (564)..(565): n is a, c, g, or t
  misc_feature (582)..(583): n is a, c, g, or t
  misc_feature (598)..(599): n is a, c, g, or t
  misc_feature (611)..(611): n is a, c, g, or t
  misc_feature (621)..(621): n is a, c, g, or t
  Predicted polypeptide sequence is orthologous to G1950
acaaccgatgctggccggactgctcttcattatgctgccagtaaaggacggctntaatatagcangaaacactaatagnncgcacacgtgcaaannngtcaacannagaaagatttaaggaaatnagctgaacnntgtgtgaatnntccttaattgaggnnagggggctgnaatagttgaatgcagttgaacacaaacacggacacaacacnncacttaatagcatagctgttnnatttctnngaggacccaaagcggttgnnnttctttctgctagttnnagacactggtgctggaatagttgccacttgagnngancaaggaagnngctataccnngtancttggtcnngagcatctnngatagcttnntagacctgcactannnattgatagcagccaagnngcaatgtcttgaaggctngaaaaatgttatgcntgcacaaanggttaacgaagngggaacaaattttggtatcgnnaaaaccntgtacgtaattttttttggtntgaatctctgtcgttttttaagntatgaacccattctgatctanngaatcagatnnttgatccaactggaccnnataattcatactagnnccaagaattatntgtagtaacntgtcatgtcaaaaaaaaaa

SEQ ID NO: 6247 - DNA, 649 bp, Oryza sativa
  Predicted polypeptide sequence is orthologous to G1950
cgacagggagatccccaacaacaacggcttcacgcccctcaacgccgccgccgtcaagggccacaccaaggtggtggagatcctgctgcaagcgggctgcaatctcaacgcgcgcaacacctacggctggacggcgctcaacgtggccgccgatcacggtcaccaccacatcgtggagctgctgctggcggccggctgccaggtcgacattcccaacaacagcggcttcaccccgctcaactcggcggcgctcaaaggccactctcgcgtggtgcagctgctgctgcacgccggcggcaacgtggagagctcctccagcaagggctcctccgtgctctattccgccgcttgcaagggcttcgaccaggtggtcgagtacctgctggcctggggctgcctgctcgatagccccaacaactccggcttcacgcccctccacgctgctgccagtaacggccacgtcaaagtcgtcgaactgctcttggctgctggcgctgacaaggaaacccccagcaagaatggctggactcccctcaccactgccgcttccaagggctacagtcgcatcatcgagctcattttaagttattaatctcatcttttcgaaaataaatcaacacatcaagatgagatgaaggatcaaaaatag

SEQ ID NO: 6248 - DNA, 1859 bp, Oryza sativa
  Predicted polypeptide sequence is orthologous to G1957
catggtcactttctctctctctcttcccaccatatccccaattccccatagcttagaagcgcacaagactcaatgcaaaccgctctgattcctcctctctctgctcttctccctctccctagctagagcttggcttgcttcctccaaacacagctcgagatcaataggaattcataggaacaacaatacaatacatacacgcatacataggtagatcatatccccctctctagtatcctatagcttacttctttgtaacagtgcctatcctcgaacatcttgcagaggaggaagaaggaagaagaagaaggaggagttgggagagaggagcaagaaatacagccaagaatttgaggaaatagtgatagttttctatggagttcactacaagcagtaggttttctaaagaagaggaggacgaggagcaggatgaggcgggaaggcgagagatccccttcatgacggccacggccgaagccgcgcctgcgcccacgtcgtcgtcgtcgtctcctgctcatcacgcggcttccgcgtcggcgtcggcgtctgcgtcagggagcagcactccctttcgctccgacgatggcgccggggcgtctgggagcggcggcggcggcggcggcggcggagaagcggaggtggtggagaaggagcacatgttcgacaaggtggtgacgccgagcgacgttgggaagctgaaccggctggtgatcccgaagcagtacgccgagaagtacttcccgctggacgcggcggcgaacgagaagggcctcctgctcaacttcgaggaccgcgcggggaagccatggcggttccgctactcctactggaacagcagccagagctacgtgatgaccaaggggtggagccgcttcgtcaaggagaagcgcctcgacgccggggacaccgtctccttctcccgcggcatcggcgacgaggcggcgcggcaccgcctcttcatcgactggaagcgccgcgccgacacccgcgacccgctccggctgccccgcgggctgccgctcccgatgccgctcacgtcgcactacgccccgtgggggatcggcggcggagggggattcttcgtgcagccctcgccgccggccacgctctacgagcaccgcctcaggcaaggcctcgacttccgcgccttcaaccccgccgccgcgatggggaggcaggtcctcctgttcggctcggcgaggattcctccgcaagcaccactgctggcgcgcgcgccgtcgccgctgcaccaccactacacgctgcagccgagcggcgatggtgtaagggcggcgggctcaccggtggtgctcgactcggttccggtcatcgagagccccacgacggccgcgaagcgcgtgcggctgttcggcgtgaacctcgacaacccgcatgccggcggcggcggcggcgccgccgccggcgagtcgagcaatcatggcaatgcactgtcattgcagacgcccgcgtggatgaggagggatccaacactgcggctgctggaattgcctcctcaccaccaccatggcgccgagtcgtccgctgcatcgtctccgtcgtcgtcgtcttcctccaagagggacgcgcattcggccttggatctcgatctgtagcgacctaaagagagaaaaacaaaggaaagttcatcaacgattcttttttcttcttctgttttgatttggtttgttcttcttctcgcagcaacatcgatctcactttctcttgtgattccattataacctgaaatttgatgacagcattaggatttgacatttttgttttgttggccacttaattggaatctttctgttggtttgagaagatatagagaattattaggaaacttgaaagttttcccc

SEQ ID NO: 6249 - DNA, 1941 bp, Oryza sativa
  Predicted polypeptide sequence is orthologous to G1958
gcctcgcttctctctctatcgcaggcgaaggcgaaggcgaaggattcgggctcagctcctccgcctccgccgatctctcgccggagatgtgtcagccctaggagaggagaagctttctttttttggaaaatcgagtcaacaaaaggtcttgccaattaacacagtgaaggataattctggcttgagtgtttgtaaatggagagaataagcaccaatcagctctacaattctggaattccggtgactgtgccatcgcctctgcctgctataccagctaccctggatgaaaacattcccaggattccagatgggcagaatgttccgcgggagagagaattgagaagcacacctatgccacctcatcagaatcagagtactgttgctcctcttcatgggcattttcagtccagtaccgggtctgttgggcctctgcgttcgtcccaggcgataaggttctcttcagtttcaagcaatgagcaatatacaaatgccaatccttacaattctcaaccgccgagtagtgggagttcttcaacgctcaattatggatcacaatatggaggctttgaaccttccttgactgattttccaagagatgctgggccgacgtggtgtcctgatccagttgatggcttgcttggatatacagatgatgtccctgctgggaacaatttgactgaaaacagttctattgcagctggtgatgaacttgccaagcaaagtgaatggtggaatgattttatgaattatgactggaaagatattgataacacagcttgtactgaaactcaaccacaggttggaccagctgcgcaatcatctgtcgcagttcaccaatcagctgcccaacaatcagtttcatctcaatcaggagaaccttctgcagttgctataccctcgccctctggtgcctccaatacctccaactccaagacacgaatgagatggactcctgaacttcatgagcgctttgtagatgctgtcaatctacttggtggcagtgaaaaagctactcccaagggtgtgttaaagctaatgaaggcagacaatttgaccatttatcatgttaaaagtcaccttcagaaatacagaacagctcgatacagaccagaattgtctgaaggttcttcagaaaagaaggcagcctcaaaagaggacataccatcaatagatctgaaaggagggaactttgatctcactgaggcattgcgtctccagttagaactccaaaagaggcttcatgaacagcttgagatccaaagaagtttgcagctgagaattgaggagcaagggaagtgccttcagatgatgctcgagcagcagtgcatacctgggacagacaaggcggtggatgcttcaacctcagcagaaggaacaaagccatcttctgatcttccagaatcttctgccgtgaaggatgttccagagaacagtcagaacggaatagccaaacaaacagaatcaggtgacagataatgaggatgtgatgagggtctctccaagatgtggacccaagtggccattgaatgggctcgatggctatctgactgatgtttggcaaagctaaaattaaatcgtttttgccttttcacggggaacagaacattgttgtgaacagcatatcaaagcttgccccagcgcttgtagctagactttagttgtacagtaccccaaacacggcagcgacgattccgtgttaatgggatgatctttaggtttcagaaggcagcacaagcaaatttgcactgatgtactctttgtcaggtggtttgacttcttgctttctttgttgttagggactggatagcatggattaggaatttgattatgatgaactaattcaagaaattgccataatctttggtaccttgtgcgcctggaacatgtaaatggtaccaaacaacaatatgatatgtttaccttcatgttctatttggcttc

SEQ ID NO: 6250 - DNA, 2003 bp, Oryza sativa
  Predicted polypeptide sequence is orthologous to G1958
ctctcgatcaatctctcctccattcccgcatcctctctctctctccctcctcaccctcacctcatcgtcgcgacaccgaggggaaaaaaaaaagcgatcgccccaatcagattcccccccccccctcctccccacttccctcgtcgcctccgaaaagccaagccgctccccgccgcgccgatcgcgccgccgcagccccagagtgatggactaacattttgggcgagtttgatctgtagaaaggcattcaaactattttatgggaaagaagcaaatcttatgcactatttgcagaattgcagtgagggaagtttgatctgaggcagttgcaaaacaagtatttctggagagatgtcatcctccttgcctattctaccgaaatctttgaaagatatcccaagatcccataatacccagaatattctgatgccagggcaactgccaaatgattctatgcctttgcaccagagtgcaactcaatcttctatttcgcacccaagagccagtgttgtcagatcatcatattcagcaatgttaggatatgctgctaacccaattgattctgtgtctagccatgaggggcattttatggctgctccctttatttctcagtcgtcgaatgctgaaatgctccagtatttatgtaataataatacccatgggggacacactgtgccaacctttttcccagctcctgcctgtggcgcgccagattacatggatactataactgtccctgataatcacacccagagcggctcctctactgttacatctgatgctgctaaacaaaatgaatggtgggcagatataatgaatgatgactggaaagatattctagatgcaacagctactgattctcagtcaaagtccatggcccaaccttccaattctgctgcatcacagcctgctttcaatcagtcaacttcatcccatagtggcgatatttgtcctgtcacaagtcctcctcccaacaacagcaatgcctctgcaagtaaacaacggatgagatggaccccggaattgcatgaatcttttgtccatgctgtaaataagcttggtggtagtgaaaaagctactccaaaaggtgtgctcaagcttatgaaagttgatggtttgacaatctatcatgttaagagtcatctgcagaagtaccgcacagctcgctacaagccagacctatcagaaggtaaaacacaagaagggaaaactaccgatgagttgtctttggacctgaaagcgagcatggatcttactgaagcactgcgccttcagatggaagttcagaagcgccttcatgaacaactcgagattcagaggaaattgcagcttcgaattgaagaacaagggaaatatctgcagaagatgtttgaaaagcaatgtaaatccagcacacagagtgtgcaggatccatcgtctggagatacagcaactccatctgagccaagcaattctgtagacaaggacagtgaggctgccttggacccaaacagaataggagacaaccaccctaaaaattctaccaatgtaggtgccaacctgaaaactgcagcaaccgagtcccctgattccccagtaattgcaactgatggatcggagctcccccaagagaagcgtcgtagagtgcatgaatcttgacagttaactcatctgaatgtagagtgcattcagattatagctgttctgcccatgtacttggtaaaagaaaaatggttccatctatattggctgaaattctagtgctgatccaagtctattgagctgaactatttaaaaggaacataaaaaagcctaatagagaaggggaactgtttggtgtccgcttgtattataattcagtagcaataactcaaatttatctccggtactatgaaataaggagaatttgagatctagccatcttcctgggtacaatttttatttcagggagtcagttgtaaaaggctacggaactccctcttcctccttgcagctcagaagatattgagctaaaaaaaaaaaac

SEQ ID NO: 6251 - DNA, 501 bp, Oryza sativa
  Predicted polypeptide sequence is orthologous to G1958
attttgctcttcattcatttgtgctgtgctctccacgcgccctcgcctctctttcctccgatcctccgcttcgttcgaatcccacaggtgaggtgacctcttctctccagtctcctctccttagtaggattaggatcattacgaatttaggatcgagaatataggattatgaaccagtagtattaggattatgttttcttcgattctttttctccttcaaatcaattcccaattcgatttagggttgacggatacgcgagcagggatagccctcccgcccgcagaaagattgggctttcttggtttccctgtcgtaatcccttctctccagccaacgcggtgaaaattttgtttcggtgggggtggggtgggtggttgccgggtaggtgctggtgcatctgctttcagtttcaccaccaccatggattggccgctaaacatatactgatatacacctgtttcctgtcccctacccctaggctagactactagggagaattc

SEQ ID NO: 6252 - DNA, 1224 bp, Oryza sativa
  Predicted polypeptide sequence is orthologous to G1958
atgaatcagcttcgcaatggaaaagttccccaatatctttcgccagctataactgtagtaccagaactctctgaagttacatttcctagtttttcagagcatagaccatcctatatcgaaagggagcagtgtggtagttctatcaactcatttgatgcttctactccaatgtgtatgttagcttccaactttacatcagatctttatatcaacaaaagtgaatcacctaacggcaagctttcttctgaatcatatgctattgatacctctggatgtgattcttccttgccgccaacacagtcattatacaagggtaatccaagttctttaaggatggtttatcctaaagtatctgaacagaatagttggagtcaagaaccactgcctggaccatttgtttgtccaactagtgttgatttcttcgatcaacaagatatgactatttttgaccaacaaatacaagataacattgcagcaagtcctagcaccaaccttgcaaagcaaaatgagtggttctcatctggcacttccttgcagtatttggaaagttcggtgtctgctggttctgtgctgaaggctgttgatgcgacaagtacaacaccttcaaattatttgcattgtcatgcacagagaaatacatcaaatcctcccaacttcaatgaaatttgttctggtaatatcgcttcttcaaacattgctccaaccaaaccaaggatgcgatggacacctgagctccatgagcggtttgttgatgctgttaacaagcttggtggaagtgaaaaagcaactccaaaagctgtccagaaagttatgaaggttgacggcttaactatataccatgtaaaaagccatctacagaagtatcgcacagttcatcatcgacctcaactatctgatggtgaatctgcgaaaagtggccaaacggatgaagtttcttctcagcccttgaaaggcatggaaaccacctgtgaaggattaagggtccagattggcttgcagaaacaacttcacgaacaacttgagatccaaagaaagctgcagctgcaagtagaagaacacagcaagtacctcgccatgataatcgagaagcagagcgagagcctaagacaactgggagcattaccaagatctctagatgcacccactcaggttttggataacagggaaacgtgcgagggacaaacaggagatgctgattcagcagagcaaaaacctgagaaatga

SEQ ID NO: 6253 - DNA, 738 bp, Oryza sativa
  Predicted polypeptide sequence is orthologous to G1968
atgtttggcccggcgcgcggcgcggtgggccgtgggtcgcgcctcgcgtgcgtgcgggcgcgcgcgtacgtctgttttggtaccattgcaatggcgaagattcgcgggaatgccaaagccaaaccgagcagaggccaccggctgagtggcagacgcactttcaccagcgttgctgttgctgcgcctgcgccgatgagcgaatcgaagaccatgtttgacgccccaagatggatgtctcgtacaacaatctatacagggaaaacgtcatccttacttgttcagttgccccaaagtttccattgtgactacggatccatgccttatactgatagtcttgatgctgttgctgcttgcctgcgacctcgcgaaatgccgtgctactactacagtcgtttaataattaatcaattgggctgtgtcggagaaaatggaaggaatggatcggaccagatccatgaaccatgcggcatgcgcaagaagccagcagaaggcaatggcctactcacgctgtcacaggcctctgccttctggtccattgacgtgcggtttcaacgcagcgtgctgcgtgcaccgtgctttgtcctcggtcctccaaaacccaagttaacctgcttcattcgaacacactctggcatgatactagtagctggattttggtcaccggaattcagctcgtttcggacgttatttccacagctatacagtgtcgagaatttcttgctgggaaatttgcattga

SEQ ID NO: 6254 - DNA, 737 bp, Oryza sativa
  Predicted polypeptide sequence is orthologous to G1968
ccgggacagaccagtttgacctcactgacactgactagccacccaatcccgcgccattgacgccattgttgccgccatgccatcgctgacgcgatgtccctatcggcattgcgtcgtcgccattggagtcgcgtgctgcagctagctggtcctcgcgaaagcaacgccatggggaatccatggaatggaggagaagaagaagaagaaacccaaagcgacatcgacatctccgatgcttctgctgctcctgctgctgctgctgctgcgaattaatggcgggatttcttggtgagatcaatcttctccatctccatgatcacgatgggattgcagactcgttaacaacttcacagcgacatggcaccgaatcatccgaatgaatcggttgaatggaaacgaaaaaggcctggcacgattgggggcaaaaaaaaaaaaaaacccattctttcctgaaaacttctcttcttttttgttctttcttttttttccctggcagtgtgcacgaattggcgctgtgtttgttctatcttttcgaaaaaaaagtttttctttttctctttggtcataaggattctttattggtgtgtatagattagtcaccattttagtgttagtaggtgaggattagggacgacagtgtatttattgatgttttcttcatgtgttcagacactgcaaagatgagatttttaaggcgtaagttgccggcacaaatgcaaagttaatgtgaaaaaaaa

SEQ ID NO: 6255 - DNA, 544 bp, Oryza sativa
  Predicted polypeptide sequence is orthologous to G1990
tgcaggaatcggcacgagggaagaagaagaaccaccgccgtggagacgtaggcgcagcgctcccgattccgcgcgccgccgtcgccgtagccgtcgccgccgctgccgcgccgcggtgtcgacgaaggagccctccgcttgcggccgcttgggtggtcggatctaacatctagggtatgtaccttgaatcctggatttccctgctccgatttcatcttcttggcgtcttcatctctgggacgaacccttgttttctgtatatatgtatataataatagtcagcccgcaatcgtttctgtgttgattagctgggggccagaatttggttggattactactattagtcctgatgttaaggtattattatatacgtcaatcttttgctgctgctgctgctgctaatatttggtttcgtgctgcttcgttaatcgtatttggttttaccttttcgccaatcattgagtttataatccttgtagctattgagtttaatatcaggccgaaatcttggctgctggataggatggcagattgtcctttcctg

SEQ ID NO: 6256 - DNA, 1807 bp, Oryza sativa
  Predicted polypeptide sequence is orthologous to G2011
ggcccgtcgccctcgcacagtatgtcggtttcgaacccgaagcctataaattccgcgccaccaccacctcctcctccacaatggaccacaacaccgaccctcctccgaccaccatggtggacgccgcggcggcgctgctgctggagcccaagctggaggggtacgacgacgacggcggcggcgagccgctgcagccggccccgttcgtctctccgctggaccagctgatgcagccgccgcggccgctggaggcgctgctgcaggggccgcagctgccgccgttcctgtccaagacgtacgacctggtgtgcgagccggagctggacggggtcatctcctggggccacgccggcaacagcttcgtcgtctgggacccctccgccttcgcgcgcgacgtgctcccccaccacttcaagcacaacaacttctccagcttcgtccggcagctcaacacctatggttttcgcaaggttcatgctgatagatgggagtttgctcatgaggatttcctacgacatagcaaacatttgttgaagaagattgtccggcgcaggtcctcaccaacacaacaaagtggtcttcagcctggctcttctggtgaatccggtttagaccctgaactcaacacactgagaagggagaagagtgcattgcttcaggaggtgaccaggctgaagcaagagcaccttcagacaattgaacaaatgagcacgctgaatcagaggctagaatcagcggaagatcggcagaaacagatggtctctttcttggccaagctcctccagaacccaactttcctgaggcaacttaagatgcacagacagcaaaaggaaatcgactccaccagagtgaaaaggaaattcctcaagcatgtaccacatggcaacattgactcaggtgagtccagctcacaacacactggagagagcaatttagatttctcccctacgtccctggaccttccagccacgcacagtgacatcttagaccttcagaattttcttttggaagatggggacctcaatcttgccatgctgccagagaacataggacttgatggaatcgaagcaccagacgacatcggggcgttggttcagggatttgacacacaggaggaacttgagcttggtagcggagttgagctactggaaatacctccagcttctggtcctcgtggccaagatcccacgattggcagatccaagggaaagaatgtattgtctccaggattggatgctacctcttctgaagctgattgcctcggatcattttctgacaatatggggatgctttctgactccatgttacaaacagcgggtaaattgatggatgcagatgatgacgagcgaatttggggcgtcgatgcttcgtcggctttacaaagttcttgcagtggcactagtcagcaagcatatggtagtcttgttagtgatccctatctgatggagatggctaataagcctgaaaaattctgggagctcgattttcaggcactggatgatggagatctgcagctggacaagtgtgttatcgatgaccctgctcttcagcaacagagaggaaatatgaattcgtagatcaaacgcagcttgggagagtaggacctgatgttttatctacctaaaaactatagttcactatgaacattgctatagttatttgatattcaggaggcttgttaactcctgaatatgcgcactatggcattaagaagtagcagtagcagcagtagtatggttatgctttttgttttccattcattcaccctgctgtttttgaatggaaattgttgttgtgtggttttctc

SEQ ID NO: 6257 - DNA, 3124 bp, Oryza sativa
  Predicted polypeptide sequence is orthologous to G2030
gaggggccatcttcctgttacttcaaccacaacaagatatgtcttccaccaacaaaatagacacccacaaccgaaacggatcgagcaaagagaagaaatccaacccatcttcaagttcagagtaccagctgaagaatcaccttctgctgctggccactctggtcgcaacggtaacatatgccgcggggctcaacctgccaggggggttctggcaggacacacaagaagaccatctcgcgggcgacccaatcctaccaggcaaccacaaagaacaatacatcatgttctactactgcaacgccactgcgttcgccgcgtcactcgtggtctgcctcctcctcctcgtcctggacaaggagaactcaggctgcgcagctgccctgcgagtagtcatgctgtttgacttgcttggtctaatgggggcctatgctgccggaagctgcagagatgaattcactaccatctactcctcggtgatcatgtcgatggtatttgcctatattgtgccttctttgtttacctatgcagtgtccaagttgaagaagaaagacaaaaatcatgggaagcaaaacaaggattcgggtgaaccaaaggatactgagaagcaaacctggtatcctgatgaacacaagcgcgaagaactgcatgaggtcttgatgctgctagcaacatttgcagttaccatcacctacgtggccgggctgaacccaccaggtggcttctggggcagcacccaggacggccaccgggtgagcaacccagttctgcaggacatcaactccagacgctataaagcgttcttcgtctgcaacaccacagcgtttgtcgcatccctgctcatcatcatgttgcttctggacaagagggtcaacacggagcaaatgtcattgcagtttggtgaactgtatgggtctattgttgtggttctcttcggcctcgttggagcctatgctgctgggagctgcagggacaccgatgacactgtatacgtcatctgtttgattgctgcaattcttgcatacatcttcctccaggtggctgttacacaattcttaaaaaagaggatcaagaatgatgggcatactgaacgaagtatatcatctgtaaagtcactgatccgtaatgaagatggtagcaggaacacaaaacgcaatattgcaatggaaaaggctcgctcccttgtcatgttacttgctactcttgctgcaagcatcacataccaagcagggctagatccaccgggtggtctctggccagatgaccgggatgggcataagggcggcgacccaatactcctcacgacaaacccggcacggtacaaggtgttcttctacagcaattcggtggcttttgtgacatccttagtggccataataatggtccaaagtaaacatgtactgaagaaccacactctagaggcagctatgctgctggatctgttcgccctcataactgcatatgctgcagggagttgccgggacgtgagcacatccatctatgttgttgctctggcaggtggtgtcctcgtctatgtggtgattcacataatcttcttcacactagacaacatggacaatgaatatcatgatcctgatgaggaggataagaagcgtgaagttttgctgctccttgcaatcttggttgccacgctcacttatcaagctgggctgacacccccaggtggcttctggtcagaggatgataatcttgggcaccaccaccgagcaggctatccaatcctgctcgaaaactatccaccgcagtacgaggcattcttctactgcaacgcgacgagcttcatggcatctatagctctcattatgctccttgtgaacccaaacctatacaggccaggcataaagtgctatgcgctttatgtgtgcatggtggctggaatgttcggcctcatgggtgcctacgctgctggaagctctcggcgtctgcgcacctccatctatgtattgacattggttggtgcagtgtttgccttggtagccttgcaggtagccatgttctggaacaagaggacctctaaaacaggaggcaacatgacgaactcctctgcgcaagaaggtggcagcacagacactgaagcctcacaaccagcacctctgataaaagggatgggatccacttcacaagcaactcagatcacagatattacagatgctgcactgagaaacactgacaaaggagaggggtcatctgaacaaggaggcagcagaataaattctgtcacttctgaaccaggagcccatggcacaggaaatggagcctctctacaagaagccaacagtgaagaagataaatctggatcaaccgagaaggacatgcgggagtacttgatgctgctaggggtcctggctgcaagtgttacatatcaagctggcctaaaaccaccaggtggcttgtggcaggaaaatggcaatgggcaccttgctggccactacatcctccacgacatcaacaagcgccggtactatgcattcttctatagcaattcgatttccttcatggcttctattgtcgtcatcgccttgctgcttccaaggatgctgaacaacctagaaataccggtctggccaatgcatacggccattttgctggatatgctcggtctcctgtgtgcttacgctgcaggcagcaccatgaggtgggagacatctagaaatatcattgctttggttatccctgtgctggtgtacatggcagcctgtacagcgctatcatttttccataaggaagatcaaaaacaaatatctgcatcgacctgccaggcatccaccaactcatagagaagcatcaacatggcgtcatcctttatcaatttgttctaggagaaagagactacctacagggaactagttactatctttctcattttgaaatagaaagccatcaagtatgagtagaaaaggacctgaagatgggtgttgaaggcatacatacacccacacctccttcctagctactgaaccatgccacagttcctctactagattttcaatttaattcaactgaagccattgtgtatgaattaggacgcttaagttgtttgttcgtgtgtattttccaggaggtattatacaaacatcaacctatatgaattattgttggtttttgc

SEQ ID NO: 6258 - DNA, 2818 bp, Oryza sativa
  Predicted polypeptide sequence is orthologous to G2030
gattagcattgatccattcacaacttggagtacctcctttctgcttctatctctcctgcaaatggagaatagcgagcaagagaggacggactcaccattggagtgtgatttgaggaagtacctccttctgttggccacccttgtggccacggtgacatatggtgcaggattcagcccgccggggggtgtctggcaggacaccgaggccgggcacctcgctggtgactccatcatccgggatagccagtatcgccgataccttatgttcttctactgcaacgcgactgcattcgcgctgtccatcgtggtcatcatcctcatcttcatccttgctatcctgcatgagaaggggaagttacagatccccatgcttccactgcgagcagccatggtggtggacctgctaagcctcattggggcctatgctgcagggaccagtcggggtgttctcacagccggcaacgtctctgcacttgtggctactttcatctatatggtggcacagatggtggtaactttatggcttgacaagaaacagactcaggatataagctcaggtgatgagaagaaaaaacggcaccgcaaggtactgatgcttctcgcaacatttgtggcaagcatcacatacatggctgggctgagcgcaccgggtggctactgggataacaaccaggagggccaccatccaggcgatcccgtcctgtgggaacaccactctcgccgtctgagggcgttctttgtctgcaacacaattgcatttgtcgcatccctgctcatcatcatgctgcttctggacaagaagcagcggatcttcttacccctcgacaagataaagatcaccatcaccgtacggacttatgtgctctacgcgtacatcaccattgctcttttaggccttgtgggggcctatgtggctggcagctgcagaaagcctgacactaccatctatgtactcagtctggttggtgctgttcttttatgcataggcgccctccaggcagtcctattttttctgccacaactttcaaacatatcctgcttgccaataattgcaaagttatcatgttcaccgggagggccatcagatagcagttccagaaagaatacaagcagtaagacagatattctggagaaggcccaatctcttgttgtactgcttgccactcttgtggcaactgttacttaccaagcagggctagtcccaccaggtggtgtctggcagaaaaaccaagatgggcacatggctggcgaaccaatactcttatccacacaagccaaacgttacaaggtgttcttttactgtaactcgacagcctttgcagcatcattggttgtcatagttttggtccggtataaacctttgctcaggcgccgcattctagagataactatgattttggatctgtttggtctcatgggtgcatatgctgctggaagctgccgggacataaccacatcagtttacatcattgccttggcaggcggtgttctagtctatgtggtgattcatgttgtgttcttcacgcttgaagacaatgacaaggagaaggaagttgggaacacgaattctgtacgaaatggttcagttgtgcgcacccaaaataattcagctgagggcaatcttgctgagaaagattcatgtattgacaaaaggcgcaagaggctgctccttttcgctgttttgggcgcgaccctcacttatcaagctgggttgaccccaccgggtgggttcagagttgtggatgatggttttgggcgccatgctggtgatccaatactcttttacaactttccacgccgttacaaggcatttctctattgtaactcggtaagcttcatgtcatctctttccctcatcatactcctcgtgaacccaaatctgtataggccagctatacaaagctatgctctttcggtttgcactgtagcaggcttgtttgctcttctgggagcctatgctgccggaagcactcaacatctgaaaacatccatttatgtctttgtgttggtagctgtggtgcttttcattatgatcatactcctggtgtgtttctatcaaagtgagagcaaagagaagcgagatgacatatccaaggagcccgttgagaaagacaaggacagagccaaataccatgccaagcgcaagtacttgatgttgctaggggtcctggctgcaagtgttacttactcccaggctggtctgaacccacctggcggtgtgtggcagggtaatagtgacgggcatggtgtgggtcactcggttatgcatgacaataagaggtatcgctacctcaccttctcctacagcaactcaacttcttttgtggcatctattgttgttatcatcctattgctaccgacggaactgctaaagaagaacaggtggctaagggtgatgaatattacaattgtgctggacttgctcggcctactgctagcctacgtggctgggtcgagcatgagatgggaaccttctggatatgtcattgcatttgttattggtgcactaggctgtgctgcaatccacaagtttttgtcatttgtcagaaggtctcagcaacaggggcaaggaaatgatcagccttctcggttaccagaaggcggcagtcaagcttagatgttgttggcatggtaacgagcggattagagggctcaagtgtagcaaacactcaaaaagtactgccatttttttcttatctccttttcgaggaaataatgttgctatttttggaatttttttaaaaaataatacgattttaatagaaaatcgcaaaaatataggtcggttcgacgaaatcgtaaatttagcaccctgtcg

SEQ ID NO: 6259 - DNA, 723 bp, Oryza sativa
  Predicted polypeptide sequence is orthologous to G2030
atggacaccggcgcagttgaggacggccgcgccggcggcgagctgtgtgacaacagccggcaaaacggtgtcgacgacgctgagctgggtgagaccagccggcagaagaacggtgtcgacgacgctgagctgggtgacaaccggcggcgggagaacggcggcgggcgccgcagtcacgcgccggggttcgaggcgaacaagaacgacacgctgctggtggtggcgacgctgatcacggcgctgacgtaccagctggggacgaacgtcccgggcgggtactggcaggacgacgccgccgacgggagccacgccgccggcgacccgatcatgcgggacaagaaccggcggcggtactggctgttcatggcagcgagctgggccgggttcgggagctcgatgctgctcacgctggggctgctcaccggcgtgccgtcgaggtcgcgcgccgtgcagtggccgttcctggtgtcctactccagcctcgtgctcacgttcatcacgtcgcagtcgcggacgccgctcgccatggacgtggtgatctggggcgccgtcatggccgtgctcaccgtcggcatcaagtaccgccgcctcgacaggctccgcttctggagatacgaaagcgctatctctgatctcgccgggcacagattcgaggaggaagactaccctgttgtcgactacgagtcagaccttcagaccgacatgtccacaacagttagatag

SEQ ID NO: 6260 - DNA, 1888 bp, Oryza sativa
  Predicted polypeptide sequence is orthologous to G2035
gggcgagctcgcacacgcatcccgacgccgccgcgaggccgcggccgccgccggcgacgatggatctcccgccgctctcccaccaggcgctcttcgccgccgtccgatccgcggacgccgccgccgtcgccggcctcctggccgacgccggggcgtccgggcccaccacccaggcgctcgccgccgcgcagacggacgccggggagacggcgctgtacgtcgcggcggaggccggctccgaggagatcgtccgcctcctcatcccgctctacgacctcgaggccgccaccgtccgctcccgcctcgacctcgacgccttccacgtcgccgccaagcaaggccacaccggggctgtgaaggagttcttggggcggtggccggagctatgttcaatctgtgactcttccaatactagccctctttactctgcagcagtaaaagatcacttggatgtagttaacgccatactggacactgatgacagctgcataaggattgtgcggaaaaatgggaagacatcactacacactgctgcaagaatcggttaccatcgtattgtcaaagcacttatagaaagggatccggggattgttccaatcagagataggaagggacagactgcacttcacatggctgtaaaaggtaaaaatacagatgtagttgaagagttactgatggctgatgtttccatactcgatgtgcgtgacaagaaggcaaatacagctttgcacatagctacacgaaaatggaggccccagatggtacaacttctgcttagctacgaggcgcttgaagtcaatgctatcaataatcagaatgaaacagctatggatttggctgagaaagttccttatggtgagtctaaaatggaaataattgagtggctgacagaagctggcgcaaagaatgcacggaatgtggggaaaattgatgaggcatcagagcttaggagaaccgtgagtgatatcaagcacaatgttcaagcacagctcaatgagaatgccaagacaaataaaagagtgacaggaatagccaaagagctccggaaactacacagagaagctgttcagaacaccatcaattcagttactatggtagcaaccctgattgcctccatcgcattcgtagccatattcaatttgccaggccagtactatgttgatagggatagtgggggagacattggtgaagcccacatagccaaccttactggtttccgagttttttgtctgctgaatgctaccgcccttttcatttcccttgcagtggtcgtagttcagatcaccttggttgcctgggaaaccggtgctcaaaagcgggttatcaagattgtaaataagctgatgtggtcagcatgccttagtacatgtgcggcttttatctcattggcctatgtggtagttggcccccagaatgcctggatggctttcaccatatcagccatcggagggccaatcatgattggtactctcttgttcctggcctatctgttgttgcgccctcgcttcaagtttggtgaagatagacagcggcgcatcaaaagggcaagtggcagcaagtccttctcctggtctatccatgaggggatatcagacctggaagcattctctgatcatgagaagagaatttatgccctgtagattgtaaaaggtcttgctttagctgcatgtaacacttaagaacatgtaattggatgaaaacaatcatccctgtatatagttgctcagctgttttaggtctgtggtgaggtggcccaagcagacctttttctgcaccatcttgatggtttgtgtacttggatacttggtacctgctaatgtgtactagtattagcacttaacaatgaagagcacctatgcagtttgaagctatggttacaattccatcc

SEQ ID NO: 6261 - DNA, 1709 bp, Oryza sativa
  Predicted polypeptide sequence is orthologous to G2041
tcaaatgttctcaagccaggtgttgatgtctgtgtgcagtcatctcatacacccgaagcaagttcacaaggaggaacaaacttctgtgttactgcgtcatgatgcaaggcttatcacaatcaagaagaatcatcaagaagataagtgtctctgcttgtttgttgttatactctacaagaaccagtgtcctggcaatgcagaaaaagtgataactgatagaagagcagaggtagtaaccataaacgatattttcctcctgcaaaagcttcaacctgaggtccatgaaggaagcatgaaatggagtttttcaaaggatcgcctctctcttaataaaggcaggctaataagtgctagattctcctcaggaattacacatctgatagtcttgtcgatcttgaggggaatggaattcaacatcaaattggtagaaggccagatcgtttatcaaataatcaaaggagatcaagcacaatggaatcttgattccatggccatccctccaggcttcgggaatacaatggagataatatcattccaattgcgtgatgaggccttgcgcccaacaatcacaaatatccctatcactcatgtgaaaaagaacaatatcacagaagacatgagattcactgtgaagagtgaaatggatagtgaactggatagggcattagatgttgagatcttgtatgagcatgtggatctgaggcgttcaaagcgcttgaagactcagccagatcgctttacaagttacgatacacctaggttccttagtggctacaagaagaaagaagcaagttcatcacccaccaagcatgtaaggggagctgtgcattgtgattcaccggtagacgattccaaaaaagaagtagaatcatgctgtgtagagattccagggaatgttacacagaagcaaacaggtgtacactctcccatggtcgatgaaaagtcaaactctccagaaggacagcataagaacacaactaagagaactacatgctctcttgtgaaggaaaaagcaagctctccagaaggacagcatgagaaaacaacaaagagaactacatgcgctttgcctgtgaaggaaaaagcaagctctccagaaggacagcataagaacacaataaagagaactacgtgctctttgcctgtgaaggaagagccaagctcagtggaaatagaggagaaaagctcaaaagagcaaagtgcaccggagtttcacattccacggacacctgcacagaataaagagaagcataatcgtcctcctttctcatgtaagccgaagctatttacttcatcaggcacccttggtgttaactgtgaaccagcattctgccaaaaggtgggcgggaaaagaaagaggcacatgtgcgagagagaatacaaacaaatgattgaccaatgcataggaaacattgagagtgaaatggagagggactctatgtttaacttcgatgccaatatgatgaattacgttcagcattcttatcgagaagaggattttacatggccaccttctgctgataaccaagaggtggaggaggatgagcttgaagaactgtggaaagaaatggattattcactgacgacattagcacttcttgagcaaaagcaggtgatggctcaaagtaggataaacatgctggtggataattttgatgggttgaggctggattgtttaactttgacggatgattacagatgctattatc

SEQ ID NO: 6262 - DNA, 1604 bp, Oryza sativa
  Predicted polypeptide sequence is orthologous to G2041
ttctaaactgcggtcgttattaaataattttcacagaccaacctggacaaatatgcgccttatggattctttggacaaactattcaagtggcatgcacatccaagcgtcctcctcatgacatactcatctttcttagggatgacgaaacaagactcaaaagtgcgaaaccgataccgagaatttatcgcagaggtcctgatgaacaaccctggactcttgattcttgacgaggggcacaacccaagaagcaacaagtccaagttgaggaagctgctgatgaaggtgaagactgagttcagaatcctcttatctggcacggccttccagaacaactttgaagagtacttcaacaccctatgtttggccagacctcggtttatcggtgatatcatgagtgaactagtgccagagaggaaaagagaaacagttggcaggagagccaaacatcaagaagcagtggcacgccgcgcctttgtggagaaagtgggccagaagattgagtctgacaacaaacatatcagaagtgatggtatcagtttgctaaacaagcttactcgtggattcatagattcattcgagggagcgaagctgatcaaccttccagggatacatgtgtataccgtgttcatgaagcccacggacattcaggaggagatgctggcaaaggtaacaatgcccaagctcgggtcgtcccggttccctctagaggttgagctgctcatcacgattggctccatccatccttggctcataaaaacgacgaaggccgtcagcaccttcttcagtccagccgaagtgaagaaggttgagaggtacaagcgagacttcgcggcggggtgcaaggccaaatttgtgatcgatctgctgcacaagtcgtcgttcagaggggagagggtgctgatattctgccacaacgtgtccccgatcacgttcctggtgaagctgatagagatggtgtttgggtggcggctcggggaggaggtgctggtgcttcagggtgatcaggagctgcctgtccggtccgatgtgatggacaagttcaacggcgacagcgcggggaagaggaaggtgctgatcgcgtcgacaacggcatgcgcggaggggatcagcttgacaggcgcgtcgaggctggtgatgctggactcggagtggaaccactccaagacgaggcaggcgatcgcgcgggcgttccggcgtgggcaggagaggacggtgtacgtctacctcctggtggcatctgggacatgggaggaggagaagtacaacagcaacaggaggaaagcttggatgtccaaaatggtgttcctgggacgctatgttgatgattcctcgcaaaaccgtgtcactgacatcgatgatgaggtcttgaaggagcttgccgatgaagatcacaccggcaccttccatatgattgtcaagcaagactgactctacttgtacctactaatattagtatgaactacgacttacaactgctactgttagctcttaattagtactagtacctccttaggaggaggtgatggcctgatataaaatgtactgctaccatcaggtatcaggcacctcaaccttcaacttcaactaagtgcacttctcctcc

SEQ ID NO: 6263 - DNA, 1914 bp, Oryza sativa
  Predicted polypeptide sequence is orthologous to G2041
atgcagttcaatggaaatgactacaaggacagacctggatgcagcaatatttgccttgatgatgatatacttgatccttctcttcttgcaaacttggcaccagagttgtcagaattgaagaactcagggagcgtgtggagtgcaatatctgatcttgatccaaagctgcttcctcaccagagaaaagcactagattttctgtggaaaaatttggcggggtcgatacaggttgaaggaatggataactcaaatgtcagtacaggtggctgtgtgatagcacacactcctggatctgggaaaacactgctgcttatctcatttctggtgagttacatgaaagctcacccaagaagccggccattggtccttactccaaaagctgcaattcatacatggaagagagaatttgagaaatggggcatttcacttcctttacatgtgttccaccatgctaacagaagtggcaagccgttgggggcaatggattctaaactgcggtcgttattaaataattttcacagaccaacctggacaaatatgcgccttatggattctttggacaaactattcaagtggcatgcacatccaagcgtcctcctcatgacatactcatctttcttagggatgacgaaacaagactcaaaagtgcgaaaccgataccgagaatttatcgcagaggtcctgatgaacaaccctggactcttgattcttgacgaggggcacaacccaagaagcaacaagtccaagttgaggaagctgctgatgaaggtgaagactgagttcagaatcctcttatctggcacggccttccagaacaactttgaagagtacttcaacaccctatgtttggccagacctcggtttatcggtgatatcatgagtgaactagtgccagagaggaaaagagaaacagttggcaggagagccaaacatcaagaagcagtggcacgccgcgcctttgtggagaaagtgggccagaagattgagtctgacaacaaacatatcagaagtgatggtatcagtttgctaaacaagcttactcgtggattcatagattcattcgagggagcgaagctgatcaaccttccagggatacatgtgtataccgtgttcatgaagcccacggacattcaggaggagatgctggcaaaggtaacaatgcccaagctcgggtcgtcccggttccctctagaggttgagctgctcatcacgattggctccatccatccttggctcataaaaacgacgaaggccgtcagcaccttcttcagtccagccgaagtgaagaaggttgagaggtacaagcgagacttcgcggcggggtgcaaggccaaatttgtgatcgatctgctgcacaagtcgtcgttcagaggggagagggtgctgatattctgccacaacgtgtccccgatcacgttcctggtgaagctgatagagatggtgtttgggtggcggctcggggaggaggtgctggtgcttcagggtgatcaggagctgcctgtccggtccgatgtgatggacaagttcaacggcgacagcgcggggaagaggaaggtgctgatcgcgtcgacaacggcatgcgcggaggggatcagcttgacaggcgcgtcgaggctggtgatgctggactcggagtggaaccactccaagacgaggcaggcgatcgcgcgggcgttccggcgtgggcaggagaggacggtgtacgtctacctcctggtggcatctgggacatgggaggaggagaagtacaacagcaacaggaggaaagcttggatgtccaaaatggtgttcctgggacgctatgttgatgattcctcgcaaaaccgtgtcactgacatcgatgatgaggtcttgaaggagcttgccgatgaagatcacaccggcaccttccatatgattgtcaagcaagactga

SEQ ID NO: 6264 - DNA, 1104 bp, Oryza sativa
  Predicted polypeptide sequence is orthologous to G2052
tcttcttctgcccacgagaccggaagtatccgaacgggtcgcggacgaacagggcgacgagcaccgggtactggaaggccaccggcaaggatcgcaagatcgcctgcgccggcgaggtcttcggcctccgcaagacgctcgtcttctacaagggtcgcgctcccggcggcgagcgcaccgactgggtcatgcacgagtaccgcctctgccaggacctcgcccatggcgtctccaacttcatcggggcgtacgcgctgtgccgcgtgatcaagaggcacgaggcgggcctccatggcgagccgccggcggcgaaggcgaaaggaatgatcagcaaggtgtcgagcagctcgtcccttgtcaccgtcgaacaccagctcagcagccggggcaacgcctcgccgtcgttcacgcccaccaacaatggcagcccgctcgtcgacgagatgttcgtcggcggcggcggcggcgacccgttccagctgcttccgagctgcgtcccgtaccatggcggcgacgcgtgcgggttcgacttgccgccgctgtgcatgcctcagactcaggacccgttcttctccgacgccggcttcacgcaggcagcgcctcctctctacggcgacgtcatgggaagcgtgtcggagcacgagctcaagtgggacaccctgggcggctactccggcggcggcggtggggagctctggaacgcggcggcggcgccgctgctgtgcaggcaggccagcgacggcgacgacctcacggcgtggttcacggccgccgacgacaacatgtccgtcttctgaacgagtcaaccatgacacgtgtgctcccgggttagttacacatggcggtatatttttgagccattcctaactggggccccacgtgtcagccactacagacatatgtcatctattatatatgcataaatatgcctataatctgtatggatacagaggtgatgagctttcttttagttactggctgtaatacatcttctctgtagcatcatacagcagagctgggttatgtatcctcttcagttaatgtacttgtaacactgatctgtaagctaaaaggtagtgttgctggtagatcaatcttcatctc

SEQ ID NO: 6265 - DNA, 614 bp, Oryza sativa
  misc_feature (41)..(41): n is a, c, g, or t
  misc_feature (196)..(196): n is a, c, g, or t
  misc_feature (313)..(313): n is a, c, g, or t
  misc_feature (391)..(391): n is a, c, g, or t
  misc_feature (399)..(399): n is a, c, g, or t
  misc_feature (531)..(531): n is a, c, g, or t
  misc_feature (557)..(557): n is a, c, g, or t
  misc_feature (559)..(559): n is a, c, g, or t
  misc_feature (573)..(573): n is a, c, g, or t
  Predicted polypeptide sequence is orthologous to G2057
gaccgacggagaatgttgagaatggactggatggagtgccntggggactagacattgcttttgggctgcaagcaccaaggagtttgcatgggggaacctggatatacgggctacatgactgctttgcttgatgaaacccttggctggaaaagatagttggatggtgctgctgctcgacatgttgttgcgatgagtntgatgacaggtgtgatgcatgtgttgattgaccacactggcctgggcacctggataatatacgaagattcataattagatataaagtgtggaatggaaagacccattgcaactgttnagatgatgtattatgggtgggaatgcttgccggtgagggcaatgaaaagaaatatggaccgagttgttgtgggaacgntgctgatnagcggggcataaaatcccccagggtgttgctgtggtgtggtgccttgtgtgtgatgtgttctgttctttggtttatgcgtacaggttgtaccaatcctgggataatggtcttatttaaagtttaccatgtanaaaaatatgcttgtactggaaccgtncnggctctgagtaatntttttgttttggtttagacacaaaaaaaaaaaaaataaaaa

SEQ ID NO: 6266 - DNA, 1137 bp, Oryza sativa
  Predicted polypeptide sequence is orthologous to G2067, G2115, G2294
tgactggagttagcgagcactgcgcactgagcacctcgacacggcgcgcgcgcggccatggtgaagaacacgagcaacaagtgcattgctgctgccggcgcgacggcggcggccggcttaggcggtggcgcggcgtcgtgcagcggcggcggaggtgatgggaaggtgacgacggcggcggcagcggcgttggcggtgaggccgtacaagggggtgaggatgcggagctgggggtcgtgggtgtcggagatcagggcgccgcaccagaagcggcggatctggctgggctcctacgccacgccggaggcagcggcgcgcgcctacgacgccgcgctgctctgcctcaagggctccgacgccgtcctcaacttcccctcctccgcctcgtctcgccgccgcctcgacatccaccgggggggcacggactcggcggcgggcgacatgtcgccgaggtccatccagcgcgtcgcggccgccgcggcggcggcattcgacgccgccgccgccgccgtcgtcgtcgacgaaagctgctcgtgcagcgccgaggcgatgtcgtcgacgccgacgtcgggagcgacctcgctgtccacgctgggaagctccggcggcggtgacgtgctggaccacgcgacgacgccgtcgtcgtcgtcgtctgccgcggccaacgtttgctcgccgccgctggagggggaccatgagctgtggacggagctggacgcgttcgcgtcgccgaagttcatggatctaatggccgccggcggcacggcgttctcgtcgccgtgggaggagcccgaggaggacggcgagctgatgaggctgtggagcttctgctagcttagctaggagcctaggaaatcgatcgtgaatccattcgcccatgcaacacaatactaccattgatccaatcaatttctcctctctttgagcatcgaaagctaggttaattaggccttggtccatggcttcagttcttccatagattcttcttcttttctttgataatatcttgattaattaatatggttgtaatttatataagtattttacggtgttacactgtacgggttgttgaatgagactgtgagtgcattggatactggttggatttgttccatttctgttctaatttaatttctt

SEQ ID NO: 6267 - DNA, 1497 bp, Oryza sativa
  Predicted polypeptide sequence is orthologous to G2071
ggattaaacctgatttccccttgctaattcgggccatcgcatcactcccccaactaatcacactcctctcttctccgcttcctcttctcgtatatttataaccccacttcccttttcttcctctttcttctcatcttggtttcttcctagtttcgggagaggattttagtgagggatttgaaggattttgaggtgggagaggagatggagttgccggcggatgggagcgcgctggcgaggcaggggtcgatctactcgctgacgttcgacgagttccagagcgcgctgggaagcgccgagaaggatttcgggtcgatgaacatggatgagctgctgcgcaacatctggacggcggaggagtcgcaggccatagcgccggcggcggcggctgcttcggcggcggcggtggttggggacgcgcagcagcagcagcagccgatccagaggcaggggtcgctgacgctgccacgcacgctgagccagaagacggtggacgaggtgtggcgcgacatcatgggcttgggcggcagcgacgacgaagaccccgcggcggcggcggctgcggcggcgcccgcgcagcggcagccgacgctgggggagatgacgctggaggagttcctggtgcgggccggcgtcgtgcgggaggacatggggcagaccatcgtgctgccgccgcaggcgcaggcgttgttccccgggagcaatgtggtcgccccggccatgcagctcgccaacgggatgctgcctggtgtcgtcggcgtcgcccccggcgccgccgccgcgatgacggtggcggcgccggccacgccggtggtgctgaacgggctggggaaggtggagggcggggatctctcgtcgctctcgccggtgccttacccattcgacaccgcgctcagggtgaggaagggccctaccgtcgagaaggtggtggagaggcggcagaggcggatgatcaagaacagggagtccgctgctaggtctcgcgcgcggaagcaggcttatataatggagttggaagctgaggtggcaaaactgaaggaacagaaggctgaattgcagaaaaagcaggtggaaatgatacagaagcaaaatgatgaggtcatggagagaatcactcagcaacttggaccaaaggcaaagagattttgcctccgacgaacactgactggtccatgctgaagccagagtctccggtttcgccgtggcgctcagcttcagagttgcttctctccttgttggtgaatggtgatggctcagtctcttggacggtcgaatgctggcgtcgattactcactaggtttagctgcgagatcgttgcgtgagcaaaggcatactatctaatctgtttaactccttatttagggaaatctggcatggtgaaaacggggcatgccatctgtgtttgttgtttttgtgcagctgttgcatctgctctgtatgttgctgttgcgttgacatgtcatcccgtttacagttcagtgattctgttctgtaccc

SEQ ID NO: 6268 - DNA, 1331 bp, Oryza sativa
  Predicted polypeptide sequence is orthologous to G2094
accaccattccctcttcttctcctcctccttgcttctcccgccccttaacccctactgctccctcccagtagccggtgctaaccctagcttgctagctagattgctctctctggtagtagtagatccgtggagtggagatctgcccgcggatcgagcggcggcggcagagcaccagccgtgtctgcggcgcggtgtgcgcgggtgttgcggagcggcggctgagcggaggtgtgggaggagggggagtgctgcggcttccggggtgttagatccgccgatcctggcgccggagatggattcctcgtcggtcgagaaggtgaagcttccgatccgtgggttcttggggggctcgatctgtggctggaatggcgccttggctgggtggttttttgacgctcgatctgtgggttgcaggggagtgggtcgatagatccggacgagcgcacggcctccggcgagcccaaggcgtgcaccgactgccacaccaccaagactccgctctggcgcggcggcccctccggccccaaggtgagatgagatccgatctgctcctcctgctcttccctttctcgatctgtgcatttttttcgcctgggttttcggtggttgatccgcccgatctgtgtttttttttttgctttgatccagtcgctgtgcaacgcgtgcgggatccggtaccggaagaagagacgggaggcgctggggctcgacgccggcgagggcggcgcggagcggcaggagaagaagaagagcaagagggagagaggggaggaggtgaccatggagctccgcatggtggggttcgggaaggaggtggtcctgaagcagcggcggcggatgcggcggaggagacgcctcggcgaggaggagaaggcggccatcctcctcatggccctctcctccggagtcatctacgcctgaaccaccaccctacctacctacccacctagcaacagcaagagagagagaagcagaggaaaggaggcagccatgggaaagagtgatttgcttgcttaacatgcatgatctcaaccgggagagactagacagatctctaccctttttttttcttctcccctgcttagtttttccagctaattagttcgatcaaagtggaagccaagttaataatgatgatgatgatgtagtagctgctgttcttcctgttactgttacttgttcttgcctagctgtaatgttactagtagtgtttttagtagagcgtgtaacgttgcaatgtaagaaagagcttatgatccatcttctttctcttgttctttgcaagagattagctcctggatctgcaccaagtaatgcagtttttcagctg

SEQ ID NO: 6269 - DNA, 434 bp, Oryza sativa
  Predicted polypeptide sequence is orthologous to G2094
ggcggatgcgccgcaggaaatgccttggcgaggaggagagggccgccatcctggtcatggcactctcctcgggcgtcatctacgcctgaacctccaaccgaatcaacctctggcgccatggcaggaagaagaagcagcgattccttcccctctctttttttccctccccccggcgctatggcagtcaccgaagctagctaataatcaatcttgtcttgtggtgtagtagctcttgttgttcttgccttaagctgtaacgacgtctgtaatgcgactctttgtctgtgtctctgtactagtactagtagtagtagtttaccgcctaacattcaagtttggtttctctgcaatgtaacaagagaagaagaagaagaggaagaagaagaaaaaaagagctaaagctggagcttgagcttgagctttggttattgatc

SEQ ID NO: 6270 - DNA, 455 bp, Oryza sativa
  misc_feature (346)..(346): n is a, c, g, or t
  Predicted polypeptide sequence is orthologous to G2110, G2574
aattatgattagatgaacgatgggtgtcagtggcggaaatacgggcagaaaatctcaaaggggaacccttgcccgcgcgcctattaccgttgcaccgttgcacccaactgccctgtacgcaagcaggtacgtatatacgcgtataaatacgtatttacgtttacaaatacgtatatgattcgaatgatgcgtacttaaattgaagcgaaaatttaaatttgtgttggttttgtgttaatcgatggatcaggtgcagagatgcgcggacgacatgtcgatcctgatcacgacgtacgagggcacgcacagccacccgctgccgccggcgggggggcggaatggcgtncacaacgtcggccgcggcggcgatgctgacgtcttggctcgaccaactccacgatgcaccggcagcggcggcgttcaccacaactgccgttcgcctcggccgttggggg

SEQ ID NO: 6271 - DNA, 1383 bp, Oryza sativa
  Predicted polypeptide sequence is orthologous to G2110, G2574
gctctctccatgcccaggcgagggagtccgccgcctcgcctcctcacgcgagccactgctgtcgccgcaccatcgtactgtcgtcgccatcctcctctcgctccggtcgatgcatccgccaacgaggaggccgggaccgtcggatccggtgaccccggcctcctcgtcggcggaggggagaccgactgtcaccctctctactcttctccttctacgtccggcaccgctacaacgacggccgcgcggatcgcgtgaggcaacgggtggctgctccctactcttctccctctccctctccattctcttcctttgcagatcggcggaggcttgcaacaacaacaacggctgcgtgggtgagcaatcgaggaggccaggaatcaccagatccggaaggacggcggcccggttcggagagggagcatcccgatctgtggcattgaggcccattgtaagtgtcgatggcggtcgttccttcacagtgatccagggccgctgggtctattgagctcggtatcgacggcagcagcagctcgggcaagatggaagaaatgtgtcagacactgcctcctccgagagcatacaccagcgacgaggccaaagtcgatcttccgcaaccccgtctggcattataacttaatcacttcagcttcagcttgcttggagcacgccggcgcagggtttcctcgacgggtcttggctctgccgtgccctcctcgcgccgccctttcatactgacagttgttcgaggttgcctcccccgctcatggcgacctccacctcagttggagttgggaagctcctttcccgacgtccccacaacacggtgaccttggcctcaacccggtgctgctacgctcagctcaacgattgctcaaactacaatgggcaataacaatattgcatttgagggcctcatttttggttgccctcacctgagcatatgtaggatacagcctgtgatgatgccgttagtacagagttgttccctctctcagcctcccaccatcttctcctgtctctctctgagcatcacctccattgctgtcaaggtgatgtttgagctcaatcggtcaaagaaggttgaatatgtaaataatttgccaacatgattttctcatattgggtggtttagtaagttaacacttaataccaatcacttcatttcagcttctcactaacaagcagccaaggtctcttcacggattattgtccatggatggccaagcttttcagcaaaatgaaaaggtgaaatataatgaaatattattcccttgctccataaagcttcagatgtggagtgagcttgctgctctgcaagctgacattccatttttaaatgtagagtgtgcttgaattaatcaaagaagcagatttatatacatc

SEQ ID NO: 6272 - DNA, 1524 bp, Oryza sativa
  Predicted polypeptide sequence is orthologous to G2110, G2574
atggacgtcgtcgtcgagagcccgccggtgagggacgagaagaaagtcgacgtcgccgcgattggaggcgcgcctccaatagtctttgagagttttgcaccatcgacgcagagagattcaaccatcatcaagaaggaggagaagatggaggcagcgaaggcggagatgggcgaggtgagggaggagaacgagcggctcaagacgatgctcacacgcatcgtcagcgactacaagtcgctgcacacgcacttcctcgacgtcgtcaaggtcaaggagcaaacggcggcggagctctccggagacgacgacgacgacgagcccgacgacctcgtctccctgagcctctgcacgaggcccaacgccgccgcgacgcgccggaagggccacgagaggacgccgtcgtccggcggcggcggcgacgacgggcggctgtccctcgggctgagctgcgctcgcggcggcgttgcctccgacgacgacgacgacaagcaggcgagccgccgcgcgttgccgccgatgcccgtgctgaacctcagctccgacagcagcggggacgccgccggcgccggcgccggcgagcctacccagccgaacaaagcgtccaggagctcgagcggcggcggcgatggcgccgacgacgaggtgctgcagcagcagcaggccaagaaggctagggtttccgtcagagtcaagtgcgacacccccacgatgaacgatgggtgtcagtggcggaaatacgggcagaaaatctcaaaggggaacccttgcccgcgcgcctattaccgttgcaccgttgcacccaactgccctgtacgcaagcaggtgcagagatgcgcggacgacatgtcgatcctgatcacgacgtacgagggcacgcacagccacccgctgccgccggcggcggcggcgatggcgtccacaacgtcggccgcggcggcgatgctgacgtctggctcgaccaactccacgatgcacggcagcggcggcgttcaccaccacctgccgttcgcctcggccgtcggcggcggcggcggcgtcgggctgctcggcccgaccaccatctccaccgccacgtcctgccccaccgtcacgctcgacctcaccgcgccgcactcgctcctgcacccgtcgtcggcgtcgccctacgccgccgccgccgcggggtacgagtccagcagggcgctgccggcggcgtggagcagcgggtacctggcgtacggcggcgcggcggcggcgcagccatactacgccaagggcgttgcgccgtcgccgttcggccatcatttcggcatgatgggcatggcggcggcggcggcgaggccggcgccggagcagctgttcggcggccagacgacgtcgccgtacctgcagagagccatcggcggcggcggcgtcgcgccggcggccgtgacggacacgatcgcgaaggcgatcacgtcggacccgagcttccagtcggttttggcggcggcgatcacgtcctacatggggcgcggcggcggcgcggcggcgccgaacaagtga

SEQ ID NO: 6273 - DNA, 791 bp, Oryza sativa
  Predicted polypeptide sequence is orthologous to G2111
gtttttgccctcaaattttcgtacgttgtcccattttttatccatcgtcgcgtcggcttggttgccgcacgtcgctcggagatggagatgtacaggcgctgttctgcatctgaccgaggaagcgctcgtgagtcctgaatttttttttttttttaccagctgggccatctgcccatcgccctaggcctcttgggcttcttcctgcctggccggtcctgctcctgcccagctaaatagttaatgattttttttctgttgtattctctgctttttggtataaataaacgggagaagatcctgtacatgatttatgatgaatttgataattttatcaacccatgcgtttttcatgtaacgtttgtgttgtgtacccttttcactaagccacttttaactgtattcattattttctttggtgattcaccagttgaatatgtaatatttgtatttctttacctattatacatattactagaaaacatacccgtacgtggcaacgggtgaaatctattttaatcttattattgttattattgttatatggtttattattgttatgcttttagtaatacagaaggaatcatataagaaatctatttaaaaaagaactcgcatgctaactactcctaactgtagctcataattttctaaaaatatatatatccaacctaactctcacagtaaattccattttaactaaaccatataacaataataaaattaaaatagccttcacccgttgcaacgcacaggcattttttagcatatttataccaaattttggaactaaa

SEQ ID NO: 6274 - DNA, 513 bp, Oryza sativa
  Predicted polypeptide sequence is orthologous to G2114
gcagaggacgtcacagttccgtggcgtcaccagacatagatggactggaagatacgaggctcacttgtgggacaacacttgcaggaaggaaggccagaccaggaaaggaaggcaagtttacttaggtggctatgacaaggaggagaaggctgcaagggcttatgatttggcagcactcaagtactggggtccaacaactcacataaattttccattgagcacttatgagaaggagctggaggagatgaagcacatgacaaggcaggagttcattgcccacttaagaaggaacagcagtggcttctcgaggggagcatccatgtacagaggggtgacgaggcatcaccagcacgggagatggcaggcaaggattggaagggtcgcagggaacaaggacctgtatctcggcaccttcagcacgcaggaggaagcggcggaggcgtacgacatagcggcgatcaagttccgcggcctgaacgccgtgaccaacttcgacatcagcaagtacgacgt

SEQ ID NO: 6275 - DNA, 3299 bp, Oryza sativa
  Predicted polypeptide sequence is orthologous to G2129
attgcaacagcatcgcaggcgtgtgcgagaggttctacaagcttagcagagagtgtgtctgcaatggctgaaagcaatcctatgaatcgcagcttttctgttgatgatctggtgggcggcatattcaggcttggccaggcgggggcagcttttggcagaaccgattctgaagcagcatttcaggagttcctcaagcgcatccccagcgcgaccaacctagcagccaaccagcagtatgagcccagccagctgcaacagcaggcccagcagctgctggccagcggcagtgcaggggcaaacaacgtgccagcaagcctgcctgaagcaggacaagccggagaaggcggcatgcccagagtgccctcgttggacgtattgcggcagctggtgatgcagaatccaggcttctcagcgccacccgtcagcgtgaaggcagaggggtctgcaggcatgctggcacccccgtctgcagctacaccgcctgctctatcggccccactgccggcgctgtcaatggcgcctgcggtagacccagcctcgctgtcagcggcagtggaccctagcacgttgtcagtgctgggcggagtgccgggcctagcagcagcagcagcagcagccaacccagcacttatggtgaacccagcagctgccgccgcagccgcactgcagctgcagcaattacaagcgccactgcgcatgggcacagtgtctgggcatgacaagtcggactatgataagtcagagacaaggcggcagcgcaggatgctgtccaaccgcgagagcgcacgccgctcccgcaaacgcaagcaggagcacatgcaccttctggagctgcagatagaggatcttgcggagcagaagcgtgagaaggaggccattgcagacatggctgagcgcaagtgccgcaccctggaggatgagaaccagcgcctcagggaggagaatgacaggctgagggacgagctgcgcttcctacgctctgagctgactgagcgcaaggagcgcaatggctactacaggcgtgaacacagttcagacggtgagcaggaggcggagaacggcaaggcgtaccatgcaggcagcaagcggcagcggccatcagaagcagcagctgcagacagcaagggcgctgaggtgctgtacaaccagcagaacggcaagcagcatggcgttggtgagggccaccccacagaccccgctgtggagggtgcacagcagccggtgggcgaggacgatctgcagtaacgtcgcgccagctagcactgctgctgcagctgctgagggctgctggcatgcgtggcttgcacgggtgtgttggatattgcgggcagtgtcagcaaaattgattgtcgcatctgcaacagcagcagctgatgcttgcatatggccatccgttggtgcgggtagtgggcgccctgccactgaagctgctgtgcaacatgcagcacgcaataaaagcgacatgtaggcaccataggccgagcagcctgctgagcagcagctgctgcgcttgcgttgtgagtggtgttgtggtttttcccctgcccaacagctcacttgcctgccttttattgttatttgtgaggacagttattgttttgtatgtgcatatgtggtagtgggcataaggggtgcagcctcagcagcatgtgtttacttagcgcgttgaccatatatctgtgagtgtgatgctgcttggctgtgtgcaaagtggggcgtgctggcaatgccttcgagtgttcctgccctgggcatctgctgttttttcttctttgttgtgactgtgattaacaagctgctagccaaccgcccagcagagtaattggcaattttgtgctccagctttttggggagttgtggggtggaacgcgtgtggcgggttccaagctggacagtgtttatgaccctggtgtgttgggacagtgaccagaacagctagggtggtggtaggcgggacgcagatcatgctgtgcatgcacagcataggaagctgctgatgctccatggatgcttcctggccccaacaacagagattgcgggggcgtggctgctatggttgtgcatgtgtcttttgtgacgttggcgcatcaattgtccgttgctggacgctgcttttgcagctgtgacactctcagcaacagcacagcaacacagcgagcgactcatgcacctactgctacatttactgcaagatgacacgaatggcagcggcacattggtgatcagtggcaggtcgcgtgatggctactgtagatgcagcactctgtgcggtttaccgaccgctgcgtgcgcgctgctgtgtttgatgcacactgaccaactggtcacgtccatggacttgactgatgctcactgcactacatgtgcgggagctcctcaacccacttgctaggttcttttgcgctgatgctacttgtggggtcagcgcggtggcaaagcgttgtcagtgtactgccatgctggcagcacagtttgtaagctggcaggactagcgcccttggcgcacgtgcgtgtgtgcggatgtgtgatgtgtgtgcacgtgcatgcgtgtgttattcctcagctgccttgcgtgcgtagtgggcttttgcacgtgggcgcctgcttgtagcagcatcaacagcagtgcatgctgtggcgcagcaggtgccagtcaccaaacgattgtcttgggggttacactgtgagcacatctcatctataactgtgtgtgcatgatgttaagcaagcaacatactgttagccatggcttggagtcctccgacttttcatacatgttggaggcttctttcccgctgctcaacgctgctgcaatgcagcttctcagtgcggccatgccatggttggtgtgcgactcgcgtgtcactatcgaccgtctgcattgcactgcaccggcggtgagccttcacactgggtgtgtttgtgaggcacgtatgtggtagaggcatacagggtgggtgcatcaacctaccactgcaggattcagagcaggctgacagagattttcccattgtgctgctgggctgcgtgtctagagcacaactctgttggccgtctaacgtacttctgtgtcttatacatactgtgcttcttttgcgtgcgatgcttgtgtcaaccttattggttgtggagcatgtgacagcagcagggatgttgctggctgaatgccggagggtgcaggggttttgagcgttgggcaaccgcttgcagctgtatgggcgattgggcccttgacacggcgactgatgctgacctgttgatgtaacatgggggtgagtaacatgctgatgtaaaaaaac

SEQ ID NO: 6276 - DNA, 1218 bp, Oryza sativa
  Predicted polypeptide sequence is orthologous to G2130
ggtcttcccgcttccattgcaaccccaccgcgccgcacgccgccgcatcgatcggaaccaaaccctaaccctaaaccctagcccccccacctcgccttccaccccccacgctcccatggcggggcgcggaggctacgcgtagccacatcgatcgaacaccctgtatggattgaggtgggtttcccgaggcatgggtacaaaccctagcctgcacgagctggcggcgggggcggcgccgcggggacgcgtggtgcgtatcctcgtgcgcgacgccgacgccaccgactcgtcctccagcgaggacgaggcggttgcggtggcgcagcctcggccgcggcggaggggtaaggtgggtggtggtggtggtggtggtgggggcgtgaagcgccgcgtgatggaggcgggggcgggggaggcgaggccgaccgcgcggttccgcggcgtgcggcagcggccgtgggggaggttcgcggcggagatccgcgaccctcacctccgccgccgcctgtggctcggcaccttcgacaccgccgaggaggccgccgccgcatacgacgccgccagcgtccgcctccgcggttccagcgccgccaccaacttcgcctccgtccgctgctgctcgctgccgccggagctacccaagccaactatttcaccgcctgaagcagctgtgaggccaatcaccttgccaattgggacagctaagccgacccttcttccacgggtgaaggaggaaggtgagagctgtggcggtcgggtcaaggaggaggccagtagctgtgaggtccaggtgcttgctccggagccaatgtggacgatgatttcaggcaagcgtaaggagcgatcgggctgtggaacccgtgtccgtgccttccatgctgtgtccgcctgtgtggaagaagttggcggggcctgagggtccaattatccgtaattactatcgttagcagctttattgttatgcatagcatcattggaaacttggtattgtgtaattttggttagtattgaacttatgatgtgaagatgactctgcatgtgacctgatttggtaaggttatgatgtgtatatacggtatggttgctgatatatgtgatgcagtatggtaggcttcgataaggtgttgtggaattagtatgttgcatctaaataagacctttgatgtgagatatagacatgttcttcgattagaataaaatatagtagaaaattattgc

SEQ ID NO: 6277 - DNA, 628 bp, Oryza sativa
  misc_feature (441)..(441): n is a, c, g, or t
  misc_feature (468)..(468): n is a, c, g, or t
  Predicted polypeptide sequence is orthologous to G2132
tggagatccgatcatccatgcatggctgcttctcccctgcgcctcctcgccatcggcgccgctgctgtacctttcatgcgtggtagccgccacccgccgaggacgaccgagcccgacgccgtgtctaggccgccgagatcatcgtccttcctctgccaagcagttcgccgagcgagccgccgggatccgccggccggtggcggcgccgacggcggccgccgaagaagaagaggaggaagaaggaataaaaaacccttggggggccccccgccatgttccaagaagggggtccggcgaaccggccaaaacgccggaaggccggttgccgggaaaaccctgacccccaaggcaaaaagggggaactggaaggaacctcaccgttcaagagaattttccttcgccggttaagtgtaacttttcttagaaaaaacggggggcaanaatggcggccgggaatcccctgggacnacccccaaacttagaaccgcgaaaatctcttccccgaagggggtaaaactcctcaaaattagaaaaaataatacgggaaattttctggaaggggaaaaaaaaaagagccgtggtgtggggggtgtaaaaaaaaaaaaaaaaaaaccccaagggggggccc

SEQ ID NO: 6278 - DNA, 255 bp, Oryza sativa
  Predicted polypeptide sequence is orthologous to G2138
atgcgcgcgctcgctcgtctcgcctggcagggcaggcggcgcgcgtgcacgacgtacgcgtcgaatgactactccatcccgctcgccggcgtgcaccggcgatcgggagagcaggtctccggaacctctgtcttcgacgttctgcaccgggagaaggcggcaataaggtttttgggaagcgcttcgcgcgactgctccctgttcgttcgcgacggctcgccttcctcttcgctcgcgtgtttcgtgccttcgtag

SEQ ID NO: 6279 - DNA, 382 bp, Oryza sativa
  misc_feature (133)..(133): n is a, c, g, or t
  misc_feature (280)..(280): n is a, c, g, or t
  misc_feature (312)..(312): n is a, c, g, or t
  Predicted polypeptide sequence is orthologous to G2140, G2765
acgacaaccacctcgcttgccattctggactgcgggtgagatcgatggtgacggacggggagtgctcggcggcggcggtgaggaagggtgggtcgccggcggtgcggagccacagcgaggcggagggaagcgncggcagcgcatcaacgcccacctcgccacgctccgcaccctcgtcccctccgcctcccggatggacaaggcggcgctgctgggggaggtggtgcggcacgtgcgggagctgcggtgcagggcggacgacgccacggagggcgccgangtcgtcgtccccggggaaggcgacgaggtcgncgtcgaggacgaggacgacgacgagggcgagcgcgacgaggggtgttattgtcgtcggcggcggcgacaa

SEQ ID NO: 6280 - DNA, 1054 bp, Oryza sativa
  Predicted polypeptide sequence is orthologous to G2140, G2765
atcatgaggtgagatatgatctgatcatcctggtctgacgagcatatccatctatcctacaattaacaaattaatgtgcattattgagttaatcgtcattaattcatatagttgaggattttggatagatggctgcatgccagcagcagatttggcaagaagggaagcagcagcagcatctgcaccacggtggctatgatgatctttcttcagtgtacagaggcacggttgtgctgccacggcggcagggcggcctggcgccggagccgccgccgccgcggccgtcatcgtcgtcggggaggagcgcggcggctcaggcgacggcgatgacgatccacagcgaggctgagaggcggcggcgggagaggattaatgctcacctggctacactgaggaggatactccctgatgctaagcagatggacaaggccaccttgctagccagcgtggtgaaccaagtgaagcacctcaagacgagagccaccgaggccaccacgccgtcgacggcggcgaccatcccaccggaggccaacgaggtgaccgtccaatgctacgccggcggcgagcacaccgcggccgcgcgcacctacgtccgcgccaccgtcagctgcgacgaccggccgggcctcctcgccgacatcgccgccacgttccgccgcctccggctgcggccgctgagcgccgacatgagctgcctcggcggccggacgcggcacgccttcgtgctctgcagggaggaggaggaggaggaggatgctgcggcggaggctaggcctctcaaggaggccgtgaggcaggcgctggccaaggtggcgttgccggagacggtgtacggcggcggcggcaggagcaagaggcagaggctgatgatggagtcgcgttactcgacggcggtcgtgcacacgcacgttgatcctcaatattgctggtacaatagtcgttagtgacaggtaatatacggcggatcgaaaaatggatgtatgaaattcacacctgttatcattttttactcgtagatttactcatgagtaaaaattttatggagatgtgaatc

SEQ ID NO: 6281 - DNA, 1469 bp, Oryza sativa
  Predicted polypeptide sequence is orthologous to G2140, G2765
gaaaagctagaacagctgctgctgcgagttgtagtagtagtagaagaagaaaaagcaagaaaaggttgttgcatagatcgatccatcgatgcgcacgatcgagtttattaattagctcaacgaaagaagaagcatcagcaagaagagccaagaactcgatcgatccaagaaggtaattgatcagctgattggttggtttggttgttgtggtggagatgtgggaagctgtaggcggcggcgacggcacggctctcctgccgtggcccggctcggccgcggccgcgccgctctacatgcccccggcagcagcggcagcggcgcccttcgccgccggcgagcagctgccggtggagcagcccttctacttcgacggaggcggaggcgtggcggggcataatcaccatcctcatcatcatcagtacgggatggaggcgccgccgccgatgacgatgatgcagatgggcggcgggggttcgtcgtcgtcgaggatggtggtgtccgggctgctcgggacgctgcaggcggagctcgggaggatgacggcgaaggagatcatggacgccaaggcgctggcggcgtcgcgcagccacagcgaggccgagcgccgccgccgccagcgcatcaacggccacctcgccaggctccgcagcctcctccccaacaccaccaagacggacaaggcgtcgctgctggcggaggtgatcgagcacgtcaaggagctgaagcggcagacgtcggcgatgatggaggacggcgccgcgggaggggaggcggcggcggcgccggtggtgctgctgccgacggaggacgacgagctggaggtggacgcggcggcggacgagggagggaggctcgtggcgagggcctcgctgtgctgcgaggaccgcgccgacctcatcccgggcatcgcccgcgcgctcgccgcgctccggctgcgcgcccgccgcgccgagatcgccacgctcggcggccgcgtccgcagcgtcctcctcatcgccgccgtcgaggaggaagatccagacgaggccgggaacgacgacgacggcgaacacggctacggcgttgccgcctcgcaccggaggcacgagctcgtcgcgtcgatccacgaggcgctgcgcggcgtcatgaaccgcaaagcggcgagcagcgacacctcctcttccggcgccggcggcggcggtgggagcatcaagaggcagcggatgatcagtgcacatgatcagcaaggttccttcaattctagtggctggtaaaaactcaagtcgatcatcgatccatccattaattcctgcagcctcatcagaagtagcatgaaatatccatgctcttgcttatgcaactcaacttatattagtatagttataaagctatatatagccgacttaaaaaaaacttagagtttggatcttctttttggtgttatggtgtgtgcatgagggaaatcaaaattaaaggaaggagaaaatttg

SEQ ID NO: 6282 - DNA, 1639 bp, Oryza sativa
  Predicted polypeptide sequence is orthologous to G2140, G2765
catccatctccctcccacacgcaagccccgggtactacgctgcccgtccagcgttcaatcgatcgatcgatccccgcggctcggtttgtgttgcgttcttccagatcgatttgatagatgggtgctcatggagaccaccgccaccaccaccaccatcaagaagccggggtgctcgtcgacgaggaggaggaggaggtgatcgagcaggcttgcggtggcccgacgagcggcgtggtggagcaagaggtggggggagacggtggtggagtgtgccaagatgctgccggcatggtgttcgaggcgaccagtagcgtcgggagcgtgagcgccaccatggggccgccgccgatcatgtgctggccaccgccggcgcagtctgtccacggtgcaatccaccaccaccacaacctaggcggcggcggcggccagcagagcccgttcttcccgctgctgccgcccctgccccctcagcccccgccgccacccccgttcttcgccgacttctacgcgcggcgggcgctccagtacgcgtacgaccactccggcggcgcgtcgtcgtcgtccgacccgctcggcctcggcgggctctacatgggtcaccacggctcccacgtcgccggcatgatgatgccgccgcccttcgctccgtcgccgttcggcgacctcggccggatgaccgcgcaggagatcatggacgccaaggcgctggccgcgtccaagagccacagcgaggccgagcgccgccgccgcgagcggatcaacgcgcacctcgcccgcctccgcagcctcctccccaacacaaccaagacggacaaggcgtcgctgctcgcggaggtgatccagcacgtcaaggagctgaagcggcagacgtcggagatcacggaggaggcgtgcccgctccccaccgagtcggacgagctcaccgtcgacgcgtcgagcgacgaggacgggcgcctcgtcgtgcgcgcgtcgctctgctgcgacgaccgcaccgacctcctgccggacctcatccgcgcgctcaaggcgctccggctgcgcgcgctcaaggccgagatcaccacactcggcggccgcgtcaagaacgtgctcgtcgtcaccggggacgacagcgccgccgccgccgcctgcgcggggacggacggggacggcgagcagcaggaggaggcgatgcaggcgcccatgtcgccgcagcacacggtcgcgtccatccaggacgcgctgcgcgccgtcatggagcggacggcatcggccaccgaggagtccggggggtcgggcgccggcggtgggctcaagcggcagcgcaccacgagcctctcggcgatcctagagaacaggtctatctaagcaagcatccacacatgatgagatgtgcaaaacgaaacgaaaaaaaaaaacagtaaaaacaacgtacaccacaccacagtccacactatctcaaagctgatcataataccatgcagctagctagctagattatggatcacatgttccccaagtacaaccgttttccatttctttaattttagttttctctcccattgattttatactagtactgctttgtgtgtgtgaatcttggtgctgtatatctgcatggcatctctcagcaatcaatacaaggccacactctttgttc

SEQ ID NO: 6283 - DNA, 2090 bp, Oryza sativa
  Predicted polypeptide sequence is orthologous to G2140, G2765
gctctcatagtcctcttcctcctcagttcatccttgcctgttgcctactccctcctcaatcctgcagaagtttctgaagagatcaattaccaagaaactgagaggaaacacacagattatctgcacacaaatcatcaccatacttgcatctgtcgttgagagaagatgatcccgttcacaaagcagagaagcaccaagatgaaacgtgccctgcactaagctatgctgttcggcaggagctcggtgaggccagtgatggaagcacgccgccgcacgccaagattctgcaaggcggactcggagtcggagcagaggaagctacggcgtgtcaggctccccttctggtcgtgcccgccgaatcggccgccgggcacctgacctgacctgacctctcttcctcttcctctgcatcttccacttcctcttcctcttttctcggtgtctgaatctctcctgagttgttgaacagcctgaggaagacacgggctacgatccttgtgccatcctgatttgtccctccctgtcgcctcactgtttcacgcgtcctggaagcaagcaggcaaacgacatggcggctctgcttttcttgtgatctgggttggaagcttctgctccttcgatcttcgccatttctgaggcgttcttgggagcagggcccttggtcttgctgctgtctgccaccactctgccctgcttgcccctgtgtgttcttcttgctggctttctcgtccttgtctgaatcttgcaggttcttgtctgtgacatcctggagacgcgtttcaggtgttcttgatcttggagcttatgcctgcgagttcttgggtgcaggaggagttgttagttgttacctttgtctccttcgttgatccattgaaagaggcagtggctgtttgctctttgatctgcatgtcctttggccttcaccgacgacgagatgggctctgctccgttcggtgacgccgtcgccggcggtgggctctatgagtaccaggggtatcacggtggcttcgccggcggccatggtctcggccaaccggccggccgagcgcccgcgttggacgacggtgaaactgaggggatggacgcatccgccgccgccgcagtcgccgccatggagatggcaaagaggaattgtggaggcggccgggaggagaaggcggcgatggcgctcaagagccacagcgaggcggagcggcggcggcgggagaggatcaacgcccacctcgccacgctccgcaccatggtgccctgcaccgacaagatggacaaggccgcgctgctggctgaggtggtgggccacgtcaagaagctgaagagcgccgcggcgcgcgtcggccggcgcgccaccgtcccgtccggcgccgacgaggtcgccgtcgacgaagcgtccgccaccggaggcggaggagaaggccccctcctcctcagggcgacgctgagctgcgacgaccgcgccgacctcttcgtggacgtcaggcgcgcgctgcagccgctcgggctggaggtggtcggctccgaggtcaccacgctgggcggccgcgtccgcctcgccttcctggtctcgtgcgggtctcgcggcggcgccgccgccgccgccatggcctcggtgcgccacgcgctccagtccgtgctcgacaaggccagctccggcttcgacttcgcgcccagggcggcgtcgctgctgggcagcaaacgccggaaggtctccacgttcgagtcatcgagctcctcgtcttgacaagtttcagagaaaattacgccaaagtcaaaaagatctgatcggttgcagtgatttttgcttctgataaattaatcgatcatggttgtaaaagaaagatacaaagctgaagtgagtttcttctttaatttctttctttctttctttttggcaagattaattactgaagtggcttctcaacattggttagcacttagcattttgctgctgcttatcttttcgaagagcgttgtgctccatgcatgattaattaccttgcatttgacatatatatatttgacattttcacatttcactgcaacttcagtttaactagtaactaggagctttgctccttcatgcatgatgcatg

SEQ ID NO: 6284 - DNA, 490 bp, Oryza sativa
  Predicted polypeptide sequence is orthologous to G2140
tcgagctggaggcgtcacgcgcgctgggacgcggccacagctgctacagcagcggcagcggcggcggcagctcggtggcgacgacgacgacgacgagcggcgccgccaatatcagcgcggcggcgtcggcggcgagtgtcagtgacgcccagatcggcgagctgaggcaggagagcgtgctcgagctgggaccaagatgatgatgatgatgatgagagtgatcgagttaggttcagataatcaactagttcttgattgaaaatgttccttttttttcatgggagatattaagctcatttgtattgtactagtaataaaatcagaaagatgtaatgtatataagttgcatgttttttcatgggagatatcaatttcatgtattgtactagtaatcaaaatgtaattaagtggccagaagaacataaggagtatattttgtgccctttgtttcatgtatcttaattactactactatctccacaaaaaaaat

SEQ ID NO: 6285 - DNA, 2323 bp, Oryza sativa
  Predicted polypeptide sequence is orthologous to G2141
gaaactgatcagatcacacacttcagactacagtcaaacagagcccttgcttgctttgcttgtgtcttcaacttcagagaccccctcctaccctcaaaaaatttcccctttcttttcctccgtttcttgcagcgacaagagaaatactaatactcctcctcctactactgctactgtgcaaggggaaggacacgacgacgaattggagagcggcgtcctctctgatccttttttttcctttattgcatctctctctctctctcgccatttttcttctaggttggtctctggatcaggccattgagggggaaagaaaaggtgcgggttttggggggaggttgttcttgcgggaggccgttgatttcgccgtgtgatcggagggagtgaaaaggagatgaatgagaaggacgccactgatttggaggagaggagtgaggccagtgagcacggccaagctctgagtttccatggtggtgccatgttcttgcaagaggctcagattgcttctcctgcagctgcaaataatgcattgacctccatggcgaatcctttccctatccctcctgggttgtggaatccaccttcacacaacatgggtttaggcgaaaccagtttttcatccttgttggggatgctgtcggccggcgcgccgccaccgtttgtggctactcccgggtttgtagattccacggcggggtttccttgctacaatggaggcaatcttggagccatgatcaatcaccctttccctggtatccaccagcctttgggtgatttccaaaacggcgtcgagccatgtagggagattgaggatattgagattgaaggatccaagaatgtgtcacaaactggtgagaagcagcaaggggatggtgagacaacgcatgccgtcgattcctcctccaaggagctaagcatgccagggcgcaatggtggcgctggccatgatgaggggactagggtgtcttgttccaagaagaggaaaagatcaggacaggatggtggggtgaagcatgcagaaggtggtgagcaattagcaactgtcggttcagcgcagaagaatgaggatgatgaaaagggtgaaccagagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacggctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcctattggcacagatgtttttattccagcaaagctgtgaattctgaaagagaagaaaagagaactgtgatcc

SEQ ID NO: 6286 - DNA, 2140 bp, Oryza sativa
  Predicted polypeptide sequence is orthologous to G2141
gaatatgaaattttcttgattcttgaaggatggtggggtgaagcatgcagaaggtggtgagcaattagcaactgtcggttcagcgcagaagaatgaggatgatgaaaagggtgaaccaaagaggtcttctgtggcgtccgggaaatccagtgggaagcaaataaaggataatgcaggttcaccaaaggaagactatatacatgtaagagcacggcgcggtcaggctacaaacagccatagtcttgccgaaagggttaggagggagaagatcagtgaaaggatgaaatatcttcaggatcttgttcctggttgtagtaaagtaactggtaaggctgttatgctggatgagataattaactatgttcaatcattacagaggcaggttgaggtatgatgtttgtaaaacttgtagggccattttcagttttacttgcatagtcctgctgcgatgtaatctggtatacccaatgtgtgcatgttgggcagtttttgtcgatgaagctagcaagtgtcaatccaacactggacttcaacatagaacgcattttatctaaagatatttttcaatgtcgaggcactactgcatcatctgcctttggcttcttcccagacattgttcatccccgattacacccaccaaaatatacacaagttgggatgcccagcattgtgaaccccactgatgcatttggaagagtaatccatgctccattaggaactaacagtgcattcaaagaacctaaacatcaggtttgtaccatcacttgcatttggctaaatggccattttcatttcatgctctttataccaaatactgtgttcatgaaaaataggacaagtttctgcaagatgttccaagacctaatttagtgttatatggcttggtgtttcgagaatactgctccacagatagtcgttgaaaagaatgtccacataatattttaaaccaagaaaagctagtcccctttatatccttttgctgggtcttgcttcactacccatctttccaaaaagttcgtgggtcttaaaagcaaagcaaactagataacataactaaactgagacattttagacaacaaacaaaattcctactatctgtttttcataactagccagattgtgcctgattcttttggccatgcaagctgtttgaacctagtccatcaatcagtctctttagcttctgactcattaaccctcttcaacctgattttagtgggaagagcattgttgatgttaaccgacattgtaacctcagtagcactaaccatttcactagtaaaccaactaaaaatgtacaaatgcagcttgttatatatctaattgtatcttcatcactacatatttgccttcacagttatctaaaacatatgctttcatattcataaacatttttttggaaagcggagtaccaaagcactgttttagtattttgcaatcctcttattacttgtgcattggacagatgcccaacaatttgaatggagagttccaggacgtcattgagatgccttttactcatgaccatcatggatcaaatgatcaaccctgagattgattccacaactgaagcaagagatcaatatgtgccatgggctttcagcaaaactgtgatatatgagcatgttgatatcatggtactagctcacagctgatcactgaagtataagcatccaaaatgcttagttagtgctatttttctcatgttcatagcagcaattgacctcctgtggaagcctctctttggatgttccatttgctgttatagaaagttgggagataaaaaaaaaaggatgttcacatggagatctcaagcaatttgttctccactgaagtagtctacagtcttgaaatggcgagaagcttcattttgcaagaaggtgatttttctgtggtctcgtcaaccccaggattattacatacactagctagcattgtgaggctacagaaattgttctttgttgtacttgcttagcccatgttccatctgacaagcaacataggcagaaatgcagtcactgattttgtatttgttgaaaaaaaaaataaatgggcttggcctgatgtagcaagcatttgaattttgcaacgggtgcatattggcacagatgtttttattccagcaaagctgtgaattctg

SEQ ID NO: 6287 - DNA, 2079 bp, Oryza sativa
  Predicted polypeptide sequence is orthologous to G2141
gagtggtagtctatgatcttctacctctcttctccctcttgctggaacatatagcatcagaatcctcactgggcatctttccttttcttgccatatctggccataggctacaataagagttcttgcttgcttctcctcctcctcctatcgcattgttcatacagctctgatcaagctctctaagcatcgatcacttggttcttgctcatcatctttcgcttgctcgtcagctaggaattcgtagtcttgagccgaggttgggtgattcgatggacatgagcgagagcagtgagaaaggaatggagagcaatgcgtcgtctggccctggcaatggcatcccggtggagtggcagagccaattcagcagcgccttcgcgtgccagccgtcggtggcggcgcagcaccagcagcacgccatgatggactccttcgcggcggcgtccgccggcctgtgggcgtcctccgacgtcgtcagcgccatgtcatcggccgcgccgccgcggggcgcggggttcttggcgccggtgcccgggttcctccagcaggggctcggccatttcccggtggactccggcttcatcgagcgcgcagcgcggtcgacgtgcttcggcggcgggatgatggccggcggcccatacggcgcagctgaccaggccatgggcgacgctttcggtggcaccgcggagggtctcatggatcatcacaggaacgttggcaacgacaaggccgaggagttcgccggcaacggccacgacgaggtgccgagctcggaggtagccggtggagactgctcctccaaaggttcagactccaagaagaggagaaggcctaacgaggtgatgggaaccgatcaagtccattcttccaacttgccatctgattctgcgaacgagagtgttcacagcaaagacaaaggcgaggagagcagcccggcgacgacgaacggcggcaagtcgaaagggaagggagcaaaggagacctctgagtcacagaaagaagagtacattcatgtccgggctcggcgtggccaggcaaccaacagccacagcttagcagaaaggttgagaagggagaagatcagtgagaggatgaaacttcttcaggacctagttcctggctgcagcaaggtcaccggaaaagcggtgatgcttgacgagatcatcaactatgttcagtccctgcaaagacaagttgagttcttatcgatgaagcttgcgacagtaaacccaaggcttgacctcaacatagaagggcttctttcaaaagaccttcttcgcttccctggagttccttcatcctctatcggattctccccagaaatgatgcatcctcaactacaattgtcacaaccaggactgattcatggtggtaccgctggcatggccaaccccgatgtgttcagacgaataatacaagcgcaattaggtgcaaaggatggatctcagatgccccactcattgaatggatcattcagtgacgtttcccaaatggcgtacccgtccctcggttctcaggacctaagcatcaggccatctcaggatgggtttcaaatgtgaagaagacgaagaagaagaagatgatgatgatgagggggccaattccatgtacgtgcaattgcttctggcatctggtgaacaagggcaggcacacgcacatgactgaagcttgctactactgctggagaagcagcgtttgcagtgctgctagctcatcgcgtaactgaagtctgaagggcttttaattccttccgtggctagctgtatatccatcgaggttttattgtgttcagaactgaaactgaaaggcttttgagccccacgtacagggacgctggaaacgaaaaatctgcgtccttgatggctggaaattctgtctggggagcgtgcatttacactgcagcacgaggagcagcaggcaggcagctgaatttgctgcagggctggcacaatgcaagatcactcatccggtggctttgttaagttacttccgattcattgttggttgcgaaaacgattaaacaactcatcataaacgtggcgctgaatggtgttaatgttaagatcaaacacatttgactcc

SEQ ID NO: 6288 - DNA, 1098 bp, Oryza sativa
  Predicted polypeptide sequence is orthologous to G2141
atggatgctaatggcggcaatgggtttggagtagagagcaacgcttcggctgtccatggtggcatggcgatggcttggcaatggcatggcggccagatgagcggcggcagctcgtgcgctgcggcgccgccgccggtgcaacagccggcgatggattctctcgcgtggtcgtcgacggtctcgccgagcaccggcgctgccacggcggcgagcggcgccggcttcttgctgccaccggcagccgtgcgcggcggcttcggcagtttcccggtcaactccggcggcatcgtcgagccggccggtgactgctcgtcggagtccaagaagaggagatcagacgagattgctggaacggatcacgcgaacgcatcgaacgcgcttgccgattctgggaacgagaccgagtgtagcaaagatgtcaacggcgaagtgatcggcccgccggcgacggcggcggccggcggcaagtcgaaagggaagggagccaaggacgccggcgaggcgcagaaggaagggtacagccatgtcagagctcggaaggggcaggcaaccaacaaccacagcttagcagagaggctgagaagggagaagatcagcgagaggatgaagctcctgcaagaccttgtccctggctgcagcaaagtcaccgggaaggcgttgatgctcgacgagatcatcaactatgttcagtccctgcaaagacaagtcgagtttctgtcgatgaagctctcggcagtcaacccaagaatcgatctcgacattgaatcacttgtcaacaattccaaggatgttcttcgttttcccgggcagccttcctctgctcccatgggattctccttctccacggagatgatgccggggctacaattatcacgaccgggcatccttcagggaggtgtccatggcatgatcaatccagatgtgttcaccagcctcatgcagaagcagcagcaaaatgacaagggagcattcagagagcctcagatgcatcagactttggatggatcattccgtaacaccgcacaaatgccgtatccacaggtcatgagttcagaagagctaagcatcaggcaagatcaagatgggtttcacatgtga

SEQ ID NO: 6289 - DNA, 1982 bp, Oryza sativa
  Predicted polypeptide sequence is orthologous to G2142
gggagagagaggaactgaggaagcgaagcgaagcgagagaggaggagaaagcccggagagcttgccctcgccgcgccgcggagatccgcttccccatccccccaacacgtcgccgccgccgccgccttccttgctgcgcggggtaatgcgcggccatgggactgcaagggaataaggcgacgcacgacttcctctcgctgtacgccgccgccgccaccgccacggactactcgccgctcccgcgccacccggactccaagccctcggcgccggcgccgccgcccgctcaagatttcttcctcaagacacacgacttcctgccgcaggtagagaagagagccgaccagacaccaccgccgccgccgccgccgccgccccacgccgcggtcaccgccgagaagcagctgctccaccagcacgcgttggccgccgccggcgcgttcaccatcaaccacgccgtggccgcggccgccaccgccgtcaagcaggagccgcccttcgcgccgtggtgccagcccgtcgccgccgtagatccccgaggtcaccagtggtcgctccccttcgccgcgcgcgccgtcgccgtcgcctcctccaggccgcagcagcagcagcagcagccaccgccgccggagaggaagggtggcggtggattcatggacgccggctccagatccagtggcggcgcgggcttcgacgacgacgacggccatgccgcgcgccgcgaggtctcctcctcgctgaaagagctcacggtcagggtggaagggaaaggtgggagctgcagcggcagcgctggcacggatcagatgccgaacacgccgcgctcgaagcactccgccaccgagcagcgcaggcgcagcaaaatcaacgacagatttcaacttcttagagacttattgcctcataatgatcaaaagagagacaaagcatcatttctcttagaggttattgaatacatacggtttttacaagagaaagtacaaaagtatgaggtttcatacccggagtggaaccaagaaaatgcaaaggttgtgccatggacaaacatctatttccgttcttcctggaaaaatgcgcagaacaaaggccaagttcctgcagatcattcacctgaccctccagaacttctgaaaaatggttccccctatatgttcccttttacagggaactctgataataacaatgcagttgaaactgcagctgcttcaggtgcacaggatcaggcagaaactgatccaatgagtcgtgtgtcttacagatcagtggacactcccagtcccaataatgttgcagacaaagttacatctcagccacacgctcaactggtgagaccatcacctgcagagaatcacacagtaaactgcgacaagttaaataattctgaccttgccatcgatgagggaacaatcagtctatcaagccaatattcccaagagttgcttaacaagttgaatcatgccctggaaaactcgggtatagatttgtcccaagccagcatctccgtgcaaataaatcttggcaagagggctatgaagagatctactcctgctgcaacctccacttctaaggagctcactgatccggcatctaatagtcaagcaatgggccgtcagcttaggttgggtgatggcgctgaagaacatcgacaagcctcaaagcgacacaaatcagataacagctgatggtttgctcctgaaaaccccagatattcaaccattttttgctcctaactgtgtacggggagccccaaggttttatgtatattaagtttacctgtgacgtctcgacaaaacaaggccttgatgtattctttcatttaatcacttcgccgttctagcccctagggaagaaaggaagcttccattgcagattgtgaagctgcttttgtccatatgcttccattcatatgagaagtttctcccaccctctgacagaatgtcttttgtaacataattcagaaatgagctatccaaagttccatc

SEQ ID NO: 6290 - DNA, 1003 bp, Oryza sativa
  Predicted polypeptide sequence is orthologous to G2144
ggcgagaagagggcaagccaccgacagccacagcctcgccgagcgggcgagacgcgagaagatcaatgcgaggatggagcttctcaaggagctggtccccggatgcagtaaggtatcaggaacagcactggtactggatgagatcatcaatcatgtccaatctcttcaaaggcaagttgagtacttgtcaatgaggctcgcagctgtaaatccgagggtcgactttggtgggctagacaacttcttgactacggagtgtggaaggataacaggcttgaactacaagaatggaatggatttggagcaggtcacctggccagacatgggcgtccatggagcaaggaatctcatgcaactacaacagcagttctggcatggtgatttagcacacccgctccagccgccttcacagtgggaaaagcggacggataccaatccccctgtctttagcaattcaagttcctccctcttcggctatgatctagcaagctctggagcgccggcccagacaggcaacaagctaaagacggagctgtgagcctgtgaccaacggtggtggtagtgatagcaagcaggtcagcagagcaagccaaacaaacatacgtgagctgtggacaatggcggctggatgtcaggagagctagctagctagctaggcgtgagctgtggactgacggctgctgctgctgctgctgctgctgtggatggttggcaacgtcttgtgcagtgcagcagtgcggtgcatgggactttcattgattttggaggccggattctgagacgatgtacatatggaatgcaagatatagagagatactgttgttgctgttgttggagactcttggagctggaggtgatggatatggaggttttactgctgctatctttttttgtagagatgagcgagagatactgtggattcttttcttgctgatgtattcttggtgtatgcctgactacgatggtttaatgtcaaggttatatgagcagcatttatttggtg

SEQ ID NO: 6291 - DNA, 753 bp, Oryza sativa
  Predicted polypeptide sequence is orthologous to G2146
atggcgaaggtgcgggggaaggcgggtgcgggtgcgggcgccgcggcggcggcggcgacgaggaccaagtggaggagcggcgcgcaggagaggatctacgggcggcgcctgctcgacgcgctgcgggccacgcgggacggggctgcaggcgggggcgggggcgcgccgccgcagccgcgggcggtgaaggccgcggcggactcggcgctggcgctcaccgcgcgggggcagtcgaggtggagccgcgccatcctgctggccggcgcggcgtcgtccaggcgccgcgtgctcgtcaaggccggcgggaagatccgccgcggcggcggtggcaacagctgccgccgcccgcaggcgcgcgccgcggcggcggcggcggctaaggcggccgcggccgcctcctccgccggcgagcccccgatgctgaaggagaggaaggtgaaggagcgcctccgcgtgctgggccgcctcgtccccggatgccggaagctccccgcgccggcgctgctcgaggagacggccgactacgtggccgcgctggagatgcaggtcaaggccatgcgcgccctcgccgacgcgctcgccgccgcgcagctctcctcgtcaactccgcagcaggcggaggccgccgccgacgagaccgagatggagagggtttgggatttgaggagggtaattgcgatgattgatgctgctgataatgctgctgctgctgctgctgctgatgatgatgatgatgacgatgatgatttgtaa

SEQ ID NO: 6292 - DNA, 644 bp, Oryza sativa
  misc_feature (2)..(52): n is a, c, g, or t
  misc_feature (589)..(644): n is a, c, g, or t
  Predicted polypeptide sequence is orthologous to G2146
tnnnnnnnnnnnnnnnnnnnnnnnnnnnnnnnnnnnnnnnnnnnnnnnnnnntttttttttcctagcaacaaaattcaataaaatctggtgccatgcattcacaactcctaagcaccagcagctagctaatctgcatttgttgctgctacttccatgttccgacgacaggggcaacagcaccaggaggtggaaaattcaagtggcagagcttacactagaattcctacttgcatctagcttgttgtcccactatacaaaataacatgcgtttgcctgccagcctagcaagaggtgaaagggaacaagtaatgcgtacgaagagtagaaacgaacgaaactcactacagaagattcaaacgcgcgcttacacgagacctcttacgagacacacgtaacctgtggcgcccacgcatcattctcatataggcttctccggcgtgacggatatttctttctccggcggcgagccgaggccggacaggaggcaggcgagcgcgcgcatgacgccgacctgcgcacgcaaagcggcaatgtagtcggccgtctcgtccagcagccgctccaccgccatcgcctcgccccccgggnnnnnnnnnnnnnnnnnnnnnnnnnnnnnnnnnnnnnnnnnnnnnnnnnnnnnnnn

SEQ ID NO: 6293 - DNA, 809 bp, Oryza sativa
  Predicted polypeptide sequence is orthologous to G2146
ctgcggtacggtctggaatccgggcttatctctctggattggatcggcgggcgagcggcgtcgggcgggcgctgcgacgacgatgtgcgggcgagggctgaagcggcggtggcctcggcccgcacgcccgggcctacaatgcctccaagcataccatcgtgatgccgcctgcgagctcggcgcccatagcatccgcggccgtctcctccgccggtgagccatcgatggtgaaggagcggctccgcgtgctgggccacctcgttcccggatgccggaagctccccgcgccgatgctgcttgggccaactatgtggccgcgctggagatgcagtcaaggccatgttctcatagacctcttggccgccaccgccggtgacgcgtgcgacaggggacgccgcgtcaacgggcagcgagcggcacatgacgtcggagatcgagcagtaccgccgcagcgacggcggtggggcgggcgcgaacatgcgcttgcgggtggcgatcgatcccctcgtcgattaggataatgagaaaggtaattacccaaagccattttgatttactatcaggcttggttacgggcagcaatcaattggttggtttgccttgttgatcaatcggagaaggaggtgcaggtggcggcgttaaaaacaaaaacaaagggcggcggacaaaaggaccaaggttagaacgcgttaattaaggcaaaaccttcatagttcaccaaaatcatcacggcggcgttaacagttgcagtgacaactgcttcccatatctgcttaaaaaccattagatggtaaagaaaacgacgaaca

SEQ ID NO: 6294 - DNA, 491 bp, Oryza sativa
  Predicted polypeptide sequence is orthologous to G2150
ctagtggatccccgggctgcaggttttttttaagggtagaaaaaatctgagtgatttttggttagaaatcatccgacaaagggatagacagttccagtcagaaaaataaaaagaaaatgaaagaaatgaaggcctcgaagcctcgtcgtcatcgctgcttgacggagaccgccgctcgccgttcttgattcttcccctggtgccccgccgttctcggctcttccccctggcgcctcgccgttcaccaccgtcgtcagagtttgaggccgctgaatccagatcctttggagccatggccaccggatctggcccgtcgcaccttgtgaaggacagaggtgcagtggtggctagcgaggaacacatcaccggcaatagcaagaccgaggggaagacaatggaggcggcagcaacatcttccatcaagtgccgagatccgggtattctcgtcaagcccttcttcgtcctgtcctcttcttcctcctggatctgtc

SEQ ID NO: 6295 - DNA, 538 bp, Oryza sativa
  Predicted polypeptide sequence is orthologous to G2156
ttcctcgagcactgttggcctactggatgcgatggtcgcggctagcgaacgccaagcggatcgaacgccgaggcggcgaggcgcagcagtattacgagtacgtgttgatcgagcgcgaacgccaccgcccgcggccaccgggcagccagatgatcgcagcggcgagaggcagcgaagaggggaacgccgagacggcgaacggccgagccctagtggctgggggctagccgtggctggctctccgcctctgcctcctcgttgtcatctcctcatcctcaactatgcaatcttcatcagctgcgatcatatctgctcaaagtctcgacctggcgattgaaaactagaccgtaacatcggtaatttcgagcaattagcaattaccatgattttaattttctgattaattattgcattttaaatgatcgattcgattgattatggaattaatcaattatcgaaagtaatgtgaatgtattttctttttgcttaaaacatgaagacatttatttccttaatccttgccacgccttctaaaaaa

SEQ ID NO: 6296 - DNA, 3334 bp, Oryza sativa
  Predicted polypeptide sequence is orthologous to G2192
gtccagccacatttgatccccctccactccattctctcctcctcctctcccaccataatggccaagctcccctcccgctccccactcctgctcccgcctctcctcctcctcctcctcctcagccgccgcgtcgcctcctcctccaccgccgccgccgccgccgcagcgcggtctgagtgaagtgaggttcttgggtggaagcgaaggagaagatagatagatagagagagagagagagagagagagaggattaaggatggaggttgacccatcgtcgtctttgccgggcgcgggggaaggaggaggaggaggaatcggcggcgggggtggggatttgtggccgttcgactcgctcaccacgtcgctgctgttctcgtcggtgtcggcctcaccgcagccgctgccggcctcgtcgtcgtggctcacgccgccctcgccgctgtggctgttcgacgagcgccagctgctcccgctcgacatgggcgcccccgctgcccccgccaccgctccgcccgccgaggccgccgccgtggtcgaggaagtccatcggacccgctccgggaattctgacacgactagtaagagggttgatcagattaatagcaaatggcagtttcacctatctattgatgataacacggacagctcatgcttgtttaaggagaggcttacacaggctcttagatacttcaaggagtccacagatcagcatctgctggttcaagtttgggcaccggttaagagtggagaccggtatgtgcttactacttcaggacagccctttgtacttgaccagcagagtattgggcttcttcagtacagggctgtatccatgatgtacatgttctcggtggatggagaaaatgctggagagctggggctacctgggcgtgtgtacaaacaaaaggttcctgagtggacaccgaatgtgcagtattatagcagtactgagtacccacgccttaaccatgcaatcagttacaatgttcatggtactgtagccttgcctgtttttgatccttctgttcaaaattgtattgcggttgttgaacttataatgacatcaaagaagatcaactatgctggtgaggttgataaagtctgcaaagctcttgaggcagtaaatctcaaaagcactgagatattggaccatccgaatgtccagatatgcaatgaaggccgccaatctgctttggtggagatactggagatcttgacggtcgtatgtgaagagcacaagcttcctttggctcaaacctgggttccttgcaagtatcgaagtgtactggcacatggcggtggtgttaagaagagttgtttgagctttgatggaagttgcatgggggaggtttgcatgtcaaccagtgatgtggcatttcatgttatcgatgctcatatgtggggatttagagatgcatgtgtagaacatcacctacagaagggacaaggagtttctgggaaggcttttatctatcgtcgaccttgcttttctaaagatatcagtcaattctgcaagttggagtatccccttgtacactatgctcgaatgtttggtctagctggctgctttgcaatatgtttgcaaagtatgtatactggagatgatgattatatattagagttcttcctgccaccaaattgcaggaacgaagatgatcaaaatgccttgttggagtccatattagctcgaatgaagaagtgccttcgtaccctaaaggtagttggcaacggagacaccaatgaagtttgtctgcaaataagtaatgtgctaataattgagactgaagatttgaagacaaatgtgcactttgagaattctgaaggttgctttcgtgaatcgcctgaaagtaatggaagccaaagagtccacgaggttgataatgatggcaacaaagtttcaatcatgtcagagagacatttgctagctgatgacaactctcaaaacaatggggcatctgttggcaggccaaatggtagtggtgcttctgattcgcttcacaaaagtaataaaccccctgaaaggagacgaggaaaagctggaaaaacaatcagcttagatgttcttcagcaatatttctcaggaagcctaaaaaatgcagcaaaaagccttggtgtatgtcccacaaccatgaaacgcatctgcaggcaacatgggatttctcgttggccatctcgaaaaattaacaaggtcaaccggtctctctcaaaactaaagcaggtaattgagtctgttcaaggctcagatgcggcatttaatctcacgtctatcacaggtcctctccctattcctgttggaccttcatcagattctcagaatctagagaaagcaagtccaaataaagttgcagaactttcaaatctggctgttgagggggacagagattcatccttgcaaaagccaatagaaaatgacaacttagctatattgatgtcacagcaagggtttataggtgcaaacaataacttgcaacttgaagcagacaaagcttctcactcgagaagctcatctggagaaggcagtataaactcacgtacctcagaggcctcatgccatggaagtcctgcaaaccagacatttgtttgcaagccaattgcatcgacgttcgctgaaccacaattaattccagaggcgtttactaaagagccctttcaagaaccagcactaccgctttccaggatgctcattgaggattctggaagttccaaagatttgaagaatctcttcacttcagcagttgatcaaccatttttagcacgttcaagcaatttggcgctgatgcaaaattcagggacggtgaccataaaggctagctttaaggaagacattgtcaggttccacttcccatgttccggtagcgttactgcattgaaagatgaagtagccaaaaggctaaggatggatgttggcatgtttgatatcaagtatctcgacgatgatcatgagtgggtgaagttagcatgcaacgcggacttggaagaatgcatggagatctctggtagccatgtcatcaggctgttggttagcgatgttgcggcacaccttggtagttcctgtggaagctcaggttgataattcaggtcagcattttcgttccatgggtgcatacatgttctgcgaggtcagtctcacctgttgttaatctagttctcttgctagatagcagtagctacttcattgtgtttgattattgtatcaatttttggttcgaatacatgtacttgtgcaaaacggcacttgtagtcaatactgtacatattaagcccttggtgctggaaaattctgatgttcaagttacaaaggttaattggtgtaatactaatatcttcgctgtcc

SEQ ID NO: 6297 - DNA, 1244 bp, Oryza sativa
  Predicted polypeptide sequence is orthologous to G2192
atccccatcccaaaccccgcgccgcctcttaccgcttcgcgtcagcttcgatttgattcggttcggttcgcgcgcgccccgatctatcccgcgcgaagtcgattcccacgccacccgcgctgttatgtgcgcggctcccatggcttccactgcccagccgcagcagcagccgcagcagcagcaggagcagcagccggtggcggcggcggcggtgccgactccggctcctccggcttccgaggcgcggccgcagaagccgacgagggtatcgttgtcgtacgaggagatctccaagctcttctcgctaccaatcgcagaggcagcctccatcctcggtgtttgcaccagcgttttgaagaggatttgccgcagccacggcatcgtcaggtggccgtatcgaaagcttgtatctgggaagtctggtgatgacacaaaaaacgctgaaagagagaaagccaagggacttcttgagatatctaaagttgcaaaacagaaggctctaagcgcatctggtctatcaacagtatcaccaggcgctttccaaggagtggcaaaatctcaacagggaagttcgaaggcaggacaagtctcacccccaggaaaacaaaatgtgttgggtggatcagcaatcttgtcctatggtacccaaaccaaaggcatcccaacctacatggacgacttcaagtacggatttccatcatctggcttgtctttgcaaactatgaaatggtgggggactgacagccacacggagaccacacctgcgaaagacgataacggtgaagcccctgaatcagcaaatgaggcttcgaagggtatgaccgacgatgagttggactggggagcagatgaagctgaagccgaagccgatgccgatagtgcgatcacaaccgaaccatctgcacagctgtgctccctgagaaggaaagctgtagacgatgggcgcaagctgctgactggcaagtcctgcgggggactggagctgtgcaggctgaataagaggcagaagatggccctcgcccaggtgttcggagcctcactgccggagcagttgaggagcaagctcgggtgatgattttgcctgccatttgtacctctgtgtaacactagttactagtagtagcgaccggcatggttaagctggttcctgatgtaacttgtcctgatccatttgtgttgtgagaactagataaattcgttgtgaagaggatggtaggagttttgcctgcctgctttcccatttc

SEQ ID NO: 6298 - DNA, 756 bp, Oryza sativa
  Predicted polypeptide sequence is orthologous to G2192
cgacaagatgaagcgcgtcatgaatccgtgaactgctcgccgtcgccgccggtggccatgcctgctcacccagctcttcttctccctccgccgccgccgccaccgcggccatgcctgtcaagtaccgtaggagagacctcctcccatggatcatgccaggcgccgccatctcacgccaaaactgcattgcgaaaacctccgaggtgcggcaatggcgacggcgtggtcaccatcaaggccagccacagaggtgacatcatcaggttcagggtgccgtgctcagccggcgtcgcggcggtgaaggcggtggtggccaagcggctgagcctggacgccggcgccttcgacgtcaagtacctggacgacgaccacgagtgggtgcttctgtcctgcgacgccgacttccaggagtgcctcgacgtcgtcccggcattgccgtcaatgtcggtgacggcgaggtcaggctccggagcggcggctccggtggtcgtcaggctgatggtccaggaggtagctgataacatcgggagttcctgcgctagctcagattagttgtaaaatgtagctgaaagtgtgaaaccagtagcaggaacatcaaacagatttctcaagtttttactactgatacacatacaagaaagttcagacctgtcaaaaatcactgtaaaaaggaacatgccttagagagtgtcaatataccatgaacattgtttcatcttgaataataaccggaaagagaaaggcacaaattgcttc

SEQ ID NO: 6299 - DNA, 591 bp, Oryza sativa
  Predicted polypeptide sequence is orthologous to G2207
ggagcgagcggtgcaagcacctcagttcgggaacggtttgaccaagctctagcttacatcggggagacacagagagacgccgatgtgcttgtgcagctctgggtgccagtcaagggcaacgatggtcagctggtgttgacgacgagcgggcagccattcactctcgatcagaggtccaatagcctcatacagttcagggaggtttcgaggaagtaccagttctctgcagatgttgcttcaggttcctcacctgggctaccagggagggtgttcatcggtaggcttcctgaatggtcaccagatgttcgatacttcaccagctatgagtaccctaggatcagccatgcacaatatttggatgtccacgggacgatggggctgccggtgtttgagagggggaactactcatgcttaggtgtcatcgagttgatcatgaccaagcagaagctcaacttcacctccgagctcaataccatttgcagtgctctccaggcagttaacctgacaagcacagaagtttcaagcattccgcgcacaaagcttaacagtgcttcctacaaagatgctttaccagagatactagaagtcctg

SEQ ID NO: 6300 - DNA, 1326 bp, Oryza sativa
  Predicted polypeptide sequence is orthologous to G2213
atggagatgcacgagtgctgctactacggcggcagcatcggcggcgactggctcaacccactcgccgccatcccgccgccgtgttcttcctcttcttcttcgtggtcgtcgcagcttctcctcctcagtgatcacgatgacgtactcttgcactccgccggcgatcatggcggcgcggtggccggaataggcggcgcctgcatgaccgccgatctcgttgtcagggacgaggagatggagatggccgccggctacctgccggtggccgcgtcggccgccgccgccgccgacgtcgaccactacatgtaccagcagtttcagctcgagcctgatcagttcgtctcgacgttgcccgcggtggcggtggcggtggcggcgacggcgggcggcggcagccacgacgacgagctcctgaggatgcccttcaccgacatcgacctcgacgcgttcgccgacgcgcgcgacgtcgtcgtcggcgtcggcgagcccaagcccagtccccagcacactctcgacgcggcgatcgcgctcccggcggtcggcggcggcggcgcccaccacttcggcacgcaggacgacgacgtcaagttcgacgtgaccaagcaacgcaacgacgccgccctcgccggcgacgactccctgtccatggtgatcgtcgagagctacgagatgggcatgcgacgtcacgccgccgagcaggagcaggagcagaagccaaagatcatcacatcagccgcaacgacattgacgcctcttcctcttcctccaccgccgccgccgccgccgcgcgtgacgaggagccgccgcgacggatcatcggcggcgacggcgggcgggaagactcggctggaccacatcggattcgaggacctgaggcggtacttctacatgccaatcaccaaggcggcgagggagatgaacgtggggctgaccgtgctcaagaagcgctgccgcgagctcggcgtcgcccggtggcctcaccggaagatgaagagcctcaagtccctcatcctcaacgagatggggagcaaggggatgtcggcggcggcgatgcggcgggagctggaggcgctggagaattgctgcgcgctgatggagaggaacccggcggtggagctgacggagaggaccaagaagctgaggcaggcgtgcttcaaggagaattacaagcggaggagggcggctgccgtcgacgtgctcgacctcgaccactgcttcagcttcgccgccggtcattgccaccgccaccaccaccagcagctggctctgccgccgccgccagctgccgccgccgaccaccgtaggagagatttcttcggctactga

SEQ ID NO: 6301 - DNA, 582 bp, Oryza sativa
  Predicted polypeptide sequence is orthologous to G2226
ccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggcctactgccgcgtctgcctcacgcggttcgagccggaatcggtggtgaaccgcatcccctgcggccacctcttccaccgcaactgcctcaagaagtggctcgactacgaccacgccacctgcccgctctgccgccaccgcatcctcccc

SEQ ID NO: 6302 - DNA, 609 bp, Oryza sativa
  Predicted polypeptide sequence is orthologous to G2226
gggggggaggacgcggccgtggccgtgtcggtctccgcggcggcggcggcggcggggcccagcctggcggacacgttcagggcgaggttccgaccggcgcggttcggccaccggcgctgcggcggcggcgcgacggcggactgccgcgtctgcctggtgcggttcgaggcggaggcggtggtgaaccgcctcccctgcggtcacatcttccaccgcgcctgcctcgagacatggcttgactacgaccacgccacctgcccgctctgccgctcccgcctcctcgccgcctcctcctcgccgccggccgccgccgccgccttggcccggacttagcgagtggattcgattcgactcgattcgattctccgacgagccgccccgcgctggctacgcgccaccgtctccgggtggcctccccgtgtgggcgtaggaaactagagagagagctctttgccttttttgcactttcacccctcactttgtcccttttttttccgtttcgggcggtttgtgcctgtaccgtgtaaatacctcgcagcaagagagtgctcctacgggtgtagcactttttgtgagctttgtgtataaaaccttctcggaatagcaacc

SEQ ID NO: 6303 - DNA, 992 bp, Oryza sativa
  Predicted polypeptide sequence is orthologous to G2226
gtaccatctcccgtgtcctcctcccacctcgctcccccgtaaaacccgaaattacaatcaggtcctcggcggacgccacccccaaatctgaaaccctcgccgccgccgccgccgcgcgatcccccccggaattccatcggatcggcccccgcctctccggcgagatgggcatctcgagcatgccggcgcccaaggacagcgtggtggcgtacctgctgtacaacacggcggtgtcgatcgccatcctggcggacatggtgcgggcggcgctggtgttcctcggcctccccgtgccgccctcggcgtgggaggacggcgacgaccagctggcggcgatcgcggcggccgccgcggccgcggccgcggcggcggggggcccgagcctggcggacaggttccggagcaggttcaggccggcgaggttcgggcggcggcgaggcgggggcgcgggcgcggccgactgccgcgtctgcctcgcgcggttcgagccggagtcggtggtgaaccgcctcccctgcggccacctcttccaccgcgcctgcctcgagaagtggctcgactacgaccacgccacctgcccgctctgccgccaccgcctcctccccgccaccaccgagtccccctcgccgtcgccggcgacggcgaccccccatttcgcccggatttagagagatctccccccttcaatccgccactgggccgtgtgcgcgtaggaaaattgagaggatcatttagctctagtgctagctccatttagtgctcctttttccccccactttcttaatttttttttcacctctttgcagtgtttttttttaccatcttcgagtggccttttcttttcttttctttctttttttacttctttgtgttgctgctgtaccattgtaaatatttgcagagtgctccgatcgatggagaggtgtagcacttgtgtacagggcttttggaaagcgaagagatgagaaggagagaaaaaaaaatcattgccc

SEQ ID NO: 6304 - DNA, 1475 bp, Oryza sativa
  Predicted polypeptide sequence is orthologous to G2227
gtattcccctcctccgcctcccctagtttcctctcctccccgaaacccccaattcgaatccggcggcgaattcgattggggatttcggcgtcctcgcctccgtgggattcctcggatcccgcctcggcttcccgtctcgatctgcgtctggagttttggagcagacgatttgagtttctggttcgatttggtttggtttggtttgggggcgatttggttcaaggcgcggatggcgtcttctccggtgtcgtactggtgctaccactgcagccgcttcgtgagggtgtcgccgtccacggtcgtctgcccggagtgcgacggcggcttcctggagcagttcccgcagccgccgccgcgcggcggcggcgggagcggccggcgcggggcgatgaacccggtgatcgtgctccggggagggtccctgtccgggttcgagctctactacgacgacggctccggcgacgggctgcggccgctgcccggcgacgtgtcgcacctcctcatggggtcgggcttccaccgcctgctcgaccagttctcccggctcgaggcggcggcgccgcggccgccggcgtcgaaggcggcggtggagtcgatgccgtcggtgacggttgccgggagcggggcgcactgcgcggtgtgccaggaggcgttcgagccgggcgcctccgcgcgggagatgccgtgcaagcacgtctaccaccaggactgcatcctgccctggctctccctccgcaactcatgccccgtctgccgccgcgagctaccggcggccgcggcccccgagtcggaggcagatgcgggactaaccatctggcgactcccacgcggtggattcgccgtcgggaggttcgccggtgggccaagggagcagcttccggttgtctacactgaactggatgggggcttcagtaacggcgtcgggccgaggcgggtaacgtggccggagggcgacggccatgtcgatggcggcgaaggtcggattcgccgtgtatttaggaatctgtttggttgttttggtcggagcagtcggccggagagttcatcatcgcagtcccgtagtggctgaacgcagttttctcggtaactcgatctcctattgatagtggtgaataagtaggatttagtataagaagggaacccagattataagttcttgggacttttgatgtaaatgaaaaccttgcgatttttttccactttgtcccgttttaagagtttatttagagatggccacgagcaaaatagcaaacaactggaagttagtttggaaagcaaattaggaggaagaagcacaggacttcatgaaaggaatgacagtgaatttattgggtaaatcaattgttgcaatgttgtagtcagagagaacaaagtgttgttcttacctctgtactgtttgtgtatatactggattgggccaagaagatttctgatttgcaatatcttgttctaataaaatttcagccttttttatt

SEQ ID NO: 6305 - DNA, 1327 bp, Oryza sativa
  Predicted polypeptide sequence is orthologous to G2227
gagatgagcgcgcccccgccgcgcgccgcctacctccgccgcccgcgcgcgcaccacgccaacgacctgcgcctgcgccgcacgcgccgcgccgcggcggcggcggcggccggcgaccgctcgccgttcaaccccgtcatcgtgcttcgccgctcccccgccgccgccggcgacgacgactccctcgccgccgccaccagcttcgagctcttctacgacgacggcgcgggctccggcctccgcccgctcccggagaccatgtcggacttcctcatgggctccggcttcgagcgcctcctcgaccagctcacccagatcgaggccggcggcctcgcccgcgccagggagaacccaccggcctccaaggcctccgtcgagtccatgcccaccgtcaccatcgccgcctcccacgtcggcgcagactcccactgcgccgtctgcaaggagcccttcgagctcggcgacgaggccagggagatgccctgcagccacatctaccaccaggactgcatcctcccatggctcgcgctccgcaactcctgcccggtctgccgccacgagatgcccaccgacgccgcccgcccgcggcccagcaatgccggcacagaggaggagacggtcggcctcaccatctggaggctgcccggaggcggcttcgccgtcggtaggttcgccggagggaggaggcccgaggagagggagcttccagttgtgtacaccgagatggatggagggttcaacaacggcggcgcgccgaggaggatctcctggggttcgaggcagagccgatcgacggagaggagtgccattaggcgcatcttccgcaatgtgttctcgtgctttggtcgcagccattcatcgaattctcaggcctcgtcttcgcattcgaggccggagttgaacgatgcgtctgaccggagcgccgtgttcagccatggctcaagaagccggagcacgagctggaggctcgaagatggccatgccgacgccatggtgcaaagataggcctcaactgaagtaaggaaggtcgtcgattgtttccatttcgcgcatatgtatttagaggaaaagaaatttgtagtagaacagaattgagaattggtgttgtacataggagcagcatcacatctactagtagatgataacttgcagggaagaagatgcccacgatggtgattctgaaatgagcatttgttgtttagagtgatgaatttgctcttgctggtagcaaatgtcgcttggaattctatgattcattcaaattcattgtggcgatgattctttgcatctgtgagaacggaatgaatgaaaccattttgatgtttgc

SEQ ID NO: 6306 - DNA, 654 bp, Oryza sativa
  Predicted polypeptide sequence is orthologous to G2227
atggcttcttccccttcctcttccttctcctcctccccttccgctgccggtgctgcgccggcgtcctcctcctactggtgctacaattgcgaccccttcgtgcgtgccgcccctcacaaagactccgctgtcgcctacccgaactacggcggcggcatcctcgaggagatgggtgcacccccaccgtgcaccgcctacctccgccacccgtgcgcgcaccacgccaaagacctgcgcctgcgacggacatgctgcgctgacgcagtggcggcagccgatgaccgctcgccgttcaaccccgtcatcgtgctttgccgctcccccgctgccgtagctgccggcgacgatgactccctcgccacggttactagcttcgagctcttctacgacgacggcgtgggctccggcctccgcccgctcccggagaccatgtcggacttcctcatgggctccgccttcgagcgtctcctcgaccagctcacccagatcgaagccggcggcctctcccgcgcaagggagaacccgccggcctccaaggcctccatctccatgccgcggggccgcccactcgcccagttcaatcgccggagaggagacagaaaaagtgacgggagtggcatggttttaattttagaaatttcgagtgacatgtag

SEQ ID NO: 6307 - DNA, 1312 bp, Oryza sativa
  Predicted polypeptide sequence is orthologous to G2239
atcactttgccgccgccgccgccgtttcctcctcctccctttccgagagagatggggcggcgcgcgcgctgcctctgcctcctcctcctcctcctcctcgtcgtaggtggcggtttccacgtggccaacgcgcaggcgtcgccggcgccgccacagacgggcacgagggcggtcaaccgcgccgtgtccaccgtcatcaccgtcgtcatcggcgtcttcttcgtcctcgtcttcgtatgcgtcatcgtcaaccagtgctgcgactgcgactcctccgctggcgctggggctgggcaagggcagtcgtcggctgctcggcgccgccgcgggctcgacccggcggcggtggcggcgatcccggtcgtgccgtacgcggaggtcaggaagcacaggagcggcggcggcggcgcgctggagtgcgccgtgtgcctcaccgtgttcgacgacggggacgacctccgcctcctcccgcagtgctcccacgcgttccaccccgactgcatcgacccctggctcgagggccacgtcacctgcccgctgtgccgcgccaacctcgagaagcagccagcgccgtcgccgcctgccgtggagttctcctcctcgcctgctgcggccgcggcggcggcggaggagtcgcgtacgcccgaggccgcggcggtgcgggttgaggaggtggcggaggcgagcgacgaagaggagacgaggaggagggaggaggaggccgtggagctggagagtctgcgcgccgtgcggcgggcggcgaggatgccgaggtcgaactcgacggggcactcgctgtgcgcgctgccggcgccgcgcgcgccggggccgggcgacggcggtgaccacgagaggttcacggtgcggctgccgccgcacgtccgggaggaggtgctcaagtcgaggcgcctccggcacgccacgagcctcgtcctcggcatcaggggatcgagccgcgagggcagctcgaggggcggcggcgggagctggcacggcgcgcggcggtggccgtccttcctggcaaggacggtgtcgtgggcgcgcggcggcgtgggagcggacaccagcgcgaaggagacgccatgccgtgatgcggtctgatccgtgcaaagccggcgagattttgtgaaaaaaaatttctctttttatgtagaggaattaatttaatttgttcgcgtgcgaaggctgaaaaaccttgtacatacaccaggttgtttgccatttgaaattattataattttgcttattagtagtaatcgcgtgcacgtaatgtacaaaccgtggcaaatatatttgaaatttcgtttgtttt

SEQ ID NO: 6308 - DNA, 1700 bp, Oryza sativa
  Predicted polypeptide sequence is orthologous to G2239
aaacgcaacgcaaacactcgctcgatcgccacatgccgacgcctcgtcctcgccaccgccaccatgcgctcccgctcgcgctcgcgctcgccgcgccgctgctgctgctagccgcggcggacgggcagccgaacgagtcgagggacaagaacaacggcggcggggaggtgggttcatggcgcccagcggcggaggcggcggcatgggctctcagtcgccgagcttcagtgcgcccatggtggtgctcctcgtggcgctcatcgcggccttcttcttcatcgggttcttctccatctatatccggcggtgcggcggcgaggcctccacggggccgaccatcccggccgcggcgctggcggcgctgtcgcggcaggagcagcggagccggcggcagcgcgggctcgaccccgccgtggtcgagtcgttccccaccatgaagtacgccgaggcgagggagctccgcgacggcggcaaggacgccgtgctcgagtgcgccgtctgcctcagcgagttcgacgacgacgaggagctccggttgctgcccaagtgcagccacgccttccacccggactgcatcggggagtggctcgccggccacgtcacctgccctgtctgtcgatgcaaccttgcgcccgacgcggcggcggcggaagcgaacgtcgtctccggcgaggtggatggggagcagcaggaggaggaggtggtggtggccatcgacgtggaccgcgagggcgaggaggaggacgaggagaggcggagggaggcgatggagctcgagaggatcggcagccagcgccgcgcggtgcggtcgaggtcggggcggccgctgccgctgccgcggtcgcactcgacgggccactccctcgccacgacgcggctcggcgacgccggcgacctcgagcggttcacgctgcgcctgccggagcacgtgcgcagggagatggtcgccgccgccggcgaggagagcctgcgccgcaccgccgtccgggaaggccgcgtcggcggcggcgcccggagcgcgcggatcgggcggtccgaccggtggccgtcgttcatcgcgaggaccttctcctcgaggatcccgttctggtctgcgtcgaggagggtactcgacgccgcggaggccggagctgacgccgccgccaccaccaccaccacgacgccaacgtcaacggcgaggaccaagcgtgacaagacggccgccgccgcagatggctccgtgagctcagccaagggcagcgtccgcttcgactgtctcggcggcggcggcggcggcggcggcccgagcaacagagtcgtcgccttcgccaacgacgacgaggaggatgacgacgagaagccaatcgcccggcaagtttgagctcgcgccatgcgcggtggcggcgccagtgcatgcatcatctgatcagaaaaccaatccgcggcggcttctcgcagcgatccgccatggctggaccttcgatgaatcagctcgtgcacggacacagatcactagaaaagatcatcaatttgagttgaaaataccactcctaaattagtactagattgttaattatacatttttctctccattgcttctttggatagagaagtggcgtggaaacgttcaaagatccaatttttcttcccctccgttgaaaaactggagcggggttgtacttgtaccggcactgtattcaaatattcatgtgattattcgt

SEQ ID NO: 6309 - DNA, 1735 bp, Oryza sativa
  Predicted polypeptide sequence is orthologous to G2239
gactagccaaggcgccctcgcctcccgccgccgaccacgcgcgctatctgcatgccaagttgccgagctaggatgcacgcgcaccagcaccagcacgcgctgctcgcggcgctcctcgcgtgcgcgctcgcggcgtcgtcgtcgacggccggagcgcagccggcggggcagcaggggtatgcctacggcgacgtgtccgggcagcaggtgcacgtcagcacgacgatgatcgtgctgctggccgccgtcgtcggggttttcctgttcatcgcgatctccaccatctacctccgccactgcaccggttacgaccccgcgacggagggcggcggcgtcggcgggagccgttccatgatcctccctgccaacagcttcgtctcgaggcggcagcggcggccgcgcgggctcgactcgtcggtggtccggatgttccccaccatgaagtacgccgaggcgaaggcgctgcgggtggggaaggtcgccggcgccgcgctggagtgcgcggtgtgcctcagcgagttcgaggacgacgagatgctcaggttcctgcccaagtgcagccacgccttccacccggactgcatcggccagtggctcgccagccacgtgacctgccccgtctgccgccgcaatctcgaccctaacaaggacaccaccgaagaggtgatcatcccggccgccgccgccgccgatccgaacagcacctccagtgaaatagttgtgatacggcaagaagacggggcgcacccagcagccgtggtgatcgacgtggtcaccgaggaggacgacgaggagcggaggaaggaggagctagagcttcaggcgataggcacccagctccgcgcgatgcggtcacggtcggggctgcggccaaagacgtcggcggcgaagcttccccggtcgcactccactggccactccctcgccgtccggctcgacggcgacctagagcggtacacgctgcggctgccggagcacgtacacagggagatggtcgcggcgggggagcagagcgtgcgccgcgggaggagactcggggaaggggtcggcatgggcgctcggtgcagcccccggttttcgcggtcgggcagatggtcatcttttctctcaaattctttgtcaggaaagctgtctttcctctccccgtcgtcgaggagaacgccggatagcacccaggtggaagtgtcatcatcctcgtcgtcgtcggtgacgaaggtgaaagggaagcgcgtggccgccgtcgatgttgccgacgacggttctgctcatgggactgcacagtaccctggttgcactgtggccagctcggcggcggcggcggctgtggacgtggagaaggcagctaccaggcaagttcgaacatagaaaacgaacagaagttttgagtgagaaacttgaacagttgaacttgacgtcatgcattttcccacatgaaagaaagaaatggtctttttttgtcggtgggactgtattctgtactctgtactaggtatattatcaacgccgatatgcccaaatattatgggagcacctattgatcaatcaggtgactgcagaatagcaaaggcgaaataatatacatactaggttgaagaaacttagatgcttttttttttttggaactagaaacttaggctgtgtttgagggagaggggattgagaagattggaaagatacgtaaaacgaggtgagtcattagtgcatgattaattgagtattaactattttaaattcc

SEQ ID NO: 6310 - DNA, 1249 bp, Oryza sativa
  Predicted polypeptide sequence is orthologous to G2239
actccattccttccaaaagaaaactcgaaacctccccctctccggccgccggcgagcggctcatccatccaccccaccttggccggagacggcggcaatggctcaccgccggatcgcgctcgccgtcctcgtgacgctgctcttgtcggcgttccgcccttgcctggcgcaacagagcaacgacgacacgagcaaacaccaccggagcgccacggccggcgggttcacgccgaccaccgtcgtcgtgctcgtggctctcatcaccgccttcgtcctcctcaccgtgttctccgtcctcatcaaccgctgcgcccaggcgcgcgctcccccgcgccgggcgttccgcagcacggcgtcccatcagcccgtcggcggcgccgccgccgcgtcccgcgcctcgcgtggcctcgacaaggaggtcgtggaggcgttccccacggcggtctacggcgacgtgaaggcgcgcatggcggcgaagtcggggccgctcgagtgcgccgtgtgcctcgccgagttcgcggacagcgacgagctacgggtgctcccggcgtgctgtcacgtgttccacccggactgcatcgacccctggctcgccgccgccgtcacgtgcccgctctgccgcgccaacctcacggcgccaccggtgtcgctcgccgccgccgagagctccgacctgacggcgccggaggaggcggtgcaggaggaagagtcggaggagctcgacgaggcgtccctgatggccaccttcacgccggaatccgtcatcgacttcggcgcgacgcacgaccatgaattcgacagagcagggtaccctcactaccggaggacgcagtcggccatggacgccgcgccggaccggcacacgctgaggctaccggagcacgtcatgaaggagctcgccgccgaccgcaggcaccggcgcgccgcgagcctcgccgggtacccggacagcgtggagaggacgccgaggtggctgacgtcgctctggcgatcggtgtcgtggcagaggcagagccgggcggactgggacgccggagaggagcacggcggcagcaaaagggttcacccggtcgccggagctcaggacgagacacccagcgggtccggctccgatgggagcaaggagaactccgattctgacgcgttaaaccgagtttgaattttgttttctcctcttctttttttttcttgtgcttcgttctaattgtgcagcggtgtagtaatacaaattaacgataaactaccttgc

SEQ ID NO: 6311 - DNA, 1242 bp, Oryza sativa
  Predicted polypeptide sequence is orthologous to G2239
atggggtcgccgcgaggacgccgccgcggcgacaatggccgcctcctcctcctcgccgccgccgccgtcgtcattgcctcgctggtcggcggcggcgcggcgcagccgacgacgtccgggcccggcccgaactacttcaaccccaagagcttcaacccgtccatggccgtcgtgatcgtggtcttggtcaccgccttcttcttcctcgggttcttctcgatctacatccggcgatgcgccggcgggccgttgggtgggcccggggggtatggcgtcggcggcggcggcggtggacgtgtgggtggtgggttcacgtttgcggcggcgcggtcgaggagggtgagggggcttgaccccgccgtgctgggcgcgttcccgaccatggcgtacgccgacgtgaaggcgcacaaggccggcaagggcgcgctcgagtgcgccgtgtgcctcagcgagttcgacgacgacgagacgctccggctgctgcccaggtgctcccacgcgttccacgccgactgcatcgacgcgtggctggcgtcccacgtcacgtgccccgtctgccgcgccaacctcgccttcgacgccggcgtcccgccgccgccgctggcgccgccgcatgcgttgaccaccgggcaagatgttgcggctgcgccgccgcagccggcggcgccagagcaggtgacggtggacgtcgtcgtcgcggatgccgaggagacggaggagaggatcaggagggaggaggcggccgagctgatgcggatcggaagcgtgaagcgcgcgctgcggagcaagtccggccgccggccgccgcagttcccgcggtcgcacaccacggggcactcgctcgccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgtatga

SEQ ID NO: 6312 - DNA, 1164 bp, Oryza sativa
  Predicted polypeptide sequence is orthologous to G2239
atggggacgcgcgagctcctcgtcgttcttgccgtcgtcgtcatggccgccgtcggcgccggcgcgcagtcttcttcggcgtcgccggcgccggcgacgtcgcaggcaccgacggtgcggcagcagacgccgttcgggcggaccatgtcgaccgtcatcacggtgtccatcagcgtgttcttcttcctgctcttcttctgcgcgtacatcaaccagtgtcgcctcgccgaggccggggacgccagggccgcggcggcggcggcggccggcgggggagccggaggagggccgtccaggagagggaagcgcgggctggacccggcggtggtggccacgttcccgatcgtgccgtacagggaggtggtgaagcacaagatcggcaagagcgtgctggagtgcgccgtgtgcctgacgtcgttcgacgacggcgacgacctccggctgctgccgcactgctcgcacgcgttccacccggagtgcatcgacccctggctggagtcccgggtcacgtgcccgctgtgccgcgccaacctcgagaagcctccgccgccgccaccgccgccgccggcggcggcggcggcgtccccttcgccggagcggtcgccgcggtgccagccttcgccgccgccgccgccgccgccgcacgccctggtgataccggtggaggacgaggaagacgacagcgacgaggacgacaggaaggaggaggccgtggagctcgagatgctgcgcagcgagcggcgcgccgcgaggctgccgaggtcgcactcgacggggcactcgctggtcgcgtcggcggccgccgccgccgagtccggcgaccacgagcggttcacgctgcggctgccgcagcacgtgcgggacgaggtgctccggtcgctccgcctccgccacgccgccagcctggtcaacctctcggacatgagctccgaggggagctcgaggggaggacggcgtgcattaggcctcgccttcggcaacggcggcgggagcagccacggcggccgccggtggcaggcgttcttggcgaggacggtgtcatgggcgcgaggcggaggcgacggctcggtgcgcaggggctgggacggctcgacgagaagaggaaaagatgacgccgagtcgagcagaaagggggcgacctcaccggcggccggccggccgtga

SEQ ID NO: 6313 - DNA, 1179 bp, Oryza sativa
  Predicted polypeptide sequence is orthologous to G2239
atggcgccagctcgagtccacagcaatggccgcctcctcatgcttctcctcctgctcgccgtcgccggctttgcggcggcgcagccgagccaggacaatcctccggcgggctactacgcgaccaacttcagcccgtccatggccatcgtcatcgtcgtcctcatcgccgccttcttcttcctcggcttcttctccatctacgtccgccactgctacggcggccgcggcgactactcgaccaccccgctgccccggtccggcgccgcgcggtcgcggcggcagcgcgggctcgaccagtccgtgctcgcgacgttcccgaccatggcgtacgccgacgtgaaggcgcacaagtccgtcaagggcgcgctcgagtgcgccgtctgcatcagcgagttcgacgacgacgagacgctgcggctgctgcccaagtgctcccacgtcttccaccaggactgcatcgacacgtggctcgcgtcgcacgccacctgcccggtctgccgcgccaacctcgtcgacggcgcgtccgagccggcgagcgatgtcgccgccgagctaccgacggcgcccgctccgcgcccggaaggcgcgacgccgtccgaggcagcagcgccagggggggaggcgccggcggcggcggcggcggcggcggtggtgatcgacgtggaggagaccgaggaagagaggatcataagagaggaggcggccgagctaacgcgcatcggcagcctgaagcgcgcgctgcgctcgaagtccggccgcgcgcccgccgcgcgtttcccgcgctcgcattcgacggggcactcgctctcctcctccgccgcggcgagcgccggcgccgagaggttcacgctgcggctgcccgagcacgtgctccgggaggtcatcgcggcggggcagctccagcgaacgacgagcctcgtggcgttccgcgccggccgccaggggagcacgcgccgtggcctcaggtcgggaggcggcggcggcggcggtgaaggcagcagccgcgccgggagaagcgtccggctcggccagtctggacggtggccgtcgttcctgccgcggacgttctcggcgaggctgccggcgtggggatcaaggtcgacgcggaggggcgacggcgacgggtccagcaagggcggcaggactgccggctccggcgccggcgccggcggcaagtaa

SEQ ID NO: 6314 - DNA, 638 bp, Oryza sativa
  Predicted polypeptide sequence is orthologous to G2239
tgcggagcaagtccggccgccggccgccgcagttcccgcggtcgcacaccacggggcactcgctctccgccgccgccgccgtgcccgccaccgccgacgacgccgcggagcggtacacgctgaggctccccgatcacgtgctccgggaaatcgtcacctcggcgaggctacgccgcacgacgagcctccaatcgttccgcaccaccgccgccgccggcggcggcgcccgcgccgggaggagcgtccggctcggccagtccgggaggtggtccaacgtgtcgtcgctgatgcgcacgttctcggccaggctgccggcgtggggctccgctcgacgcggcgccgaagccgactctccggggaaggacggcgccaaggtcgccggcgactgcaccgcctccgtggagcaacactgcgacggcggcggcggcggcgcgtgcccacgtccacttggtgaccatgtatgatgacgtgtcccgctgattgttagtcaaagtattagaagtactccactaatattaggaaggcgtccttgtcgtcaccgttaattctcttctcttttcggcggcaatttgtgtgtacataaagtcacaaactttattcttcttcgattacaaagtcgcaaaaaaattatgtggttg

SEQ ID NO: 6315 - DNA, 1223 bp, Oryza sativa
  Predicted polypeptide sequence is orthologous to G2251
ctctctctctctctctctctctctaaagattccatctttgatttcgtttctctctctagaaggaaggaaggaggtcgccggcggcgatggggttcccgtcggtgtgctactgcgtgatactgccgcagccgctggtgctggtgctgcagctgctcgacctgctgcgccacgccttcctgctctgcctctccgcgctcggcctcgccgcgccgccgctcccggacgaacaccccgcctacgcgccgcccccgccgccgccggcgtcgatggcggccctccccgccgacctcgtctgggcgttccagcccgcgccggagccggccgccatcaaggcgcgcctccccgccgtccgctacgccgacttcgtcaggtgccgccgcgccgccgcggcggccgcggcgtcgtgcgtcgtgtgcctcggcgcgctcgaggcgcgtcaccgggtgcgcgagctcggcaactgcgcgcacgcgttccacaaggcgtgcatcgacaagtgggtcgacaagggccaggccacctgcccgctctgccgcgccgccctcctcccctccgccgacgacgccgacgccgccgccatcgccgccaccaccaggcaccacctcccctccttctgatccatgtcgccaagaacccatcttgcttagcacccaacacccccttccaccccaagagcaacaagggttccctcctcctttctccaccaatggatcaaatccaatcaaaatggaagaacacacaacacaagagaagagagatagagagagaaatcaatggaggaagaagatgagaggagagagagggggtgtgtgtggtggaggagtattattggtaggtgaggcactaattatgaggaggacaaggatggctacctgcactgcattggatctggtgaatttcagccctagctagctatagatccaacatctcctctcttcccttctcttctcttctcttcacttcacttcacatcaactttttctttgcttttcttttttctactttactttcttcttttgttgccttcacctcctttttgaaattttgctttctttctctttaatttttctccctctttttccttcttttttttgagggtttcctctccccttgtcattaacttaatttgtaaggggggattaagagagagagatgtgtacatacctgcctccactttgacaaatatcggaataataatttataatgatgatgatgatgatgat

SEQ ID NO: 6316 - DNA, 1039 bp, Oryza sativa
  Predicted polypeptide sequence is orthologous to G2251
gtcactcgtcaccatcctccccctttgctttccacgactctctttcgccgcagtctctgcttccgtgcatccatcggcgttcggcgactcggtgtatagtagtattgccaactgtgcgtagcaagctcgatacagcggcgatcatggggttccctctggtgtgctactgcatggcgatccccaagccgctcatcgccttggccaagctcctcgccgccatcagggaggccctccagctgatgctcttcgtcgtcgggatctgccaccacccggagcgatcgggccgcccggctgccgtcgacgccccgctgcccgacgaggtgaaggaccgcctcccgcccctcgagttcgcccagctgctcgcggcctcggagcacggctgtcatggctgcgacgacgacgaggcggtggcggggtgcatcgtgtgcctggagaggctggaggcggatgacgtggtgcggcggctgggcaactgcgcgcacgcgttccaccgcggctgcatcgaccggtggatcgacctcggctggttgacgtgcccgctgtgccgctccaccctgctgccgcgcgcgcgccccgccgccggcccgcgcgggcgactgggccgcctcgccacccgcctcacgggcgtcgtttggtgaatcaatatttggcccgcgcgaccgcgacgcgacacgggatcggttgggtgggagggcagtcgcgccatttcacagcctaagctagcttactgctgctgttaatcaacggagacaaagctctctttccctttcgtttcctttttctttttctgccgaggattatccagctggaggagagtggtacgtgtcggaatgcggtggaatatatcgatgattagacggtaggaacaattaattagaagcaggcaagcagctggttggttggcccggcctggcacctggcatgatcattgggaggttcatgtaattactgcgatgattagatactgcatgtaagtaaatcatgtcatagagataatacacctgtgtacagtggtataatgataaacggttcatttggt

SEQ ID NO: 6317 - DNA, 1276 bp, Oryza sativa
  Predicted polypeptide sequence is orthologous to G2290
accgcagttcactgcactctcctctacaagcggatcaccggagaagagatcgatcggtagccgtagcacggcacggtggttgatcggcggcggccatggccggagcggagtggtcgccgttcgacggggacgccgccttcgcggagtactcgtcggcggtgctggccgagctcggcgggtgggcggcgccgggcgaggaaggcggcgcggggatgatggtaccggcggcgctggatctgccggtggatgtggtgggggcggcggcgcgggaggaggaggaggaggaggaggaggcgccggcgagatcgggcgacggcgccgccgccgccgcgtcgtcgagctctagcggggagcccgccgcccccgacaagcgaccggccgccgccgaggcagcgccggcggcggcggcgacggcgacggcgacggcgaagaaggggcagaagagggcgaggcagccgcggttcgcgttcatgaccaagagcgagattgaccacctcgaggatggctacaggtggaggaagtatgggcaaaaggcggtcaagaacagcccattcccaaggagctactacaggtgcaccaacagcaagtgcactgtgaagaagcgcgtggagcggtcttccgacgacccttccgtcgtgatcaccacctacgagggccagcactgccaccacaccgcctccttccagcgcggcgtcggcggcgccgccgtcgcggcgcacatccacggcgcggcggccgtcgccctcgccgagcaaatgtcggcgttcgtctcgccgccgccacagccgcatatgctgtacggtttaccccggttgcacccgccgtcctccgagaccgccgtcagctgctcgatgccgacgacgacgtctttgcaggagctgaacaatagcgaggggctacaacgccctggctataataatagcccccaggcggcggtgaccatcgcgcagcggccgccgtcgccgtcggtgcctccggctgtttcgtttgacaaggggctacttgatgatattgtgcctcctggagttagacttggatgacaatactcaaatatacatgcatggtaagttggtaagtagctacacaatggacctcattaattagaattattagcagatgttaaattgtatatgttcttatgatactgctaacgaaatctggaagttggaactcacgaaaatttagacactcctaaattaagttgattcttactcctatgtaagagactgcacactaatagaatcaaattttataattgttcttactcgcataaaaa

SEQ ID NO: 6318 - DNA, 1070 bp, Oryza sativa
  Predicted polypeptide sequence is orthologous to G2290
gcactactagctagctgctgctcctccggctggccggccggccggagtgtgccatggccatggcgggcgccggcgactggccgttcgccgccgacgaagcgtacgccgactcgtcggccatattcgccgagctcggctgggccaacgggctcgccgtcgtcgacgccgtgggggagctactgccgccgctggatccaccgggcgagctggccacgccgccgccgccgccgctggatctgccggagacgccggccgggtcctccgcggacggcgccgcgtcgtcgtgctccaccgacgacgccgacggcgggaagccggccgccgcgtccaccgaggcagcgagcaagtcgctgacgcctgggaagaagagggcgcggcaaccgcggttcgcgttcatgacgaagagcgagatcgatcacctggaggatggctatcgctggagaaagtatggccagaaagccgtcaagaacagtccttttccaaggagctactacaggtgcacgaacagcaagtgcacggtgaagaagcgggtggagcgctcctccgacgacccctccgtcgtcatcaccacctacgagggccaacactcccaccacaccgtcaccttcccccgcgccgccgccaccgccgccggcttctcgcacatccacgccatggccgccctggccgccgcacccttctccgcgcaccaacaactgtacagcaacctgcagccgccgccgccgacgatgccgcttgctgctactactccggcgtcgtcgtcgtcgctgctacagctgcctctgcactgcaaccatgagctgcaggttgttgccagctgcggcggctacccgtcgtcgtcgtcgtcgccgccggcgagtgttcttcccgtcgacaaggggctccttgatgacatggtgcctagggcaatgaggcatgatgggtagtacaagcatgcacaccatcgatttaatttggggttaatttgtagcctaattattaatcttaattagctgcttcgatggattaattagcacggtaagtagttacttattcgtgttgagatcactggaaagataataataattaat

SEQ ID NO: 6319 - DNA, 658 bp, Oryza sativa
  misc_feature (19)..(19): n is a, c, g, or t
  misc_feature (111)..(111): n is a, c, g, or t
  misc_feature (155)..(155): n is a, c, g, or t
  misc_feature (159)..(159): n is a, c, g, or t
  misc_feature (183)..(183): n is a, c, g, or t
  misc_feature (200)..(200): n is a, c, g, or t
  misc_feature (240)..(240): n is a, c, g, or t
  misc_feature (243)..(243): n is a, c, g, or t
  misc_feature (247)..(247): n is a, c, g, or t
  misc_feature (254)..(254): n is a, c, g, or t
  misc_feature (281)..(281): n is a, c, g, or t
  misc_feature (326)..(327): n is a, c, g, or t
  misc_feature (494)..(494): n is a, c, g, or t
  misc_feature (573)..(573): n is a, c, g, or t
  Predicted polypeptide sequence is orthologous to G2296
tgagaatcttgtttcggantcgtacaggaacatgggtatgttgctacactgcgcggagggatttacgaacgtgcacgtccattttatccatgtgtataggaactttgatgnttggacattgtaccttcttgagggtgctcaaagtgctaacgccnaacntatctttggtatacggatgttacntaccattttctggaacngctttgcttatttgtggtcagccggtacattggactccgnccnttgngctgagnccccaaaagtattcctccagtggccancctgaaaaattccgtagtgtcgacgttatggtattttgtttctanncccggtagtcccgtccattgtgcgaccggtgaggcgcgaaagcgtatgtgtgtcctacaaatttgtgagtcaccatcccagttggtagctccggccaacctgcaaggacaggtcaagtatccagaggcgactgatcgtaccgtgagttgtccgcatggtagccttgntcactgtacccggattgttattggtgagagtcatttgtgcaccattcttgggcaacctgtgtacatagtcatgcatatntgtatggatcatatggcgtcagaatcatcagataatataattgagacgttttccagttaaaaaaaaaaaaaaaaaaaaaaaaaaa

SEQ ID NO: 6320 - DNA, 729 bp, Oryza sativa
  Predicted polypeptide sequence is orthologous to G2296
atgtggatgcaggaagggcatccaacatgtgtcaaccttacgcctataccacatacagatggccatctctggaggaagtatggagagaagaaaatcaagaactcatcgttcccaagacgttggtgtaaaactgtcgcgatctacaggctatactaccgatgctcttaccgggacgacaggaattgcatggcgaccaaggtggtgcagcaggagaacgacgccgacccgccactctacagggtcacctacattcacccgcacacctgcaacccatcgccgccggccccgacgccggcccatgtcttcaccgagccaccgccggccaaagcggaagtacaccacgcggtgttgttcaggttcagctccactgccggcggccacacggccaataatgcagtgcatcgtcagcagtggcagcctgcggcggctacgatggcggcgggggcccaggcgcagctgtcaatgacgatgagcgacgacgagcgggagcagccgccggcggccatccgttctgcgccgccggcacggcggctgtcgatgttccgcgccgtcgttgatggactcaggcagatgcggtcgtcggcgccgccaacaccgtcgtcgtcgatggtggtggacgacggatgggacacgttctcgtcgtttgatttggatacgtgcgaattcagtgtcgatgacgagttgctctgtggtgaccatatgtatttcccggacagtatgcagcaatag

SEQ ID NO: 6321 - DNA, 1219 bp, Oryza sativa
  Predicted polypeptide sequence is orthologous to G2311
cagaccatagagaaacccaaactagggtttctggtcggatagttcagacgccggagagtgcaggaggcggggggggcttgtggggaggaggcgcgcggagatgggcgccccgaagcagaagtggacctcggaggaggaggaggcgctgcggcgcggcgtgctcaagcatggccccggcaagtggcgcaccatccagaaggatccggagttcagccccgtcctctcctcccgctcgaacatcgacctcaaggacaaatggaggaatttgagttttagtgcaagtggactgggttcaagggataaattaaaggttccaaggataaaagggccttcatcttccacatctccaagctctcagactccgcttctcgtcctacccccaaataaagttgctgaggcttcaccatccgcagatcctgagaaaagctctcaggatgtgaagattccaaattccatggtaatagaagctctttgtgaaattggggatccaaatggttcggatgttgatgcaatttgccactacatagagcaaaggcacgaggtgcaagcgaattttagaagattgcttactgcaaaattaaggaggcttatagcagcgaaaaagattgaaaagattgacaggtcctataggatcacagaatcttatgcagccaaagtttcgcaagcaaataagtctccaagtccaaagaaggatccagccaagccactgaaggcatcgcagaatttaggttcatttgctggtacgagtcctgccctagaagcagctgcagctgcagctatgaaagtggctgatgcggaggccaaatcacaccttgcgaatgagcacatgacggaggctgaaaggatcttcaagcttgctgaggagaccgagtctctcgttacactcgcaacagagatctatgaacgatgttcaagaggagagatattaacaataatgcaagtggcgcaaagcaattttgaattccaatctgttagcggcaacggcagcggcactggttctactgtacttgcataggttggtttgccctgtcatctttggcatgttgttcctccgatgtgtaacttaaaacatgttgttaacttgttatgtacttgggtcgagccggataagacgtttacctcaaaaacgtcaggtgttccgctcatccttaattataattatataaatgtgcatctctcttgcgattgcaagtgtgatcaaagacaaaaaaaaaaaaaa

SEQ ID NO: 6322 - DNA, 612 bp, Oryza sativa
  Predicted polypeptide sequence is orthologous to G2319
gcacgagggtagccatcttgtgtatcgaatagctatagctctccagcagattgatcagtgacgacgacgacgatggcggcaatggcggcggcggcggcggggacgaagaagaaggcgaggaagccgtacaagatcacgaggccgcgggagaggtggtccgccgaggagcacgagcgcttccttgacgccctgattctgttcggccgtgactggaagaggatcgaagcgttcgtcgccaccaagacggtcatccagattcgcagccatgcccagaagcattttctgaaggcccgcaagttcggcctcgccggtgggctcccgccgccgcttcaccctcgccgtgccacgctgctccgggccaacgccgcggcggcggacatgatgccgcccccgtggctgccatcggccggcggcggctccatcggttgctcggcgccaccgtccggcgtgcagcagagcatggccggcaggtcgccggcgtgctactcaactgatgaagcttctttccggccattgattcatagcaatgacaatgactgttcattcatcgagacaccaaactgcatcggatccggtggcgaatcatggatcggtgatgatgccttcttcatg

SEQ ID NO: 6323 - DNA, 468 bp, Oryza sativa
  Predicted polypeptide sequence is orthologous to G2334
tttttttttttttttttatcgtcgactcgacccaaccggatcgagcgccgccgccgccaagccgccaccaattcaattcatcgatgattcgagtcacggatacattgagtgttttataccgtatcccttctctctctctctctctctctcttacagccaaacagtattacagctggcgaattctttcccctattacaagaaagatgttacttggcccacattggcccactatagcgagggttaggaacacgagctcgaatgggcttctttgctgtagcgcttgaagtctcttctatctcctgctctgctgctatctccagttctactgcattgttctcctgttctccatcaggcaagatttgaaggtcgagggggcaacggcgatggggacgactgtggagacatcggtagccctcttaagtcggcggtagcgtcgagggggttggctcctcagtaccatcggatgga

SEQ ID NO: 6324 - DNA, 1729 bp, Oryza sativa
  Predicted polypeptide sequence is orthologous to G2343
gaagagaaggtagctcatgcatattaaaagggctaaacaccaaccaaaccctttgctcctccatgacaacaatgtcatgttgctagcagctagatcaagaatatattcaagatagttaattgctgcatataggttttgcaagttgcagaacttgcagctatattgttgttacactagctgttcatatcttggattccagtgatatctagagtgcatgcatggggcatcactcttgctgcaaccagcagaaggtgaagaggggcctctggtctcctgaggaagatgagaagctcatcagatacatcaccacccatggctatggctgctggagcgaggtcccggagaaagccggtttgcagcgatgtgggaagagctgccggctccggtggatcaactacctgagaccggacatccggcgagggcggttcacggcggaggaggagaagctcatcatcagcctgcacgccattgttggcaacaggtgggcccacattgccagccacctgcctggccggaccgacaacgagatcaagaactactggaattcatggatcaagaagaagattcgcaagccggcggcggccgccgccgcggcgaccacgacgagcccgaacaacccgccgccgtgcagcacggcgacgtcggaccaccaccacctgccgccgccggcgttcggcggcgctgatcaccacctgcagctcgacgccatcatcaaccagaacctgatatcatccctgccgccgaagctcgccaccggcgacgactcgccgccggcggtgcccgggctgccgcaccactgcccgctcttcatgttcgacaccaccaccaccggcgccggcggcgccatcagcccgccgccgccgtcatcactgatcccaacccacctccaccaccaccaccacccgttcatcgccagcttcacggcggcgatggccgccgacacgccgagctacctgcccccgctggtcgacggcatggcagccatgggagcggccatggattgcagcttagaagatggccaaacagccgccgccatggccgccaccaatggctactaccagcatcatcagaagcatcagcagctggagattgagctggaggaggaggagcagaggcagctagggcatcatcatcatcagcatcaccatgagcatgagcatgaaaatcatcagtgggatgaagaagaagcacagcatctgctgatgtgggatcaagaagtactaacatcatccaacttggaggccatgcaaagtggtgctcattccctcctttttatgggaccaaatgaccatgattaagttggtaataataacctatgtctaccccccccccaattttttttctttttgggaaaaaaaaacttgcatgtgcatattttgcatctcacaacatctgatcccatctctgatctgatcttgatctccctttgatcaatctagctctcactactaccccatctgatctgtctatacatgaaataatgaggttttgcaaattaaaggcgcgcgtaatttattgtgttttggattttttttctatctctctccaagagcttttattttggtttttttacttttttttttggattggagtgtgaagactgaatagtgtgtgtcaattgggttttttgtaaagagaccaccttgtatgagtgcatggcatggcactttggagtgtgtaatttgattgatgtatctaagtgaatttataataaacacaggaggatgac

SEQ ID NO: 6325 - DNA, 494 bp, Oryza sativa
  misc_feature (52)..(52): n is a, c, g, or t
  Predicted polypeptide sequence is orthologous to G2346
tttttttttttttgtacaatcctaatttcactcacctccaacaacaatgatncggttgtacatcacaatttacataagacaatttacataagattctttgttatacatcactcataactccaaagttcacttgtctactacttcctctgtttcacaatgtaagactttctagcattgcccatattcatatagatgttaatgaatctaggcatatatgtgtctagaatcattaatatctatatgaatatggatctagaaagtcttacaatatgaaacggagggagtatcagttagcagatcaatgaaccaactatgacacaattgtagaccagagaatattttagaaattgacaacattacagctacgattgaacaaatgctaagaaggataaagaacacataccagccttatgtcctcttcatttgagtagtaactcttaccttttggatcaacaacttctagggaccaccacacagtgctggcgtgtaaatct

SEQ ID NO: 6326 - DNA, 2917 bp, Oryza sativa
  Predicted polypeptide sequence is orthologous to G2348
ggtcctagtcatcggacgccgcccacctacccgactacccgaggcagcctctctctcctccctcgcccaccaccacacgacacgagacgagaagactgattcattcgctcgcgtacacgcctaggcgctccgagaattcgtgagggaatcccgcatcgccggagccgatcggcggcgccgcgggcgggtggggggggggggttagggttagggttttgggggtggcccaccggggatggacgcccccggcggcggcggcggcggcggcggcggcggaggtggggtggatgccggcgagcccgtctgggactgggggaacctcctcgacttcgccgtccatgacgacgactcgctggtcctcccgtggggggacgattcgattgggatcgaggccgatcccgccgaggcggcgctgctcccccctgccccgtcgccgcagccggcggaggcggaggcggaggccgcggggccggcgtcgctgccgtcgtctatgcaggcggagggaagcaagcggcgcgtgaggaagcgcgacccgcggctggtttgcccgaactacctcgccgggagggtgccgtgcgcgtgccccgagattgacgagatggcggccgccttggaggtcgaggacgtggccacagagttgctggcaggggcgcggaagaagccgaagggtgccggccgtggtagtggtgcggcagtcggcggaagtggtggaggggctagccgtgggacaccggccgagatgaagtgccaggtgcctggttgtgaggcggacatacgtgagctgaagggataccaccgccggcacagggtgtgtttgcgctgcgcgcacgccgccgctgtcatgcttgatggtgtccagaagcgctattgccagcagtgtggcaagtttcatatattactagatttcgatgaagataaaaggagttgtagaaggaaattggagcggcacaacaaaagaagacgaagaaaacctgattccaaaggcatattggagaaagatatagatgaccagttggatttttcagcagatggtagtggtgatggtgaactaagagaagagaacatagatgtcactaccagtgagacgcttgagactgttctgagcaataaggttttggacagggaaacacctgtgggttccgatgatgtgcttagttctccaacatgtgcacaacccagtttgcaaatcgaccaaagtaaaagcttagtgactttcgctgcttctgttgaagcctgccttggcactaaacaggaaaacaccaaacttaccaattctcctgtgcatgacacaaagagtacttactcatcctcgtgtcccacaggacgtgtatcattcaagttgtacgattggaatcctgctgaatttcctcgacgcttacgccaccaaatatttgagtggctttctagcatgcctgttgaactggagggctatattcgtcctggttgtacaattttaactgtatttgttgcaatgccacaacatatgtgggacaagttatccgaagacacaggaaatcttgtcaaaagcttggtaaatgctccaaatagtctcctgttgggtaaaggggccttctttatccatgtcaataatatgatatttcaagtattgaaagatggtgcaacattgaccagtaccagattagaggtacagtccccgaggattcactatgttcatccatcatggtttgaagcaggaaagcccatcgatcttattctttgtggaagttctcttgatcagcctaaattcaggtcacttgtgtcatttgatgggctgtacttgaagcatgattgtcgccgtatactgtcacatgagacctttgattgtattggaagtggggaacatatacttgattctcaacatgaaatattccggataaatattaccacatcaaagctggatactcatggacccgcatttgtggaagtggaaaacatgtttgggctatcaaattttgttcctatccttgttggtagcaagcatttatgttctgaactagagcagatacatgatgctctgtgtggttcttcggacataagttctgatccttgtgagcttcgaggacttcgacagactgcaatgttgggattcctcatcgacattggatggctaataaggaagccatccatagatgaatttcaaaacctactgagtttagcaaatatccagagatggatatgcatgatgaaattcctgatacagaacgattttatcaatgttctggaaataatagtgaactcgttggacaacatcatagggtcagagcttctttctaacttggaaaagggtagactggaaaatcatgtaacagaatttcttgggtatgcaagcgaagctcgaaacattgttgataatagacctaaatatgacaagcagagacaggttgatacaagatgggcaggtgattatgctccaaaccagccaaagttgggcatttctgtgccacttgctgaaagtactggaaccagtggagaacatgatttgcactcaaccaatgcagcttctggagaggaggaaaatatgcctctagtgactaaagctctcccacacaggcaatgctgtcaccctgagactagtgctagatggcttaacgctgcctccattggtgcttttccaggtggtgccatgagaatgcgtcttgccaccactgtggtaattggtgctgtggtatgttttgcagcttgtgttgtccttttccacccacacagagtaggggtgcttgccgcgccagtaaagaggtacttgtctaggaactactcatcatagttgaagctagattagattaaccttcctgttgcttttcccctgtatcatatgcatgtacctttctaatttgaggcttagcttgtgcatccgatgttcaaatatttgtaagaggacccacagacataaatgcaaatttttgcagctttttttggc

SEQ ID NO: 6327 - DNA, 1195 bp, Oryza sativa
  Predicted polypeptide sequence is orthologous to G2371
acacaacacaccatcatcatcttcatctcctacctcctctcctctcctctcctcttctccactacccaacttttgctcccaacacatctttgtttcgatcgaccgatcgatcagctctagctcagccgctactcctacgtcaaggagaagcgcctcgacgccggcgacgtcgtccacttcgagcgcgtccgcggcctcggcgccgccgaccgcctcttcatcggctgcaggcgccgcggcgagagcgcgcccgcgccgccgcccgccgttcgcgtcacgccgcagccgcctgccctcaacggcggcgagcagcagccgtggagcccaatgtgttacagcacgtcgggctcgtcctacgaccctaccagccctgccaattcatatgcctaccatcgctccgtagaccaagatcacagcgacatactacacgcaggagagtcgcagagagaagcagacgccaagagcagcagcgcggcgtcggcgccgccgccgtcgaggcggctcaggctgttcggcgttaacctcgactgcggcccggagccggaggcggatcaggcgacggcaatgtacggctacatgcaccaccagagcccctacgccgcagtgtctacagtgccaaattactggggcagctagttgatgagatgatgaggagatctgaggcctttgcttgcagaatcctaaccaccaacagtgaaactagttactactaccaccagcctactactactacactctgaaccaagtgacaggttcgattgaattgacctgttggaagggaaaaaagaagaaggaagtggggggagatcccttgtttcccgggcaatcttccttccatgaatcatcagagtgccccttttcctgggttttttttacattcttgtcttccagaaaccctacttacagtacgggggcccttgcagcaggtggggaggtttcaggaaacatcaggttgaaaaggagagggaggagagagatggtgacacaccatgagaaacaaacaggagagagagagagagaggaaaaattgacatgttttgcaagtatgtatgtgtcatctgtagtatgtgactgtgagtgggtccatgaacaaactgtgaagttgatgtatccttctcctgctgcctcccctgaacctgaagaaacaaagtaataccccaatggggattttgttctcttccccttttcttctacc

SEQ ID NO: 6328 - DNA, 1642 bp, Oryza sativa
  Predicted polypeptide sequence is orthologous to G2371
gtctctacaccgcacaccatccctgctatccctctccagcactagcagcaaaagcttttgccacaaaagagaagtaagctagcagaaatggccatgaaccaccctctcttctcccaggagcaaccccagtcctggccatggggtgtggccatgtacgccaacttccactaccaccaccactacgagaaggagcacatgtttgagaagcccctgacgcccagtgacgtggggaagctgaaccggctggtgatccccaagcagcacgccgagaggtacttccccctcggcgccggcgacgccgccgacaagggcctgatcctgtcgttcgaggacgaggccggcgcgccgtggcggttcaggtactcctactggacgagcagccagagctacgtgctcaccaagggctggagccgctacgtcaaggagaagcgcctcgacgccggcgacgtcgtgcacttcgagagggtgcgcggctccttcggcgtcggcgaccgtctcttcatcggctgcaggcgccgcggcgacgccgccgccgcgcaaacacccgcaccgccgcccgccgtgcgcgtcgccccggctgcacagaacgccggcgagcagcagccgtggagcccaatgtgttacagcacgtcgggcggcggctcataccctaccagcccagccaactcctacgcctaccgccgcgcagcagatcatgatcacggggacatgcaccatgcagacgagtctccgcgcgacacggacagcccaagcttcagtgcaggctcggcgccatcgaggcggctcaggctgttcggcgtcaacctcgactgcgggccagagccggaggcagacaccacggcagcggcaacaatgtacggctacatgcaccagcagagctcctatgctgccatgtctgcagtacccagttactggggcaattcataagaagattgactatgagatctgatctgaggccatgcctgcatgatcataattcataagtcctagcaagcaacagtggaagaactagttgctactgctctgcattcagtgacaggtttaaattgtgacttgtggaaggacaaggaaggaagtgggggggaactcccttgtttcccgggcaaatgcatattccttccatccccatagtgccttttttctaggttattttcttcttcatcttggcttccagaaaccctacttactgtatgggcccctggcagcagacatggatggggaggtttcaggaaacatcaagttgaaaaggagaggggaattgaagagacaggcagagagctgtatgtatgtcagtatgtgtcatctgtctgtatagtgggtccaagaacaaaccctgaagctgatgtattcactcctgcctcctcaggaaacataactttatccccatttcacctcttctactgtgcttgacctgatgcaatcaattgttgatggaccagatgcaattatgcaatgcttccatttgttgcaatccaataggttcaccgattacactgtgtaagaaattaaggagtgcatgtgcaatttattccaactttttagaaatgacttacatggtaatttgtctgaataaatcactatgatgttaatagtatgactaaagaaaactcccgcaaacgacaagcagtaaagaaattacgtt

SEQ ID NO: 6329 - DNA, 237 bp, Oryza sativa
  Predicted polypeptide sequence is orthologous to G2371
atggcacatcagattttggttaatgaatcacaagcaagcaatgtagcaggtggcgctagcactggtacggcagtgaccagcggagacaggaggccagatccatacatgagtgcatgtgaagccatgatgggtatattcctcattgttgtctacaccaatgagatcctagcatttaacagtcgtcaaaggctagacagttttaaagaatctcaaaaatgtgttggtcatgatctataa

SEQ ID NO: 6330 - DNA, 2037 bp, Oryza sativa
  Predicted polypeptide sequence is orthologous to G2372
aagcgatcgattcgagtccccttcccttcctccctaaaccctaaccaaacccccaccactctctttccgcgcgccgcgtgcgacgatggcgcgcccgccagccgccaccgctccgcctcctcctccgccgccgccgccaccgccaccgccaccgatcgaccgcctcgtctggctcgcctgcgccgccccgctgtcccgcatccccgtcgtcggcacccaggtctcctacttcccagagggccacgccgagcagtgtcccgcccctctcccggatccgctcccctccgcccaccgattcttcctctgcaccatcaccgccgtcgacctctccgccgacaccaccaccggcgagccctacgccaccatctccctcctccctcttcgccacgacgcccccgcccccgcccccgcccccgcccccgccgccgccgaattagcagaagcagaatcacaggagttccgctactacgccaagcagctgacgcagagcgacgccaacaacggcggcggcttctccgtgccaaggttgtgcgccgatcacatcttcccggcgctcaacctggatgatgacccgcccgtccagagcctcaccatgggggacctgcagggcgactcgtgggaattccgccacatctaccgcggcacgccgcgccggcacctgctgacgaccgggtggagcaagttcgtgaacgccaagcagctggtggccggggacacggtggtgttcatgtggtgcggggccccggcccccgagaggaagctgttggtcggggtgcgacgcgcggccaggtactcgggcgagtcggcgtgcaacgcgcgggggcgggtgcagccccaggaggtgatggaggcggtccgactggcggcggagcaggcggcgttcagggtgacctactacccgcggcatggggcgggggagttcgtggtgccgcgggtggaggtggataagggattgactactccgtggaggtgcgggatgcaggtgcgcgcccaggtgatggaggccgaggacacccgccgcctcgcttggctcaatggcaccctcactaacctccgccaccaacaaatctggcgcactctcgaggttgaatgggatgcctccgccgcgtcatcttccatgaaaaacagatttgttaatccttggcaggtccagcctgttgatttccctcctcttcccatggggctaaagatttctaacaacaatattagtgcacctgtgtgcaatggggattcactgctggtgccaccgatactaatgcacccgcaacctcaacctcccgctgacattcagggagccaggcataacaatggccatgcctatgcagatataccctcttcatcaacaccatcaatggtgaggactcagcagctgttcccaagggatcttcagattttagttccccacaccgacattgtcactcctcaaaatggatcaccgcccgacaaccccgtaaacacgcctctttctgcatctgacggaatgaagaccatacagctgtttggcgtcacaataacatcacctgtgcaaggagacaccaatggcgctttcgcttcagcacaagtgaatcaggttccagagggtgtagatgatgaaactgctaccgaagaagcttctgacacaagcctacctgactctcttaccaatggccacaatcaagatggtgctaggctttgaaggaatatcccattaaacgtttccaagatatggctggaccagatttgtttctaacattttggtctgttctgtttcaccctccggcagtttgacgggatgtggtgttcttatgcatgcatttaatctggagtttaggctggcaactatgccgcatggtccagttaagtttggagtaatctggagaaacgttcatttctttgttagaattgttatagagcagcactgctctgttttattttccttgaattttcacacctgcactttgtttgcttgttgtttgtttacctgtattgatctgataaacatctttaatttcctggggaaccgttgaactctgctttgctgttgcggctagcttttcc

SEQ ID NO: 6331 - DNA, 201 bp, Oryza sativa
  Predicted polypeptide sequence is orthologous to G2372
atggtgtggatgttggtggcgcactcccgcgtgtactacttcgcacagggccaagccgagcatgccaacggcggcgaggccgcggcggagctcgccacagcgacgggggccgcgcgcgcttccgacgtttgtgctctactgcatggaagggaccaggcgcagcaaattgagtggcgcattgatagtgcccttaggggctga

SEQ ID NO: 6332 - DNA, 1056 bp, Oryza sativa
  Predicted polypeptide sequence is orthologous to G2382
atgggggtgacctgcccgcaaactcgacggccgatccatctcgccgagccacccctatccccggaaccaaaccctagctccccgctcatggacgacggcgcggcgcccgccgccgccgccgccgccgaattaccctcgccgtcgccctcctcctccggcacctccccctccccgcgctccaagcgccgccgcaccgaccgctacgcgcaaggcttcgagttcgccccgcgccccgcccccgcgaccgcgaccgcgaccgctccggcgccgacgcccgcgcgcggcacgcccgagtggtcggagggctccaccttcgcgctcctcgacgcctggggcgaccgcttcgtgcgcgccggccgccgcagcctccgcgcggacgagtggctggaggtctcccgcctcgccgccgccgcggcctcccgcccccccgggtactactcggagcagcagtgccgcaaccgcatcgacaccctcaggaagaagtacaggaaggagaaggagaggatgcgcctcgccgcccgccgccccgaccgccccgaccgcccctcgccttccaagtggatctacttcgacaagatgcagtctctcatgtgcccaccgccgctcccgttgcagccacccgtagtgacgcgccgccgagacacgcagccggtgccgcgccaatcttggggtctggacgccgcggagtacgtgctgggcgggtgtgagaacgcgggaacaagggattctgggtctggtgcggaattgggtgaagagcagccaaacgaggctggtgcagggaaaggggaagactttgagttgctcgtggagtcgattcggaagcttggggatgtctatgagagggtggagagtagcaagaggcagcacatggctgaggttgagtggttgcggagggatctccaaagggatcttgaggtgaggaggagggagattttggagaaggcgcaagcagagattgcgcgtctcactgaggaagatggggaggagggtgacctcaaggagggtgagggtgatgataacaagaggtttggggatgatggtggtggcgaagagtag

SEQ ID NO: 6333 - DNA, 2777 bp, Oryza sativa
  Predicted polypeptide sequence is orthologous to G2404
gattagctaaaactgtgaaaactctccattttccttgcctctctctctccccacccaatcccaacccaccacctctcctctcgccgccgccgccgccgccgccgcgcgccgttctatggcctacacctcctcctccctccacctccacaagcacctcctcctccccaagaccaacccctcctcctcctactcgcggcctccgcctccgacgtgtggtgcgcgcctgggataccgttcgccgcggaggcgtcgtccgtggactgcgtggtggcgcggcaccagatggtggggagaggccgtggcggcgacgcggagaggccgcacagagagagaccgtgcctgtccaggagggtgaccgtgcaggagcagatatcgtcgtcgttcatggactcgccgccgccgccgcacctcgacgtcgcgcccttcttcggcgccgacctcctcccctccggccgcctccgccggatgcgcgggtaccgccactcccccgtcggcctcgaggaagaggtaaaaaacgtcacaggctcacggtagtagcagcagtactagtactggcacagtagcgcacactgcaacaaacgttcgttcgtttcctcgttgcccccacactgcattttgcttgcttgcacacttgtcctgagccaccgcattgcatgcatcggtagatacatttttccaacgtactcctaagtcggagatggacacggcccgcaacaagtgcgcatgctgacagcggttggtggtgcgacacgctgcctgcctgcataagattcccgtgcgtagggtagtttagcgcgtgatctgacatgcgtattaagcagctgtaacgcgtgatatagattaatagtagtagtattagaagtggagtagattgattgtctggtggtgcgcgagtgaacctggggggtggccggctggccgggtgggcgttggaagtggttgacttgcatctttcgtgcgctaaacgtgacgtgagatcgtggccttcttggaggttaactaatcggcagccttacacaggcgcgcacaataattgtataagcggttgcagttgcaagccatggcacctgcattatgcgcgctggttagcgtagtggccgtacactcgtttaggattaatgcggctgagaagggagggaacgagacagtgggatgtggccacagctttggaaagagacctctcaaccatggtcatacacttccatgaatgcttctcgttgtgtgtatacaccgtgccaactacaagtataaatgctggatactcttgctgagctgatcagaaatgttgccggtaatggtcaattgttgtctcaacggtgctagtatttcaggatgcgggcaaggagtgctggagcacacctgggaatgccaagcaatagtatggtttattctatctactgtcatgctgttctgtggtggatcgtacggttggtaggaatgggcatgctggtatggtgcgtgaatgattggttgcctccgatggcagatcgagagtcctagcagttcaccatttatgattagtgctcggctgtgctgcttgactgaactattcttttggtgcttaagggggaccaacgctccttatcatgttcctgttgcttcagtcataatcagatctagagttgtagtcattccttctggtccttctggatttcatgtgggcatgtgattggtgatgactccttaataatagctcaacatcaagatccacaaggattgtcggtcccgcactgccattgcctatcaagatatatatttgaggggatttgctttaatgtgctttggtgcctagttcagggaagtccatttccttacctataaacattttttctatctagttttacttctgtgctatacctctgttttctgacttaggttttccactgtcataagaattcatatttgattttggtgcacattccaaacagtcgtaaagaaagctactatatatttatctggtgcttcaatctaacctttctatgtaatcgtaaagaatataagagatacgtcagtgcagctgtagaagcatatttagctgcacactttgtactctacttggaagaataaccagcccgatggtcagtgattgagggttaacttgtgctaagcggtgcagttgttaatctgtgatcttcctggcagacatatacataattatgcatgttgctagctcaataagcagccttatcaaaggtagcgagttcaaatacttaatgaaactgtttttgatatggcagatcatgatgtttcagacaagagttctgttgggaggaatgagcatgtatgatcggtaccaggattggcgccttgatgttgataacatgacatacgaggagttgcttgagcttggagataaaataggttatgtcaacactggattgcgtgaggatgagatagttcgcaaccttaggaaggtcaaacacccagcctttgactcctcgttccggtattcaacagaaatggaaaagaaatgcagtatttgtcaagaagagtttgaagccaatgaagagatggggaggctggattgcggccacagctaccatgtttactgcattaagcaatggctttctcagaagaacgtttgcccagtttgcaagactgccgttaccaagacttgaagtccggactccgggcaacgacgattgtatacctgggtcaaactttcaaaacatgtttgtttgtgctctgtacagtcaattacatatgttattgtataaacacatcatccattcttttgcatttgcagatagaaatgccatattgaggcatcctttatc

SEQ ID NO: 6334 - DNA, 984 bp, Oryza sativa
  Predicted polypeptide sequence is orthologous to G2404
atggccggcgaccgccgcggcggcggcggcgtcgtctcggccgacggggagcgacggcgggggatccggcgcctgctgctgccccgcggcgaggggtcgtcgtcgtcctcgccgccgcagccgccgccgctgcaggcggaggaggggaggcggaaggggttcgcgtcggcggcgctgcgcgggctgggttgcacgtcggccgcggcctcgcaggcgtacgcgcccggggccggggcggccgcggcggcggccgtgcggtcgtcggcggactggcacgggcggaggcggaggagggggaaggagaagaggaaggagaggggaggaggaggagggggcggtggaggcggccacctcgtgggtggagggatcggcgccgacgtgtggtgcgcgcctgggataccgttcgccgcggaggcgtcgtccgtggactgcgtggtggcgcggcaccagatggtggggagaggccgtggcggcgacgcggagaggccgcacagagagagaccgtgcctgtccaggagggtgaccgtgcaggagcagatatcgtcgtcgttcatggactcgccgccgccgccgcacctcgacgtcgcgcccttcttcggcgccgacctcctcccctccggccgcctccgccggatgcgcgggtaccgccactcccccgtcggcctcgaggaagagatcatgatgtttcagacaagagttctgttgggaggaatgagcatgtatgatcggtaccaggattggcgccttgatgttgataacatgacatacgaggagttgcttgagcttggagataaaataggttatgtcaacactggattgcgtgaggatgagatagttcgcaaccttaggaaggaagagtttgaagccaatgaagagatggggaggctggattgcggccacagctaccatgtttactgcattaagcaatggctttctcagaagaacgtttgcccagtttgcaagactgccgttaccaagacttga

SEQ ID NO: 6335 - DNA, 1095 bp, Oryza sativa
  Predicted polypeptide sequence is orthologous to G2404
atggctcgccgcgacggcgtcggcggcgacggcggcgcgtcggcggcggagcagcagcggagagtagcgctgcgtgtgctgctgtcccgtgcggaggcttcctcgccgccgccggcgacggtggaggaggaggcgcagcgggggaggagcggtggtggtaacaaggggctcgcgtcggcggcgctgcgcgggctcgggtgcacgtcgacggcggcgctgcgtgcccacgcgccggcttcggcggtggaggtggcgagtagctcggagcggtggcacgggaggcggcggcggaggaaggtgcaggagaggcggagcgcgaggggcggcggcggaggaggaggaggaggcgtggcgccgcccggccccgcgccggcggcggccggggacgtgtggtgcacgtgcgctcccgggataccgttcgccgccgaggcgtcgtcggtggactgcgtcgtggtggcgcgccaccaccacgcccaccacacggcggcggcgatgggctccggccgccgcggggaggcggagcggcgccacagagagaggccggccgctcctcgagctcgaagggtgaccatgcgtgagcacatatcctcgtcgctcatggactcgccgccgttccccgacatgccgctcctcaacgccgacctgctaccaccaccaccctccggccgccaccgccatggataccgccacccccacgtcggcgccgccgaggaagagatcatgatgttaagaacacggctattatggggaagattcggtatgcatgatcagcaccaggattggcgactcgacgttgacaacatgacatatgaggagctgctggatcttgaagacagaattgggtatgtaagcacagggttgcatgacgatgaaatcgctcgcagccttaggatggtcaagtattcagcattcaaccccaagcattttgcaacagaagtagaaaggaattgcagtatttgtcaggaagaatttgaagcaaatgaggaaacagggaggctgatctgtggccacagctatcatgtgcaatgcataaagcagtggctttctaggaagaacacctgccctgtctgcaaaactgttgtatcgaagacatga

SEQ ID NO: 6336 - DNA, 1255 bp, Oryza sativa
  Predicted polypeptide sequence is orthologous to G2423
atatcagaaaataccaaaatacagcgtattagattttctacatggtatcagagccgtagacaaacgtcgatcgatcctcggttccagctaggttccatccgcgctgccccagggagatgagatcaatttctccctggggcaccgcaccgcattagctagctagcctctccaatcatttacagattagtttaccgcatatcattagatgcgttttctaataattagttttagatctattagctagccacagaaaaccatatgatcgtcaggagcaatgcggcaggtgttacaggagcagacaacgtcaacaagcatcataccatccggcctcatccatggatcgatctgcatcgccgctgccgactcgtctacatagatggacacctcgcgtcctctgacagattaatctgcaagacgcttcatcgacgacatcgaccgtgtcctctacgacggcaacgaccgcgtcaccgacaacggcatcgatcacgtcatgtacgactacaacgactgcatcaacccggcatcactattgtggtgaccgctatacggcgcagaaggaccaaccaaagtggtggcctcattgccaacgacgtcctctgacatatgcaagaggtccctaatggcatcctctgacatctacaaggtgcaagatgctaacaattacagtttttgtcttcacaccatggcgtaaatttttttttttttcgcctttggctatatgcggctacaccgacaaccacagttacttcatgatcggctacattgacgaacgtctacaacaaaaatcattgacgaaaactccagtccaagcgtccgtgtcatcgctatcgtccatgacactcccgctatgactgcgggagggaatagaggagagtcaagggacgacacagaaggggacgcaggcaccaggtggaggaccgtccatcagagatgcagtcgatgatggtgagtcaaagaaagatgaagaaatagaagatttcaaatccagtcgcaatcgttcgcttcgctcccgttacgactgagggggaatgttagaagtataatatggtagttagagataagagtcaaatacaaattatagagataagatatatcctagagatagaatcctagagataagatagagtcctagagatagaatcctaaagataaatctactcttatttgtattgtactccaagtctctatcccctatgtactcctatatataccccatgagagggtcgatccaatatatcagaaaataccaaaatac

SEQ ID NO: 6337 - DNA, 1105 bp, Oryza sativa
  Predicted polypeptide sequence is orthologous to G2453
gacgttgctcgtcgtcgtcgtcgttgtcggagtcgccatgtcgtcggcggcgcgccaccattgctccggtctccgggagcggctaggctgcgtgcagtgcagcttctgcgccaccgtgttgctggtgagcgtgccgtgcagcagcgtgctcagggtggtggccgtgcagtgcggccactgctccggcatcctctccgccgtcaacctgccgccgtcgccggtgtcggcgtccatcgagctgactccacaggtatgattcttttcagcttcagttgatgaaaatgattggatgatgtgcagaatctgtactaacctgacgagatgaaacaggagctggacgctggtccgccgccgggggagtactcggatgagagcagcggagacgatagggagggaagagatgcagaggacgatgcacctgcacctgctgctgctgctgttgcaaacaagcgtacttgtcctgctgttttctcttgatcagtttgtctgaagatgataatgacgatcatgatgggctaattaagcatgttcttgaaacatttctgcagcgccagggaggaagcagcggacgccgtctgcctacaactgtttcgtcaagtaatagcccagaaaaacaaaatgagtatatactgtgatcatagctagactgagggccaattgcagagcatcacctagagcatacatggctctgaatattcttatataaatgtcccccctcgatattcaggtgagacttgagaggtgatggaagtattaacattcctttttgttgtcagggaagagataaagaggatcgaaagcatggagcctaacatcacccacaaacaagcattcagcacagctgctaaaaactgggctcacttacccagaatccagcagaagcgaggcagggatagctgctgaactacacctgcaaaacaaggcaaacgaaattaatgggcacgagtaccaggcagcagtgagctactaggcaggttcaggaaaaatccaagttgtagctgtccagataatcttgttgcacatctcaagcacgtgcttcctgaattcttctctttcatgtgataaatacagcaagttttttttttcgactactcggttcttaacc

SEQ ID NO: 6338 - DNA, 4830 bp, Oryza sativa
  Predicted polypeptide sequence is orthologous to G2455
gtatatactacttccgtcccaaaataagtgcagtcgtggatatctgtgtctaatgtttgactgtctgtcttatttaaaaaaattatgaaaaaattaataaaattagtcacaaaaagtattattcatgttttatcatctaataacaataaaaatactaatcataaatttttttaataagacgaatggtcaaacgttggacatgaaagtgcaaaactgctgatcgcacccaaagctgctagctagtagtacctccacttaccagaaaccgggttagccctgacggctaaaaaccgtcaagaataaacgaatggaaggggatgcttgatcctgtagccccatctcaagtgacgtgcaatatactgtacataaatgtgtacatgaacttgaattgttgtattatagtctatataccactatatacattgataagacaagaacaaagggttttggaactttgttcttcatcgagggaattaatagcattaatacaaaaatcgtacattgttttgtttgacagattaacagtataatgcaatgttatatttaattcatgtttttcttgactccgtaaagatagtcaataaagttgtgcatgcatggctttcttgtcaataaatgtggttcttgcacattgtgcataccagtcacacattttccattttgttgatgttgttaggcccaatgttatttggtatgaaaatgatgccatactgccacacacaaacgaatgcgagatgacaaccaacgttaaacaaaaaaaaacagaacctatctgctgatcaaagacaaaccctgcaagccagtaacggtaatgcatgcagtagtactgcactaaacagcagaagtcctaaataattaattcaccatggaatattaagccccctggcaacgtagactcttctcctaccactcattctcccaaataagctacccactccgtccaacgatataagcatttctagattgttaagtactccctccattccaaattgatatacatatagtttttttgaggttattcctaaatgatctacatatttgtgttcattcattaggtctattcgttatttgtgcattggagtaaatggacattgatgcatgcatccatgcacacaagtatttataacccacatgcaatatcatgatttgttattggctaggagatagtggggatggtgcatgcatctagcttgttgctagagtaaatatagtatgagagagttattagcttttcttggtcttggtgtacatatgaaatatgtagatcaatttggaatggagggagtaaatgtgaaggttaaggagaaaagactttagtctctctcgtttaatgagagattgatggttggggatggaagggtgattgagagtaagaattggaggtgattggtgtaacaagtacacaagtgtatgaatgctattattaattcttggataaaattcaaatgcttatattgttggacggacggagtactagctatatagctagtcacaccagcatttgctaattggctgctcatctgctgtacccacatttcatttggccttgatctttccaacctctccttgcactcagcttgcagcttagctagctgcacacactgtcctcccacaagacaccccaccaaacaccttttcttcctccctttcttgtgtgtgcccccactcagatcagccagcagctggtagtaccctctctagcttattgcagggccatatcctctgctagcttagcttctctcacaaaccccttaattccatctcatagacagccaaaagggtcaagaggaaattgggtttgtgctctccccaaaatcctccatatatagtgcacaggaggcatcattctgttcatacatatctctcccttgcttgctttgctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtatcgtcttcctccctcatctctttctctctctagctctctctctctctctcatatcttgtgtatttctgttctaatttgaggtgtttgccggatctatatggggagttcaatttttttgtatatttttttgaaggggctaatgcgtgcatgctgtagtccatgcatagaggtagcctaagctaggggaaaataagcaccctaatcaagtatgctagctacttgtttactaaactaattgcactttgttttgtcctggataagtttgtaattttatatttctggagagttctccagtacatcgaaatccagcaatccggtctttttgcataaacttccatgtacatggtaacagaaatgcacagattttctttatggcaaacataaaatcatataaatagaaggatattgcaaacatactttgtactatttcttttcatcttctccaacttttcaagaaaaaaaaatccatatcttccacccaagggtgtcatttttgtatctccttgaaacaagactgtttctctctgacttgatccaccttgtacggttttaatttatttttacagaagggataaactcttcttggttttggatgagaaccaacatatttgtatatatcctatagcggtgcattatccagatccaacactatttgattatattctttcgctcatcaggcaaaatatcttgtacaaaatggtaattttccttggaaagaatgcttgatttgctcatagagaaaaaaaaaagtattgtccccgacatacatagtttttcgacgcatggggtcatacacatttttggaaggaacatgtacataagataatattatctgagagctttctcatgtatggatctactatactaccacaaaaagaaagaaataatttcaggtcaaattaaacttttagatgcgtgcaggtgattaaagctagcatctttaaccattaattattgcctctctagctttagctagctgctccatgcgataataccccagtgtctgtactgtgctgcacacttggagctattcctctgattattggctgtgccctgagtgtgcccacctctccaaaaccgaaattttttatgaataaacaaattttaattaacaaaaaaggctttaagctgctgcctgttgctaccacatcctgcagctttgtctctcattctgcacatgtgcagaaagaagtggatctgcctgtcatgtcattttcctctttgttgatgtttgcgcaggtgggtctcttctacatactctctctagctagctagtagtagtagctatattgtgtgtgtgtgagtatgcaatatatatgcatgcgtctcttagtatgtgttgtgctgaaagagaggagagtgtgacatgaacttttaactgtaaaagaagtgtgacatgaacttttaactgtaaagatgcctcctcttttttcatgctttttttttggaaaggatgattgtactgttcacacgaccaaatctaacttacctaagtatagatctcagtcatctgcacatagatttctctatctcaatctcaagatctgtctctctgctgtgtctctctcttcctgtttgtttgtgtgtgtgtgtctgactgatgagatgaatctagggagatattcttctttagacctgattgagatgtcatgtctctgcctcctggaggccttgagtgtgtgagatgcatcatgcattgcatggtagtaagagaaaacatgcatatatggctcaagcttctccaggcaaagagctagctaagctctcaaaagggagacacacttgggaaaaggtgttatttgtgcatgatggccaaataggactcaaaagacgatatggatatgagacatggtgcaacttttgacattcctagctactagctagctactttgtcatcacacatatatattgactacatacacatatatattgactacatacacacatacacatatatattgtgaaacggtacgtagcctagtggttgcagtgacctgagtaacaccccaaggttctgagttcaaatatccatagaagtgaattttagattgggttatattatggatggctaagttctctgtgtgataggctaagttcctaatttaaaacgggttatttgtgcttgataggctaagtttttatccaattggatatagaggccgggtaaaaaaatacacttctctaaaaacacacacacatgcattggcatttgacaattaatatatatggatatatacttcaattaatcttgtagctgcaaggctactattttttttccagcagcatggtcatctactcacctcttatttgcagtgcatgactgaacactgttgcagagaacacattgaattatttgaagagagaccagacggtagcatacgttgatacatgttcaggccaatgctgatacatatagctagcaagctagctagcatagcattttagcattatttgcttggattcttgtggatcgatctgcgataaataattttatgaacagttatatcttataccactatttaagaatccaatgaatttggacgaagggactagggagtcaattaattaggaccaggaggtaaacaataatactgtgtgcttgtgtggtaactctaccagactcattaattggagctacatattccatgtatatatatatgtcatgaaatcctatttttttctgttttacgtttctgatagaattacccctatatatttttattaataagtttgttatgcatataataaatcacagtgttctgagagaggaaacg

SEQ ID NO: 6339 - DNA, 957 bp, Oryza sativa
  Predicted polypeptide sequence is orthologous to G2455
catacatatctctcccttgcttgctttgctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtgaatgtgccaaacaattgttcctacaacattgtgactgttagatgtgggcattgcacaatggtgctctccatggatcttgctccttttcaccaagcacgcactgttcaagatcaccaggtacagaacagaggatttcaaggtaataactttggaagctatgacatagcttccagaaatcagaggacatcgacagccatgtacccaatgccaaccagtcagcagcaagtgtcacctatacgtccccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgtattatacgtactattatacgtacgtgctgtgctatgtacgtagacaacaaaaaaaaatgtgcgtgatgagttctac

SEQ ID NO: 6340 - DNA, 1484 bp, Oryza sativa
  Predicted polypeptide sequence is orthologous to G2455
gatccatgtagctacagattatatgtaatcatcatgtaatggtacatagctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtgaatgtgccaaacaattgttcctacaacattgtgactgttagatgtgggcattgcacaatggtgctctccatggatcttgctccttttcaccaagcacgcactgttcaagatcaccaggtacagaacagaggatttcaaggtaataactttggaagctatgacatagcttccagaaatcagaggacatcgacagccatgtacccaatgccaaccagtcagcagcaagtgtcacctatacgtccccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccattttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgacgcgtaattaattaatcagttaattaattacgtacgacctactgtgttatgctatcgatccgtgttaataaattacctacgtatcttgattaattagtatcgtataatacgtactattatacgtacgtgctgtgcttatgtacgtagacaaccaaaaaaaatgtgcgtgatgagtaatacacgtaagtagtaagggtatagtgtttaaaaggatcaaccaggagagtataaaaacgaagtgaattgaatgaatgattagcagaaatatggtaagtgtgaatagacagacgaaatgaaaaaggaggagaataaaaaaaaaaaacaaatacagggcacatcaacacaagagcgcgaaaccgagcacggagacaaacagaagaaaaggcaatcaacagaaacgcagcaagcaaaaacactacgcacaacgcggccgagacgagacgcaacagagaaagcgagcaacgacggagcgagccgacgggggacggacggccgcaaaacgaggacggccagaagcgcacccaccaacggcgcacggagcgcacaagagaaccactgaccacgcagccgccgccgggcagcgcgcggccgggcggtgacgaagcgacgactggagcgcagtcaaagaggaggaggcggcaggaccgagaccagcgaggacaagacggcagcaaaagagcggcaa

SEQ ID NO: 6341 - DNA, 1598 bp, Oryza sativa
  Predicted polypeptide sequence is orthologous to G2456
atgctgcctcctcgccacctctgcctttccctctttgctcgcggcaaaatccacatgcagttgtagacttgtagtagtagttagttgtggttgtttgttgttttggctttcaaatcaggaacaacgacagatccgaggctttctcgaatcgggcaggtccatcaaatcggaagccagccagccatctaatcacctcatcacatcaaaggggaccaaaaggatatctctggtggctaccccctctcctccggccactcgtgtaaaatttcccttctgatcctgcgctgtgccagattataaggccattgcgtagctcgatcgaagaaagaagcaggccagccacagtactgcctctcttgtcgatcgatcgacagccacagcctgcaggtgtggggattcggctggccgtcgccttcgtcttcgtcttcgtcgtcgtcctcatcatgtcgtcctcgtcctcgtcgtcggctgtcttcccactggaccacctcgcggcgccgtcccccaccgagcagctctgctacgtgcactgcaactgctgcgacaccatcctcgccgtcggcgtgccgtgcagcagcctgttcaagacggtgacggtgcggtgcggccactgcgccaacctgctctccgtcaacctccgcggcctcctgctccctgcgccggcgccggcgccggccaaccagctccacttcggcccttccttgctctcccccacctccccccatggcctcttggacgaggtggcgttccagacgccgagcctactgatggagcaggccgcgagcgccagcctgagcagcatcacgggccgcagcagcagcagctgcgccagcaacgcgccggcaatgcaaatgcctccggcgaagcctgtgcagcaagagcctgagctgccaaagaacgccccggcgtccgcgaacaggcctccggagaagcgtcagagagtcccatctgcgtacaaccggttcatcaaggatgagatccagcggatcaaggccggcaacccggacatcagccaccgggaggcgttcagtgcagccgcaaagaattgggcccatttccctcacatccattttggcctcatgccggatcaggggttcaagaagaccttcaagcctcaggatggttctgaagacattcttctcaaggatagcctgtatgctgcggcagccgccgccgccgctgcagccgcaaacatgggcgtcactccgttctagcgagctttggcaaagcggccgcaagcaccgaattcttggtggtggccctagctcgctctcatgtgtggcgccattctagctatatagcaagggtttaattagcatcagatcatcatctcttaatatcatgtgtgttgcttaattagagtacttctgagtgtgtagaagagagatggggaatcctgttgagtgcctaggtttatgcttataaccatattcctcgtagagacttttttccctgtttttctcttttcttttccttctttatttttttatcctttctttctttcaggactatcttcgtactccctattcacctgtagagtgtagagaagttgctgttccgttgcctgattgtgtcccaaaagacgtgtcttaattacg

SEQ ID NO: 6342 - DNA, 1809 bp, Oryza sativa
  Predicted polypeptide sequence is orthologous to G2456
gttacatatctctcccttgcttgctttgctcctggatatatagctagcttctttctttcttcctctctccctgtgtggcacgcgcctccaatcgatctcttcggtgagtagacgcatcgagatcggggggaaatgtcggtccagtttacatcggagcatgtttgctatgtcaactgcaactattgcaacactatccttgtggtgaatgtgccaaacaattgttcctacaacattgtgactgttagatgtgggcattgcacaatggtgctctccatggatcttgctccttttcaccaagcacgcactgttcaagatcaccaggtttaaaaactgaaataatggtttgaaatttcagttcaaaactgtagccgaagaatctcttgcatatatatcagctatatcttattttttatgaaacaaaacaaatgaaatattaatttctgtacgtatgtaaaaaaaagaattaatattaattatttactacgtacagtggaatggtcacatctaaatttgtttatttaggtacagaacagaggatttcaaggtaataactttggaagctatgacatagcttccagaaatcagaggacatcgacagccatgtacccaatgccaaccagtcagcagcaagtgtcacctatacgtcgtatgcacaattaattttctcatgattttatttcattgatctactaaattatggggtttattttttatttctctatataagcatgcatgcaaaatgggtatatataatatagttaaaggttatatttactgttctaggcttctaatgtataatcaaaatatattatagtaatcaagttcatgcatgagctatatatgaacctgatcacactgaattccagtaaacattagttttttccccgtatacgcatggagctgtgttagatttcccaaatgatcaatctataggtattaacacacacacacacacacacacacacatacatacacacacacacaatacatatattatcagcttgcataatttattaaattgccttgttcttctgtattcacattatagctagttttatgtattatatatatgcttgtataatagatttaaaatattggtccttttttcttctttacagcccctgagaaaagacagcgtgtcccatctgcatacaacagattcatcaaggaggagatacagaggattaaaaccagcaatcctgagattagccacagggaggcattcagtgctgctgcaaagaactgggctcatcttccccggctccatttggcctcagcgtcgccgacggcggcggcggcggcggcagcaactaatcgcggcggcgcggcctgccggccggccaccgatcgccggcgtgcacgccggcgcgcggcggcggccggtcgagaatgcgcgcgcaggagggacgacgacgatatattattatcgcgtgtgcccctctctcttcgccgcgtaattaattaatcagttaattaattacgtacgacctactgtgttatgctatcgatccgtgttaattaattacctacgtatcttgattaattagtctcgtattatacgtactattatacgtacgtgctgtgctatgtacgtagacaacaaaaaaaaatgtgcgtgatgagttctactacgtacgtacgtactgtgttctagtgttttaatttgtatccgaaccaaggagttgtttaattaactgcatgcacatgcactggacttgaatctggagtattatgtaagtgtgcatgcatgctggattatgcaaaataaacgaattaatgaatagaactgtttttgttaattaattaatt

SEQ ID NO: 6343 - DNA, 1301 bp, Oryza sativa
  Predicted polypeptide sequence is orthologous to G2456
gatccgctagcttcatctccactagtctcatccctccttctccctctcctcgttgaacaccgcactatcaaatcacccagctgaaagccaagaccgcgcgcgccggccggccgggcagggatcacctagctaggatacgcgccatgatgtcgtcggcgccggagacgttctcgctggaccacctctcgcagcatcagcagcagcagccgccgccgctcgccgagcaggagcagctctgctacgtgcactgcaacttctgcgacaccatcctcgcggtgggcgtgccgtgtagcagcctgttcaagacggtcaccgtgcggtgcggccactgcgccaacctgctctccgtcaacctccgcggcctcctgctcccggccgccgcctccaccgccaaccagctccccttcggccaggctctcctctcccccacctcaccgcacggcctccttgatgaggtgccgtcattccaagcgccggcgagcctaatgaccgaacaggcgagtcccaacgtgagcagcatcacgagcagcaacagcagctgtgctaacaacgcgccggcgacgtcgatggcgtcggcggccaacaaggctacccagcgagagccgcagcagccgaagaacgcgccgtcagccaacaggacttcagagaagcggcagagggttccctcggcatacaaccgattcatcaaagatgagatacaacgcatcaaggcaagcaatccggacatcacccacagggaggctttcagcgctgctgccaagaactgggcccatttcccacacatccattttggcctgatgccggaccagggcctgaagaagaccggcatacaaagccaggacggagctggggaatgcatgctcttcaaggacggtctctacgctgcagccgccgccgctgcagcagccacagcagcatctagcatgggtgtcactccattctaacgcctcagatcaatgcacgatctggcttaaaaaaaactttgtgtcccaccctgtagttagggtcctgcatgtctcgatctccagatatgatctccggttgcttgttaactgaaatgttcctctatatatggacgatcatggcaccatatgcatggcatcttggcatgcatcgatcgtatctaagtccttatctatgtgtaattctagttttctcagtttcttcatgtattttccccttaatttttcctattcctattcgcatgtacagaggctgctagctgtgcgtgctgcctcttatatatcttatggacataactagatcgatttggtttaattaccaggtgatcatttgaaatc

SEQ ID NO: 6344 - DNA, 733 bp, Oryza sativa
  Predicted polypeptide sequence is orthologous to G2456
aactcgcaccttcgtctccgcctcttcctctccctcaactgcgcaagcgcttctccctccttgcgcggtagccggcgccaatccctaccctcgtggcggctggctctgctccctctccctgcgcagcagccgacgcctctccagccctctcccctatgcagcgagtcctctcctctctcatgaggtggaggaggaggcgtggggtggcgggggcaagatccaacgacccccaagcttgggaccagcacagcgttaagggagatggcgaggacggtgcgacgacggcaaggacagtggctccacgaaggaggaggtgcagggcggcggcggccagatccaagtgaattttttgctgcctcccgctttcactcacccttgcttctgttactccatctgtaagcgatgtctttgccttagcagccagatttgatgtcgtcctttggaaatttgtggccttctttatggggatctttggtgcttgcccgatttgctctccatgggtgttttggagatgcttgggctgattctgtcaccactggatttgccgcatcgtgactcgtgagctgctgcatcttaaggcgaaagattggtttctttagggagttgagatttgtttgtgtgtatctgcttccacctttataatttttgtagcgtcaatcttcatcgtattcaattatgtgtccttgtgaagcaaaacattgaatgaaaaactgattttctggggttggttttg

SEQ ID NO: 6345 - DNA, 942 bp, Oryza sativa
  Predicted polypeptide sequence is orthologous to G2456
atgtcgtcgtcgtcctcgtcgtcggcgtcgtcggcggcggcggccgcgtttcggccggctgttgtgcagcgggagcagcaggtggtggaggagaaattccccgcggcggcggcggcgatgcgggagatggtcctcccgccggtggcggcggcggcggcggactccgagcaggagcagctctgctacgtgcactgccactactgcgacaccgtgctcgtcgtgagcgtgccgagcagcagcctgttcgagacggtgacggtgaggtgcggccactgcagcagcctcctcaccgtcaacatgaggggcctcctcctcccgaccaccgccgccgccgcgccaccaccacctcctcccccgccgccgccgccgccgccgccggccgcgcacttcccccactcgctcaacctcgcgccggccaaccctccccaccaccactccctcctggatgagatatcgacggcgaactccccgacgcagctgctgctggagcagcacggcctcggcggcctcatggcgagcgcggcaagctgcaggaacaacaactccccggcggcggcggcggctccgccgccgccaacgtcgcaggggaaagcggcggcgaaagagccgtcgccccggacgaacaccgccgtcatcaacagacctccggagaagaggcagcgtgtgccatcggcgtacaaccgcttcatcaaggacgaaatccaacgcatcaaggctggcaatcccgacatctcgcacagggaggccttcagcgcggctgccaagaactgggcacactttccgcacatccactttggactgatgccggatcaccaggggctcaagaagaccagcctgcttcctcaggatcatcagagaaaggatgggctactaaaggaagggctttatgcagcggcagctgctgctgcggcggcggccaacatgggtgttgcaccgtactaa

SEQ ID NO: 6346 - DNA, 1496 bp, Oryza sativa
  Predicted polypeptide sequence is orthologous to G2457, G2459
gacatgagccacaagaaataaaagcacttgctagctatgcactgtagcagcattgccgctttgctttgcttgcttgcccccacacgctctctctctctctcactagctaattagctgctactacatcttccatctctctcctctctctctctctctagaaataaggaaggagagaaagagaaagagagagaaaaccagaaaagaggaaagtgagatagctcaatttctccttccttcctctctccatctaatctacacatgcacaaatgttgcagctgatatatggcttagctagcatatgcaaagcaagccttcctgcagtctagtcacctctcaagctacatactcccagtactgcttcatctagctctctctagtagctagctctatcatcatcgatcatcctcctctcaccggccggccaacccaagaagagattattcctcttcatcttcttcttcctctctgttcatcactggcttcggcggcggcggccgcggcggcgatcgatcagctgtgagaagaagaagaagaagaagaagaagaaatgtctgcccagatcgctccggcagagcaagtgtgctatgtgcactgcaacttctgcaacacgattctcgcggtgagtgtcccaggaaacagcatgctgaacatcgtgaccgtccggtgtgggcactgcacgaatctgctgtcagtgaacttgagaggactgatgcactcagccccagcactacaagatcatcatcatcatcatctccaggagagtggtctgagcggatgcttccgtgatcaaagtggctatccggagtttggtttttctgcagcttcgtcgtcttccaagctcaggctgcctcctgctgctgctgccatggtttcctactcgcagcaaaaccagcagctcgagcaagctctccatgctcgccctccagagaagaggcaaagggtaccttcagcctataacagatttattaaggaagagatacgaaggatcaaagcaaacagccccgacattagccacagggaagccttcagcacagcagccaagaattgggcacattatccaaacatccattttggcctaagccctggccatgagggtggcaagaagctcgtcgacgtcgaccccatcccaactgctccatcttccaagaagatccaaggtttctactcatagattgaggggatcaatctgccgataccgataccgcaaataggaggaagagcatcaagagcacaaaacatatatatactgtgagtaaagaagcaaaggaaaaaagaaaagaaatgctgccaccttacctttgttcatgaccaaaaaacttgtgaagacgtatgtcataagtacatagaagaaatcaactcatatagagtgaaaaaaaacatacaaaaaatcaagctactatagctcatcgatcgactgaaaggctgaataaaccattcgaccataatgttgttacatgtataagtatgtttgaagctagctagctggctagttcttt

SEQ ID NO: 6347 - DNA, 1257 bp, Oryza sativa
  Predicted polypeptide sequence is orthologous to G2457, G2459
tcccgtttgcaccaccaccaatctctctctctctctaagatctctatctatctaaagatctgagctacaattaattaaaacctgataagaagaagaccctgagctcaatcccttcttattatactatatatatacttctgtatttgtgcacagtgttggtacaggtatctgcagacagccatatctatctttctagctaattggcaatatgcctgaagtccactgctcgtcctaagatttacttctccacccccccccctctcctttgcttcttcttcttcatcatcatcttcttcctcctcctgttaattaagttcttgatttctaagctagcaattgagcacacatcgatcgcgagagacgcagcggcgcccgtctaccgcggggctagaggaatgtcggcacagatcgtgccggcgccggagcatgtgtgctacgtgcactgcaacttctgcaacacaattttcgcggtcagtgttccaagcaatagcatgctaaacatcgtgaccgtccgttgtggccattgcactagcctgttgtcagtgaacttgcgaggattggtccaagcactcccagcagaagatcatttacaggacaatttgaagatgcacaatatgagcttccgcgaaaactactctgaatatggctcatcttccagatatggccgagtgccaatgatgttctcaaaaaatgacacagagcatatgctgcacgtgcgacctccagagaagaggcagcgggttccttcagcttataacagatttatcaaggaagagatccgggggataaaagcaaacaatcctgacataagccacagagaagccttcagtactgcagcaaagaattgggcgcatttcccgaacatccatttcgggttaggctcccatgagagcagcaagaagctcgatgaggccattggagctcctagtccccaaaaggttcaaaggctgtattgatcgagtacacatgatgatcgatggatcctacgtgcttgttgatctcatgttgtaagtaacttaattaagaaaaaaagtctacgcttatttatttcttaagtatcatcagttaaatttgtgagcgagtatatagatgagttgtcatgatcagtgagtgatcgtatgcatgcagtgctgagaattaaaggtgtatatgcatgagtaacgttacatgcagctagtgtcgacgcacgtatgacagactgaataaactcttcaccatgttgtttttttatgtttgaaatgaattaattaattgtcc

SEQ ID NO: 6348 - DNA, 1037 bp, Oryza sativa
  Predicted polypeptide sequence is orthologous to G2457, G2459
ccccgcaccaccgctcacacttgctcctcctcctcctcctcctccgcctcagtgctagggctagcttgcttgtcgccgtcgccgccgtcgtcgccgccgcaatggatctcgtgtcgccgtccgagcacctgtgctacgtgcgctgcacctactgcaacaccgtgctcgcggttggagtcccatgcaagaggctgatggacaccgtgaccgtgaaatgtggccactgcaacaacctctccttcctcagcccgcggccgccgatggtgcagccgctctccccaactgatcaccccttgggcccgtttcagggaccttgcactgactgcaggaggaaccagccgctgccgctggtctcgccgacatcaaatgagggtagcccaagagcacccttcgttgtgaagcccccagagaagaaacaccgcctcccatctgcttacaaccgcttcatgagggaggaaatacagcgtatcaaagctgccaagccagatatccctcacagggaggccttcagcatggctgccaagaactgggcgaagtgcgacccccgctgctcatcgacggtttccacctccaacagcaaccccgagcccagagtagtagctgctcccattcctcatcaggagagggccaacgagcaggtggtcgagagcttcgacatcttcaagcagatggagcgcagcggctagggcggcggcggcggccggagccggcggcgatctatatcggcggtgaagctcgtatgaagctagctagcctgcaggccggccactggggagagtaccaaatttcagatcccccttattatcaccgtcgtcagctcagctcatgcatgcatgctcatcgttcccctttagcatatatctgtgctcgttttgtgtttattagttaattatgtttgatcttgttaatttgttgttgcatggagtatgtaccccctataagacccagctgctgctaccgtacgatatacgtacgtatgctatatatatatatatatatatatatatatttgtcatctaaaaaaaaaaaaaaaaaaa

SEQ ID NO: 6349 - DNA, 1694 bp, Oryza sativa
  Predicted polypeptide sequence is orthologous to G2465
ggtccgtccgttcgattcgacgacaccttcatttttattttcttccttgtgtaataagaagacgactagtggtaacaaaaagattcgctccctacgcgacgccccgaccccgattcccttcgcttcctactccttcctcttccttgttccttccttccttcctcaccccacgaacgcgcacaccaacctttcccatccctagctgctgcccttccatcggatccacggatcgagacctggcacggcggcggaggacgggccggcggagatggaggtggaccacgcggaccgcgacggcgcgcggcgccggtgccgcgagtacctgctcgcgctcgaggaggagcgccgcaagatccaggtgttccagcgggagctccctctctgcttcgacctcgtcacccagactatcgaggggatgaggagccagatggacgccgccggcagcgaggagacggtcagcgaccagggcccgccgccggtgctcgaggagttcatcccgctcaagcccagcctctcgctgtcctcctccgaggaggagagcacccacgccgacgccgccaagtcaggcaagaaggaggaggccgagacgtcggagaggcattcgtcgccgccgccgccgccgccggaggccaagaaggtgacgccggattggctccagtccgtgcagctctggagccaagaagaaccccagcagccatcgtctcctagcccaactcctaccaaggatttaccgtgcaagccggtggcgctgaacgccaggaaggccggcggagcgttccagccgttcgagaaggagaagcgcgccgagctgccggcgtcgtcgaccacggccgcggcgagctcgaccgtggtcggagacagcggcgacaagcccaccgatgatgacacggagaaacacatggagacggacaaggacaacgacaaggacgccaaggacaaggacaaggaaggccagtcgcagcctcaccggaagcctcgccggtgctgggcgccggagctccaccgccgcttcctgcaagcgctgcagcagctgggcgggtcccatgtagcgacgcccaagcagatccgggagctgatgaaggtggatggcctcaccaacgacgaggtcaagagccatttgcagaagtatcgtctacacacgaggaggccgagctcgacggggcagagcagcgccgcagccggcgtccccgccccgcctgcgccgcagttcgtcgtcgtcgggagcatctgggtacccccgccggaatacgctgccgcggccgccgcacagcagcacgtgcagcttgccgccgccggcaataatgcgtccgggagcgccaaccccgtgtacgctccggtggcgatgctgccggcaggcttgcagccgcattcgcatcggaagcagcaccagcagcagcagcaaggacagagacattccgggtcggaaggccggcggagcggggacgccggcgatggcagctcgtcctccccggccgtctcgtcgtcgtcgcagaccacctccgcttgattagtgtagattcgtcgattacatcattatatgtacgtagtacgagagtgcatcacatcaaagtgcagcttgattttggagctagctagcttaaattaagggttaattactgattgcttcgtgatcgcacacaccacatttgctgttttgtttgtaaaaaagataataaaatacataaatattaagg

SEQ ID NO: 6350 - DNA, 2862 bp, Oryza sativa
  Predicted polypeptide sequence is orthologous to G2492
atggaaagtcgggaatggatgtatcattggccgaggcttttgtctccatatagcaacgaagtgtctaaatttattggtattgccaaggcacacgctgagaagaacaatatgaggaagataatttgtccatgtgctgactgtaagaatgaaatagtctgggacttcgacgatgcttttaaagtgaaggagcacttagtaactcgtggatttatggacgagtacgaaatatggacacgttatggcgaagaacaagtggacaggcctgaaaatgtagttccgacacaagttgaagacatggtgcatgacgatggttctgttgaggacaaaatcgacctagaggaaatgttacgtcatgcagaacccgaggtgctgatggggtcggccagagagttaaataactttgaagctttacagaaggcagcaaaggaagttttgtacgatgaatcgaagggctgtgacagtgagttcacaacactatggaaagagtacgtttttttagatgaatgtccaacatgcggtactagccggtacaaatcgaatagcaatactggcctagaaccgtctgacacaactgagggacgacagagaaaaatcccgcagcttgtgatgtggtaccttcctgtcaaagaccgcattaaactgatatactcaaacccacgagatgcggaactaatgcactggcatgaagaagggcgcaagaaggatgggatgattcgacacccggcagatgctcgtcagtggataaactttgatgctcagtacagagagtttgctaaagacccacggaacattacatttgccctgagtactgatggagttaatccttttggagacatgagcagctcacatagtacttggccagtgcttctcaccatgtataatcttcctatctggctttgtcaaaagcaaaaatacgtactactctgtatcctcatacagggaccccgtcagcctggtattgatattgacgtatttcttgaaccattgttggaagatatggctgatttatggaaagagggattgaaagtgtatctcccgggttccaacaagcttgtgtacatgcggcaccggcggttcctacgcacaaatcacaagtaccgcaagatgaaggcggagttcgatggcactgaagagactgatcctgcaccaaaaccaacatcgggagaaaaggggacaaagcgcaagaaacccgagaagaatacgaaacaaggggatagtaagaagcaagatgatagttcgaagccagatgataaactccctcccctattcaagaagcattccatattttttaagtacctcccatactggaaagatctggaggttcggcatgccatagatgtcatgcatctagagaagaatgtgtttgacaacatagttggaacattgttggacatgccgaacaagactaaagatggtctgcaatcaatgatggatctagtcgagatgggaatcagagaagagttacaccctcaagaaggagaaaaaaatggtaaagtatatcttccaccagcctgttttacactgacacctgaggagaagaagtcattttgcaactcattccgtgatgtcagagtgcccataggtttctcatcaaacatcagtcgactagtttcaatgaaagatttgtcggtatctggttataattcacacgactgtcatgtcttgctcaccgtgttttttgcaattgcaataagggccataaaaccggagcatttaaaggttgctattacaaggttgtgctactttttcaacgcagtgtcacagaaggtcattagtctcgaagagttaggaaatctccgtacattcgcacatgagacacagtgccaacttgagatgtgtttccctccgtcagtttttgatatgatggagcacctcattgttcacgtagtgtcgcagatggttgcgcttcgcccattgtacctccatcaaatgtggtcatacgagcgttacatggcggttttgaagggttacgtccgaaatcgtgcacatccagagggatcaatggttgagggttatagtactgaagaggttgtcgagtgctgtatcgattatctcaaagatggatatgcaattggagtacctgtgcctcgacacgagggcggattgagtggcaggggaacgataggaaagaagagatttgtcacccatgatcacaaatcattccaagaagctcacttcagcgtgcttcatcagtttgttatcgttgagccgtacatcgatcaacatatcgaactaatacgagctaacaataagggtcgcaccaccgagtggataatgaaagaacacgagcatctcttcacagattggttgcgagacctagacttacctgagggacaaactaccgatgaaatgactatgaagcggttggcttgtggtccatcaactatagtaaattcttggcagggatatgacattaatagatacttgtttagtacaagagcccaagataataagacttgtatgcaaaacagcggtgtccgtgtggaggcaattgatgaagccggggaaaaacaatcatacttcgggtttatggaagaaatatgtgaaatcgactatgggcacacaatgcaattctccatatttaagtgccagtgggatgacccttgggtactcgccaatcgtgtggcacaagtgttttacgtgaaagacccatcaaatttgaagaaagatatagtgctacccggaaaacaaaagatattgggagtggatggggttgaagatgtcgaagattacaatcaatacgatagtatgccactttatagtcagtttgtacagaagattaagaacgtcgagacatctactcagaagatcgtgaagccttacatgcgcacggatggtgtgggaaaaaatgttaaagggtaa

SEQ ID NO: 6351 - DNA, 1052 bp, Oryza sativa
  misc_feature (14)..(14): n is a, c, g, or t
  Predicted polypeptide sequence is orthologous to G2515
cgatcccctcctcnctcctcccccacttctccccaccaccacaccaccacacacacgcacgcacgcacgcacgcctccgttttcccccaccgacgagaggcggagagggaggggagctagggtttttcggggcggggatggcgcggagggggagagtgcagctgaggcggatcgaggacaaggcgagccggcaggtgcggttctccaagaggagggcggggctgttcaagaaggcgttcgagctcgccctgctctgcgacgtggaggtggcgctcctcgtcttctcccccgtcggcaagctctacgagtactcctcctccagcattgaaggtacctatgatcgctatcagcaattcgctggagccaggagagacctgaacgaaggaagtacaagcatcaacagtgatgaaaatgcaagtatacactccaggcttagggacataacggcctggtctctccaaaacaatgctgacgagtcggatgctaatcagctagagaaactggagaaactgctgacaaatgctttgagggatacgaaatcaaagaagatgttggcaaaacaaaatggtgaagggagtaggagcagagcaaactccagtggctctagggggcaggaggaaggaagtgcatgagcaggaagcacaggtgtcctgtgcataagtttggcagtgcatgcacctcccaaattaaaaagctaataaaaaaaagagaaaatggtgcatgctctgtttgctgccagtttctcccactgattgatcccaggtagagaaaagagttgccatggcctctggctctgcttgttagatcaagggggggagatggaataaaaggatggggaagtattcaggttcttgtaatgaagacctatgctgtggtgttttagcaatgtttgatatgtgtgctacctgtgtttgactggttgtgttgcttgatgtgtcatctgaccatgatactgaaagcctgataattgcactgacttgtgtatggagtttgtttcaacctattggtatgaatctgtttgattctgtaggaactgtggtttgctgtttgcc

SEQ ID NO: 6352 - DNA, 1079 bp, Oryza sativa
  Predicted polypeptide sequence is orthologous to G2515
gaggaggtcgggatggggaggcgggggcgggtggtgctgcggcggatcgaggaccgggtgcggcgcgggatctgcttccggaagaggctcgccgggctggagaagaaggcggaggagctcgccgtgctctgcgacgcccacgtcggcttcgtcgtcctctcctgctccgacgacgaccgcctccaccatttcgccgcgcccgccactatagaaaacattgtggaacgttatgagaattctctaacagcacaaaagggagtacatggcaggcgcactccggaaaagagagacactcattggtgaaaattttcctgccggtgctgatgataattattttaccataccaagggcaaggattttcatgttcccaaggaaacaacagataaagggtcgaacgatgatgacatgcgatctattgatgaaacagacatatccacattgaacatggaccagcttagccaaattgaaagattactggaagatgaactaaggtggacaagggcaagaaaggtggtggtggatagaagtgccagattacaaaaaaaggtgcaggggaaagcggcgattgttgaggttgagaggggctccatggagattcccatagaatctgggcaggagaaggaacagataggaggggaggctgtggaggagcaacggagccggactacgccgttggacctcaacatgccttgctgggacgcaggtcctctgcagtaaacgtagataacattatctttgcacagcaatctgagtctgtctaacgttagtcgctactactgtccccggtactaacagtgtcgtaagttactgttgctgggaaactactactacgctttgctaatctttttttactgtagccgttcatatccaggatactgtgccgtaactggagcacaccagattcaaatcaaatgtactgtgacaccattgtattttaaaatgtgtttttctcctacttcctactagttctagttcatgttcggtggaaaattgtaaaccaaataaaccggcatcggtattggtcgatgtgtacccgtgggctctgtaataagactgtccgtgcctgcaaattagtaccg

SEQ ID NO: 6353 - DNA, 582 bp, Oryza sativa
  Predicted polypeptide sequence is orthologous to G2515
cactatagaacaagtttgtacaaaaaagcaggctgtaccagtccggcattcctcgagcactgttgtcctactggaaaaagaaaaagaatcttcttctccgacccgccccgccggtggggagtcggcggggccgcgggaatccggcaaagcgacggcgatgtccgccgcccgtggttgcctcgtctctccgcctacataagggggcgcctctccgggctccggcgcgtcggattgggaggtcgggatggggaggcgggggcgggtggtgctgcggcggatcgaggaccgggtgcggcgcgggatctgcttccggaagaggctcgccgggctggagaagaaggcggaggagctcgccgtgctctgcgacgcccacgtcggcttcgtcgtcctctcctgctccgacgacgaccgcctccaccatttcgccgcgcccgccacgtacgctctttccccttgaagttgaatctgctcaactcttgctgaagtgtatagtagtactggctaccttagctcgattttgtcattttgactggtatattcaaatatcgttgggtattatattactcggttcgattttgacta

SEQ ID NO: 6354 - DNA, 1269 bp, Oryza sativa
  Predicted polypeptide sequence is orthologous to G2520
agcgctctctccctctcgtcaccgctactactagtgtacagtgccactgcgagctctcctctccgcccccgatctggtcgcctcgctcgcctcaaaccctagagctccatccaccggcgagccctcttgggcggaggtgcttcattgctgctgctgctgccatggaccccgcccccacgctcgccgccgagctctggcgaacgccgtacctcggtggcggtggtggtggaggaggaggagggcgtgggttggaggcggcggcgtccggggtcacggagcagagcaatgggagccgcgggggtggcggaggaggaggcgcagggcggaggaggcagcgggaggcccccgcgctcgaggacgactcgtccaggatcgtctccacttccggaggaggaggcggcggtcaggatttgactgattcagaagcaaagcgtttcaaggcaagtaaatcaagtggagataatagcagtttaagaacagaggctgaaactgattcaagaaatgctagcaagtctggtgatcaaaatccgccaccaccagaaccaccaaagcaagactacatccatgtgagggcaagaaggggtcaagctactgacagccatagccttgccgaaagggcacgtcgtgagaaaataagtgagcggatgaaaattctccaggatcttgtccctggatgcaacaaggttattgggaaagcatcagtacttgatgagataattaattatatccaggctttgcaacggcaagttgagtttttgtccatgaagcttgaggctgttaatgctcatgtgaataatggaatcgaagcatttccacccaaagattttggtgctcaggtatacaacacggctcctggattgacgtttgatccacaaacaccaagagaatacgcccagggatcaacaccatcggaatggctccacatgcagattggtggcacctatgaaagagtgacatgaacagaacaaagtcaggatggtggcccaaaataaagcataccatgagttcagtcagaaaccacggctttagattatttttcgaaactctcgtgctccaaattcgatttcattcatagcatggagctcatgtatttagagactgcgagcacagtatttttacatctgtaccgggatacaattctcatcagattcatgtattccacggaatttcggcaggtcacgctcattcgtagcatgaaagaaaagtaataaccatcaataattctcttgctataaatcctaaagcccttcatttaaaaaaaaaaaaaaa

SEQ ID NO: 6355 - DNA, 422 bp, Oryza sativa
  Predicted polypeptide sequence is orthologous to G2520
attgttgcttttccatctaaagattttggtgctcagccatataacacagctgctggtttgacatttgatccacaaacaacaagggaatttgcccagggttcaacatcagagtggcttcacatgcagattggaaatgcatatgaaagagtgacatgaataaagcaagcaaaaccataaaacataattccttgtagtggcaataaagtgtactgggatcgatcaagcctgtggtcctaggattatttttttttctcaacaatttcttctcattatcatgtcaccaagttatttttttgttcctaatttggtccatgatgccatagatacattcatcttgacctgttgatactcaacggtctatctgctttgcttgtatcccatggtctttgtagctcggatttgaatagggaaagaagaggatg

SEQ ID NO: 6356 - DNA, 2890 bp, Oryza sativa
  Predicted polypeptide sequence is orthologous to G2522
atttgatgacgaatcaagtcacaataaaataaataataattacataaatgtttggaataagacgaatggttaaacgttggataaaaaatcaacggtgtcatacattaaaatatgaaatatgaaggtagtatgtgaaagcctgatatgtcaattggttagatttcttgtggtgaaacatgcatcttcaaattcattatattttaattgtaaaaaaaaatctttagagatggttactcttaaaattatcagattttttttgtcacggctaaatgtaatgaatcttaatatgaattttcgcatatatgtgtagtactattagaaataactgtttatttttttctaattttttatgacatttgctagttggtgtgtgtgagaaacctatatgcatatttttcacttagacacaggagcggagctaggtaggatagggggtgcccaggaacccggttaagaaatttttttaagctatagttcatctattttcaccatatatgcacctccctcaatccaaatttaggcacttatatcagtctaaagtagagtaaaataagtgagtggcagctctcttcatttcgttctagctccgctcctgcttagacatactatctcgatataacaattcaaccaagtcttacgtgaactatgaaccgcccaacacaaaggttcatgagatatccgccgttggtggtcaggtgaggtgaggtgaggtgaagctttgggaagcatcaaccttgaaaaccaagaaaaggtcgtgggcgacagggcgagcgccataaatatctgaaaacatcttgtggagagctgacaggtgggacccgaggggaggtcccgatcggactgtagcgtgggggcggggatcgagtgggcgggtagcgacaggccaccgcccacccagcccatccgcgcgcgtggacgcaaaatggagtggcgcgcgccgaacgaaacggaagccgcagccagcaaattgcaaaggaaggcaaatcacaagcaaatccacccccgcgccgcgccgctcgcgctcggctccgccttttttccctttcgacgtcgttgggccaaggaaacggaaccaaatcttatcgcctccttgtgtgggcgccatccgtccctccgtccgctgcccatctctctctcacgctcgccgtcctcttgtgccttcttggcttgggtttgcctgcgcctgcgcgcgcttggcctagttgcatcgtctgcgttgcggctgctgcgatagcatgtaggccaaccgcgtcatcttatctctctctctctctctctccccccatcatttcatctgatctagtatctcatctcctcctcccctccttttccttctcccccaaccaactcactcttcatcttcaacaccttgctgttcgtcctcgtctcgtcgtgctgattgttcaagaacaggagaaagaaaggaagaagcagtttgattgatctgtttctgttggggggagctcggtgatccatgcatggatggcaaagaactcctctcaccgtccgaactgtcatactatgcgcaccagcagcatcagcatcagcatcagcagcatcagcagcaacaccggatgctcgggggcggaggaggcggcggcgggcatagcgcgtcgccgctcgccgggatgcacggcggcccgtcggtcatccgacccatgcccaacatggggatgagccccaccgcgatcctccagtccatcggcccgggcccgctcgccggcatgcagttccagatggacgccgcgccgccgccgccgccattgatgcacaacagcatggcctccgtctccgcctccgccggcgccggctcacccaccgtgccgccgtccgcgacgcccatggagccggtcaagaggaagcgaggccgcccgcgcaagtacggcccggacgggaccatgaaggtgtccaccgccgccgccgcgcagcaccagcagcagatgctgagcgcgccgccgaggatggggtccgtgtccggcgccgacatggttggcggcggctcagggatggacgactcggcgcagaagaagcggcgcgggcggccgccggggacagggaagaagcagcagctctcatcaccggttaagctttcagggggcaatgcgttcagtggctcagctggaacgagcttcacccctcacatcatcacggcatctccttcagaggacgttgcagggaagatcgtggcgttcgccaaccattcgtccagggcggtgtgcgtgctctcggccaccggctccgtctcccgggtggtcctccgccacccggccgacggcgccatgtcaagggttcacgcctcctcccactacaagaaccctgccatctacgaggggctgtacgagatcttgagcatgtcggggtgttacaacctgatgaacgaggggcagagcgacgggctgagcgtgacgctgtgcagccccgagaggcatatcattggaggcgttctcggcggagcattggtagctgccagcaccgttcaggtggtacttgggagtttcgtgcagggagggtcgaagcccaagtcgaagaaggccgggaaacagcagcagcaacaggcggcggcggcggccttcagctcggactcgctgaccggaggagggcaggacgcgtcgccgagctccggccataaccaaaatctaacgccgccgccccctgtaacaacgacgggagggtggcctagctccgggatatttgacacgagaagttccaacattgatatcaactcatctagaggctagcttcatctctcaatttgtcgactcttccatatgtgctccagaaatttgtttttctgattcccaaagaattacccccaaaattgtactcctctctgtaatagcctgttcagtttttgagccgttaattcttatagattattattattcactag

SEQ ID NO: 6357 - DNA, 614 bp, Oryza sativa
  Predicted polypeptide sequence is orthologous to G2525
accgctcgccgccgacgacgagagcgactgctccgatgagcgaatccggcagggtcaccgccggcggaggaaggggcgagctgcggccgccggagctgccgcgggacccggcgctggagttcctgtcccggtcgtggagcgcgtcgggcgccgccgacgtctcccgccgcgcgctcgccgccgccgccttcccggcggcggcggcgtcggccgcggtcatcgccgaggacgtctccggtgagctcgacgtcgacggctccgcctccgggagctccttctccttcgcgtcggcggccacctcgcagctcatcatggacaggatcatgtcgcaatcggaggtgtcgccgctgacctccggccgcctctcacacagcagcggccctctcaacggcggcggctcgctctccgacagcccaccggtctcgccggacgtcgacgacagcaagttttgcagagcggtgagcacgccgaagccgcagccgtaccgcggcgtcgtcggcggcggcgggaagacggtggggcggtggctgaaggagaggaaggagaagaagaaggaggaggcgcgggcgcacaacgcgcaggtccacgccgcggtgtctgtggcggaagttgtt

SEQ ID NO: 6358 - DNA, 1278 bp, Oryza sativa
  Predicted polypeptide sequence is orthologous to G2536
atttcacgcgaactcgagccccacacatatatatacacatcccaagatcacaaatcgagtgtaattaaatttgtgatttgtgaaccttcttcaattctacctagctagcaatctattgagaggtgaattgaagtgcatgcatacaagaatatatagatggtgatgagcggcggcggcggcggcgcgaggattgccagtgatccggcggcgacgccggggttccgattctacccgacggaggaggagctgatcggcttctacctccgccaccgcctcgccggcacgagggccgacgacgtcgcccgcgtcatccccgtcgtcgacgtctacggctaccatccttcccagctcgccgccatggccggggtggcgaccgcgggggacagggagcagtggttcttcttctgcccgagggcggagcgggagctccacggcggcaggccggcgcggaccacgccgtcgggctactggaaggccacgggctcgccgtccttcgtcttctcctcctccgccgccgccgccgccagggtcatcggcgtcaagcgcaccatggtcttctaccagggccgcgccccctccggcacctagaccaggtggaagatgaacgagtacaaggccgtcgccgccgccgccgccgacgacgaccacaacgccgctggcgtggccgtgcagctgccaccaatggcgccgccgccgtcgtcctccgcgtgcgtgcggctgaggaacgagctgagcgtgtgccgggtgtacgtcagcaccggcacgctccgatccttcgaccgccgccccctcgacgcgcccccggtgatcagccaccatcaacctcagctccagcaacaacaacgtcagctgccatcgtcggcagcggcggcggcgacgaacggcaacctcatcgccctcgccggcgggtacgagtgctcacacgacagctccggtggctcgtcggaagatgccgccatcgactggagctcgctgattaccgccgccaccgattccgctaccgccgccgttgatttcagcttcaacgacgacatcgatttcagccctgccgctgttggcccatgggcgccacagctttgattgattgattatttgtgcacactgcataataactgaattactagtaattagtagtagtaagtttgatcagtgcttgctaattgccatagtgttctatgttcaggtcaactcgattgatttattacctcccaaactctcaattctgcttgtctttaatttttcttgaataaattctgaactatggcctgttcttttctt

SEQ ID NO: 6359 - DNA, 2330 bp, Oryza sativa
  Predicted polypeptide sequence is orthologous to G2536
aaccatggatacaagctagctttgcttcttcttcttcgtcttcttgtaccaaatcattcaaagttttctttcttcaagccttcaatcttctatatatatctccctccatgatcaaccagctatagctacctcactccaacaatcgccgaccacgatggccaccacgaggagcggcgtcggcggcgccatcagcgacccatttgcgacgccggggttccgcttctacccgacggaggaggagcttctcggcttctacctccgccaccgcctcgccggcacgaggcccgacgtcgagcgcgtcatccccgtcgtcgacgtctacggctaccacccgtcccagctcgccgccctggccggggaggcgagcgcgcgcgacacggagcagtggttcttcttctgcccgcgcgccgagcgggagctccacggcggccggccggcgcgcaccacgccgtcggggtactggaaggccacgggatccccgtcctgcgtcatctcctccgccacaaacagggtcatcggcgtcaagcgcaccatggtgttctaccagggccgcgcccccaccggcaccaagacccgctggaagatgaacgagtacaaggccgtcgccgacgacgccgacgccgccgccgccgccatgctccacccaatggcgcctcccaggctgaggaacgagctgggagtgtgccgggtgtacatcagcacgggcacgctgagatcgttcgaccgccggccgctcgataatcaagcggcggcgcccaccaagcaacaggtgatgccatctttgacggcggcggcggcggtgaacacgaacctctgcggcggcggcggcggcgtcgtgttcgccggtgcacaaggagacagctcccgcgactgcagctcgtcgtcggggtcgcgagaactcgccggcggcgccgatgggtctgaagacgacgccatcgactggaactcgctcatcagtagcgccactgctgatgatctcggcttcaacaccgtcgttggttttgatcctagcatcgtcggatcatggccacaagtctagtgcttgattacgcgtaatataaaattaatcgagtttagtgatcagttagttttttgttttttttgcaagaagttcaaaaattattgctgtgtgttttgcactgagtagcaaagatgggaggattagaagatgaatcgattagtttgcaaatcaggtgaattaattagagtaattaacatctgtagtaatagtaagtagaaaatcaaaatgagaagttgtagcagaaagtgtatactaccacaaatccgttcttagtccgactccgaattaatcccagacggaagatcgatcgagaccgattcggagatggagccgattttgcttggaaatcaatggagaggtgaaatgggatcggattcatgggcggctacataagcaggagtcgagaggccgcaccagctcatcatcatcatcatcatcatctcattccccgcggttcgatcctcctcgcgctctcgtcgtcgtcgtcgtcatctccggttgatcgatcacttcacttcaagtcgatgtcggccatggcggctctccctgtgctgctcccgaccccgccgaggagcaagatgctgccgctgctcccgacgccgtgcctcgtcatcctccccgccaacttcgccacgtcggtggcctccaacgcgcccaagcccggccgcgccgacgccgccgacaggtgggacacgcacaagaaacccaccagctcgtcgtcgtcgtcaagctccagcaccgggagcgccagccgcgccgccgcctgcgagcgcaaagaacccggcagcccagcgtcgtcgtcgtcaagcagcggcgggaagcccggccgagccgactcctgcgagcgctgggacacgaacaaggccaagaaccagatcatcagcagcggccgcctcacgccggcgtcgtcgtcgtcgacgaacgcgcgctgggacatgaacaaggtcaagaacacggcgccgccgtcgaacagcaacaagcggccggtgagccgcgggtccgcctcggccgagcgctgggacatcagcaagaagcatcgctcgcaggacgccgccgccgccgctctcggctcggcgagtgatcggaagttgacgacggtggcaaagccgcagcagccgctgttctctgggccggcgttcctgacctcgccggagccaagcatgcttcccatgcccaccttcttgatggcccgatagcttctgcttgtgcatttcaacttcagatgaatcggactgtagttaggatgggatttgatgaagcatgttattctttgtgggtctgtttgtgatcaattgaattgaattgaact

SEQ ID NO: 6360 - DNA, 1248 bp, Oryza sativa
  Predicted polypeptide sequence is orthologous to G2536
gaatagcaatagcgccaagacatacagagaagccacagacgtcgaggcagctagcgcgcgggggaggacaggacactgcagcaagttggccggtgataagcgcgcgaactcgctggcaatatggccgacggcggcggccgccgggctcccgggttccgcttctacccgacggaggaggagctgatatgcttctacctccgcaacaagctcgacggcctccgcgacgacatcgagcgcgtcatccccgtcttcgacgtctactccgtcgacccgttgcagctctcagagattcaccacgagatgctgggcggcggcggcgaggagggggagccgtggttctacttctgcccgcggcaggagcgggaggcgcggggcggccggccgagccggaccacgccgtccgggtactggaaggcggcgggcaccccgggggtcgtctactccgccgaccgccggcccatcgggatgaagaagaccatggtgttctaccgcggccgcgcgccgtcgggaaccaagaccgcgtggaagatgaacgagtacagagcattccactaccccgacgcctcctccgcctccgcctccagcgccggcgccgccgcgccaccaaaccatcttcctccgcagctgaggagcgagttcagcctgtgtcgactgtacaccagatcgggaggcatccggcaattcgatcggcggccgctagcgggtggtggtgatgagaacccggggccatccatggctgccgcggcggcgtcacccgaggaaaacgacggatcaggaagttccatgcagcaactggagctgatggatcaaggtggcgccgttgatccggattgggaccagtgggacgacttggccaccttgaccgcacttctgtactggcctagagattagggatgccaattgtttacatgatcttgctcgtagtgctaactgtgaagtgcatgttacacgtatcaacgaccaagtgtagtacatgcttttttttcttttgccgcgcaaactctccagtattaacataagaaaaaaaaaatcagaacacacacaattttttttggtttctccaaatataattaattaattattgttttcttcagttaatcatatttttctagttggatcttcgcccttggccctgtgggatctcctccaacttttctgataataggatttgtttatactagttcatccgtcacaaaatgtaaggtatacatgtattttagatggtttcattaatacaatacttcttcg

SEQ ID NO: 6361 - DNA, 1150 bp, Oryza sativa
  Predicted polypeptide sequence is orthologous to G2536
atacgagcctttgctacccaccacgagagagacgcccaccgtacatcgatccatcgccggccggccgcacacggggtggattgagatcgatcgatcgatcgggcagcggcggacatgggagagctgcctccggggtaccggttctaccccactgaggaggagctggtgtgcttctacctccggcacaagctcgacggcggccgacgcgtccccgacatcgagcgcgtcatccccgtcgccgacgtctgctccctcgatccatggcagctcccagaggcgcaccagggcgcgtggaccggcgacggcgagccgtggttctacttctgcccgcggcaggagcgggaggcgcggggcgggcggccgagccgcacgacgccgtcggggtactggaaggccgcgggcacgccggggtgggtctactcctccgacggccgccccatcggcaccaagaagaccatggtgttctaccgcggccgcgcgccggcgggggccaagaccaagtggaagatgaacgagtacagggccttcgaggaagacgacgacaacgcagccgccgctgctccggcacagaaccattatctccagacgaggagtgacttcagcttgtgccggctgtacaccaggtcagggtgcccccggcagttcgatcgccggccgccgagctcctcggtggcaggcggcggcggcgagaaccgggcggcgccgtcatccaccgcggctgcgtttgccaacgaggatgctgctgaatcctccgggaagagtcagaagaggaaaaggagcgcgccagatgacagccttgacagcacctcatccagcgacgacaatggcggctgcgatggctctatgctgcagcaacagcagcagaggcagagaggaaccgatgaggagcttgtagagtgcagcatgacggactgggcagatcttttggactggttttgatgtaggaattcgattttacggtcggtcgtaaattcaagaaaacggcggtcgatctctaatttttgttgctaattttcattatttttttcgtgttgccaaaaaatattttagcagtcaaatggtaaattttgagaaagatctcagacagttggcagctcaaagacacaattttttaatgataacggaaactaataaaagcctgctgaaaatc

SEQ ID NO: 6362 - DNA, 387 bp, Oryza sativa
  Predicted polypeptide sequence is orthologous to G2543
cgccgcaagcgctaccaccgccacacgcctcgccagattcagcagctcgaggcgatgttcaaggagtgcccccacccggacgagaaccagcgggcgcagcttagccgggagctcgggttggagccgaggcagatcaagttctggttccagaatcgccggacccagatgaaggcgcagcacgagcgggcggacaactgcttcctccgcgccgagaacgacaagatccggtgcgagaacatcgccatccgcgaggccctcaagaacgtcatctgccccacctgcggcggccctcccgtcggcgaggactacttcgacgagcagaagcttcgcatggagaacgcccgcctcaaggaagagctggaccgcgtgtcgaacctgacgtcgaag

SEQ ID NO: 6363 - DNA, 228 bp, Oryza sativa
  Predicted polypeptide sequence is orthologous to G2543
atgacgcttgatgacggcaagtttgtcgtcgtcatgttcgggcccaacaaaaaagggccacagtccccttatgaagccatggagacacgcatcacgccgtcgctcatgtgccgtcgatcgatgcacgtcaatgatcggagcgggcgtcgccgatcggccgacatgggacgcatgaggcaccgcaagatggatcgatctacgtactgtactttgcatgccaccgcatga

SEQ ID NO: 6364 - DNA, 2096 bp, Oryza sativa
  Predicted polypeptide sequence is orthologous to G2557
gatgaacatgaggaccatcatatccctcatcccagatacatgatctgtactgtctcctcctctctagcttctctcctctccctgctgtgccccttgctttgttgcttggtcaattagagctaagcagcaagctagcttcctggaagcaaggccggcgcctggctgggacaagaaccacaggaaccacagctgactgattgatcaatcaatcaatcttctgctgccctgctgcctcacagcctcagcaagacaatcaattttggccctcttgaggctccggccggtcgccgactcgccgtcgtcgaaggtgctctccggccggcggagttaacattgagcttgatttcaagccgcgctccgatccgaccggcaaagcgccgaagctgccttccgtttgtttcactctggtctctgggggctcgccatcagccatccgtaccgagctgtagtgtgcgcggttttgtcgcgtcgtcgtacgtcgagaatccgtgagccagacagacaagccagtggtttggtgattcttgcggcggcgcggcgatggagaccttcggctgggccggcggcgggcagctgatgcaccacgacgacatctacttgccgcgctcggtggggtgcgggcggccgttcgagctggacgacgcgttcctgggcgcgtgcttcggcgcccagctccagtgcgacggtggcgtcggcggcggcgacggcggcgggtgtctgcagggtacctcgggatttggcgccgtggctggagacccgttggggttgctgtgctcgggggacgtgtttgcgtctgtcgccgagggcgccggcggcgcgcacgacgacggcctcctcgacgcggcgctcgccttctcccggaatcagctcgggggcgccgcctgcgacgggagcgacggcggggccgtgtcgaacggcgccatgctgtccagctacagcggcaccaccggcggcaacatctcctccggcgagtcgaataactacagcggcggcggcggtggctacgacgccgatgtggtgtcgccgacgtccaccatgtccgcagccacacagtcgctccaccccaagcgaaagctatacgacgaccaccaccaccccgccggcatagcagccgcagccgcagcgccaccgctggcgccgtgcccacgccccaccaccggcgccgtcgccgcgaagcggagggcttccacgtcagcaacaagcatcaccttcggccaccagccgcaccaccaccacgcgggcgccaccaccgccgggtacgagcctgacatggaagccatggcgcaggtgaaggagatgatctaccgggcggcggccatgcgccccgtccacctcggcacggaggccgccgccgacaagccccgccgcaagaacgtgcgcatctcgagcgacccgcagacggtggcggcgcgtctccggcgggagcgcgtcagcgaccgcctccgcgtcctgcagaagctggtccccggcggcaacaagatggacacggcgtccatgctcgacgaggcggccagctacctcaagttcctcaagtcccaggtccaaaagctggaaaccctaggcaccaccaccaccacgtccaagttaccgcagcagtattacagcggcaacatcaacagcagcaataatcaccatggattcctcggattcgcagcaaataacaacaccatttcagctggctacgcaaattctaatgctggaaatgcaacgaaactgttgtagcactgtggctagcacaagtacttgatacgcacaacgtacgcgtggtctcgtcgtctatatacatgtagtaacatgctgctgttttctactgtttctaggcttggtggtgatcagtgtacgtacacacggcacataattggagtcttaattagtggtggagtgcatgctgatttagttcgtggtcatgttcttgtgcaagatttagatttataatcttccgctggcggatcagctgcatggagtgagaagttacatcaaattaaaggggccatctgatggttcgttcaaaaaaaaaaaacgggtgccatctgatagaggaaaacatgtggttcaataatggaaaagagtggcctggacgagcaatttgcgagtgg

SEQ ID NO: 6365 - DNA, 1473 bp, Oryza sativa
  Predicted polypeptide sequence is orthologous to G2557
atgtttagatcagctgttgcagtgagccaatcagctgcctcatggaggttagctacgacgacgacggtgtggatggatcgtggcttcaacgagatgatcttgagcgagagcgtgtggaatggcggcggcggcggcggagatggagatggtggggcggtggtgctgccgccggaggtgggtggtgtcaatgcggtggacgggagcggcatgacgatgctggagaggctggtgctcgacgaggccctggcggcggcgatactcgagctgcagggcatccaggcgccggggtgcggcgggggcggcggcaaggtggcggtggtgccgccgccgacggccggtgacggcggcgtcgaggcggcggtcgccttcgcggcgatggcgacggggacgcctgcctacgctgacgttgacgcggatgtcctgcagcgacagcggcagcatcaccatcgccaccagggcgcgatggggatggctgccgagtacgacgtcgcaccagcaacaccggctgtcacgttgagcgctgtaccaccaccaccaccaccacctgcgttcgcgaccgcagccgcctccgttgacggcggcggcgccatggacgcgacggtcttctccggcatcggcaacgacgacgtcgtcgacgcggtgagcgccacggtggcgatgactactgccactgcaacgaccagccagtgcgaacgagtcagaggaggcggcggcggcggcggatgtggacgtaagcaacgccggccgggaagaaagcggaaggccgccgagccaaccgccgccgccgccgcggcggacatgtcgtcgcaggacaaccctctctgcagcctcctggcgtcgaacaccgccggcgccgacggcggcatccagatcgcgttcagcacgagcgccccggcgtcgaagcgggcgaagccgtcgctgagcagcagctcgtcgagcatcagcttcgacggcaggggccccggcggcaactgcggcggcggcggcggcgacgacccactgtacgagcccgacacggaggcgctggcgcaggtgaaggagatgatctaccgcgcggcggcgatgcgccccgtgaccctcggcgccgaggacgccggcgagcgcccccgccgccgcaacgtgcgcatctcctccgacccgcagacggtggcggcgcggcagcggcgggagcgcatcagcgagcgcctgcgcgtcctgcagaagctcgtccccggcggcgccaagatggacacggcctccatgctcgacgaggccgccaactacctccgcttcctcaagtcccagatcagggagctgcaaaccctagaccgccggaactacccgaacgccgccatgtccatcaacaccgccgccgccaccaccatggcgacatccagttcaccaacctacaacaacagcaacgccgccatgccagccttcgccttcccggaaaccctaggatgcggaggaggaggagtcgagcagctgatctaa

SEQ ID NO: 6366 - DNA, 1245 bp, Oryza sativa
  Predicted polypeptide sequence is orthologous to G2557
atggacgccttcgggtggagcgcgccagccgcgccgtgccagccgagctgcggccccggcggcgacgacgacgacgacgtcctcctcgccgccgtcttgggcgcgagcttcgagctccactccctcgtcgacggcggcggcaacggcgccgccggcgccgttcgctctgacgatgcctacggcctcgacgtcgacctgccgtcccaccagatgagcctcctgcgttgccaagatggtctgagtgctcttcacggcgacgcgtccccgacggcggcggcggcggcgttccttgactcggtggatgtgttgccagtgccggccatcgccggcgcgacgcacgacgacggcgggctcctcgataggttcgcgttcccgaacgttgccgagacgacgaccgtgcaagccgccgcgtcgaacaccgccttctccggatacagcagcaacaccaccggcggcggcaacatctcctccggcgagtcgaacacctacacggaggtggcgtcgacgccgtgcgccgtgtcgacgacgacgacgacgacggctctgcccccgtcgaagcggaagctaccagagaagtaccccgtcgtaggcacatcaccaacgacgaagaccacgacgacgtcggagacagccgcagagcgccggagcaccaagagaggggccgggggcagcagcagcatcacgttcggcggcggctgccacggcgccggtgcggcggcggcgctgctcggctacggccgcgggtacgagccggacacggaggcgatagcgcaggtgaaggagatggtctaccgcgcggcgccgatgcgcccggtcaccctcggcggccccgcctccgcctccgacccgtcatcccggccgccgccgccgccccagcggccgcggcgcaagaacgtgcgcatctccagcgacccgcagacggtggcggcgcggctgcggcgggagcgggtgagcgagcgcctgcgcgtgctgcagcggctggtccccggcggcagcaagatggacacggccaccatgctcgacgaggccgccagctacctcaagttcctcaagtcgcagctcgaggcgctggaaaccctagggaatggcaatggcaacggcaacctgttgcaccatggctactacactggatcaagaaatgctactgctactgctgctactggttctagcaatagcactgtacttgcatttgggcgagatggacttgctggctttgtgaaatccaataggaatttgcaattgtag

SEQ ID NO: 6367 - DNA, 702 bp, Oryza sativa
  Predicted polypeptide sequence is orthologous to G2557
gcgagtcgaacacctacacggaggtggcgtcgacgccgtgcgccgtgtcgacgacgacgacgacgacggctctgcccccgtcgaagcggaagctaccagagaagtaccccgtcgtaggcacatcaccaacgacgaagaccacgacgacgtcggagacagccgcagagcgccggagcaccaagagaggggccgggggcagcagcagcatcacgttcggcggcggctgccacggcgccgccccagcggccgcggcgcaagaacgtgcgcatctccagcgacccgcagacggtggcggcgcggctgcggcgggagcgggtgagcgagcgcctgcgcgtgctgcagcggctggtccccggcggcagcaagatggacacggccaccatgctcgacgaggccgccagctacctcaagttcctcaagtcgcagctcgaggcgctggaaaccctagggaatggcaatggcaacggcaacctgttgcaccatggctactacactggatccaagaaatgctactgctactgctgctactggttctagcaatagcactgtacttgcatttgggcgagatggacttgctggctttgtgaaatccaataggaatttgcaattgtagtactgtgtaccatgcatgattcatgcatgcatgcaaggtgtgtattcgtgtgagtgacatatatatattttatacagtgcagtgagaca

SEQ ID NO: 6368 - DNA, 695 bp, Oryza sativa
  misc_feature (676)..(676): n is a, c, g, or t
  Predicted polypeptide sequence is orthologous to G2559
gctgagaaagctgcagcaacaggtggctcacacgaaagagacgctctcctgacgacggtcgccacggagaagaggatatcgctgatcaaggcgtgggaggagaacgaaaaggccaaggccgacaacaagtcagtaatactaatagtagctcttctctcacttcttgccaaggctgagttattttcttcaactttgaaccgtgctcgcttttcattagcacgttttttaaactattaaataatgtgctttataaaaacattttatatagaaaataaattcaaactaggtcgaaagatataaaattcctgcattccaaatgagccctcggttaactgaaactttcgcgcacagggcggccaagaagttggccgacatcgcctcatgggagaactccaaggtggccgagatcgaggccgagattaagaagtaccaagagtacctggagaggaagaaggcggacaggtggagaagttgatgaacggcgtggcgaaggtgcacagggcggcggaggagaagcgagcggcgacggaggcgcggcgaggggaggaggtggtgaaggccgaggaggccgcagcaaagtaccgcgccaagggagagccgcccaagaagttgctctttcggttgaatctcttctcggtcatctccattgatcgtcgtcgtcgtcgtcgttgttgtnaatgtgtgtgcgacagtgt

SEQ ID NO: 6369 - DNA, 975 bp, Oryza sativa
  Predicted polypeptide sequence is orthologous to G2559
aaatacactcttctctgagcttcctcaagcttctgaaaacagcaagagattaaattatcgtaattttaagcatccaaggtgtttggtgccagtgctcgaggactggagatggagacccaggaggcgaagagagcagatgtggcggcggcgccggcgacggcgaccggcggtgaggccgtcaaaccggccgccggcgatgctggcgcagtaaccaagacgaatggaccttcagcaccagcaggcaaagctgcaactccaacgggttcggttgacagagacgccatactcgcaaacgtggagctggagaggaaactgtcaatgatcaaggcgtgggaggagagcgagaagagcaaagcggagaacaaggctcagaagaagatgtcatccatactctcatgggagaacacgaggaaggcagctatagaagcaaaactgcgaacacaagaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctagaaccacaaaaaacgctcctgcagtgcagtctcctgtcctgtgtgctgatgcttctgtgtgttgatatggtgatcagtttgcagttttgggcttgtttctcttctttaatcttctgtgttgaagttccggatttcatggctctgtcatgctgctgctgtgttttccttttcgctgaagatgtgatcatcatgtttggtgagtgtaagcatactcaaaacacttgtaaacagtcagtcacatgtaaacataccaccttttttgtgaattttgcgcttccagagattaagaaaaaaagcgtgccaatttgttttgttggtgctttgtatc

SEQ ID NO: 6370 - DNA, 1037 bp, Oryza sativa
  Predicted polypeptide sequence is orthologous to G2559
acagtgcgttgtccatcacaattgctaattaactaagacacccttccttgattgtgacactagcacgacgcactttcctctatatacatatacatatatcctccttccgtccagctaacggtttatatgcttagctagctgtttgttttggcgataccatttgcattgcttgcccagcatcgtcgtcgtcgtcgtcgggagcaaggaggaggagagaccatcgatcttgattgatttgaagctagatggcggaggaggcgaagaaggtggaggtgaccaaggacatcgccgaagagaaggcagtggtgccgctgccgacgccgccggccaccgagcacgacgactccaaggccatcgtcctcgtcaaggaagctgaggctacaggaggttcagctgaaagagatgcttatctcgcaaaaattgtgtcggagaagagattggtactgatcaatgcctgggaggaaagcgagaaagctagagcagagaacagggcggccaagaagctgtcatacatcacttcatgggagaatgcaaagaaagcagagatggaggctgagctgaaaaggatcgagcaagaactggagaagaagaaggcggcgtacgaagagaagctgaagaacaagctggcattgctgcacaagacggcggaggagaagagggcgctcaccacggcgaagcgtggcgaggagctgatcatggcggaggagatggccgccaagtaccgtgcaaagggcgaggctccgacgaagctgttcgggctcttgaaagcctgagagaaatcatgaggagttcatcatacatatatgctgggatttggtgttgttgattagtctgtgaacttacagaaatttgtatatgtgcaatgcatggcatccgtgtttgcgtcgtgtgtatgtcgtctaattgaagggccatttggtttgtattttgtcagttgggtggtttgatttctggtgcgttttgtaaaggaattgtgtatatgcataggggagtgcaggcaggggatgatggattatgaatacgcttattctttcatg

SEQ ID NO: 6371 - DNA, 950 bp, Oryza sativa
  Predicted polypeptide sequence is orthologous to G2559
caagcttctgaaaacagcaagagattaaattatcgtaattttaagcatccaaggtgtttggtgccagtgctcgaggactggagatggagacccaggaggcgaagagagcagatgtggcggcggcgccggcgacggcgaccggcggtgaggccgtcaaaccggccgccggcgatgctggcgcagtaaccaagacgaatggaccttcagcaccagcaggcaaagctgcaactccaacgggttcggttgacagagacgccatactcgcaaacgtggagctggagaggaaactgtcaatgatcaaggcgtgggaggagagcgagaagagcaaagcggagaacaaggctcagaagaagatgtcatccatactctcatgggagaacacgaggaaggcagctatagaagcaaaactgcgaacacaagaggagaagctggagaggaagaaggcggagtacgcggagaagatgaggaaccaggtagcggcgatccacaaggcggcggaggagaagagggcgacggtggaggcgacgcggcacgaggagataatcaagtatgaggagatggccgccaagcacaggtccaaggggactacacccaccaaattcctctcttgtttcggctcctagaaccacaaaaaacgctcctgcagtgcagtctcctgtcctgtgtgctgatgcttctgtgtgttgatatggtgatcagtttgcagttttgggcttgtttctcttctttaatcttctgtgttgaagttccggatttcatggctctgtcatgctgctgctgtgttttccttttcgctgaagatgtgatcatcatgtttggtgagtgtaagcatactcaaaacacttgtaaacagtcagtcacatgtaaacataccaccttttttgtgaattttgcgcttccagagattaagaaaaaaagcgtgccaatttgttttgttggtgctttgtatc

SEQ ID NO: 6372 - DNA, 2575 bp, Oryza sativa
  Predicted polypeptide sequence is orthologous to G2565
gatcgactcaaaccgaatccgctcggctcgcatgggcgaccgccaccgctgtcttctgtcggcgccgccctcgccgtcgacagccacagtcgctgccgccaccgggagccaaaatcggcgccgccgccatcgaaatcgattcgatttctctcctttcctcctctcgtgtattttccggccaccgaaaaccctatctcttccaaaaaaatccccaaatcggcgccggctgctgggtctacgggaggtcgccggctgctgggtctacgggagggcgaggcctgctggggaccttgactgccgcatcggcaggggcagccggccggcggtaggtggcagcggcagggcagcatgccgcagcagcagcaggccatggctgtcgcgaggcagaccctcttgttgcatgctatggctctggctctagctatgtcacagcgtgaacaggccctataccgaagctgccgatggaagaaagcaatgtcatagctgcagcacaacagaggtacattttttttgagaatttcagaacattccaaatagaaaggtttaaatttattattgaacttgcagttgtgtaattgtttgtggagttttgattagtctaaaataacaccgctgatactagagtatgttgcacaaaatggtacacgctcaattgctctggacagactattgaaaatactaactccttatattaaaggaattagaacaaagtcattgatttcgactagtatcttggaaggtgtaacatccattagtttatctttttatccttcttctgagcaccccccaaaattgcagctaacttccttctaaaatattttatatcttcctgcaaaattcataaaggtatttgttagatagaaacaatcaattgaggacttgtaaagaagatgcaaaaatatttagtgcatcttacatgcgtgtattccttcgacaacctattgccttgccagtgctccatgttttttagtacaaagagcccacatgagacgctggaagaattgaattatattagagaagtgataacatacatttaggtagtgaaaaaaactattattgtagtggctgcataacatacagatctccttgtaatggcaaattctgtatgaccgtgacttcccaggaagtaatatgatggtcaggccattgtgttgctatgtgcttttcttctggttccaacagctgaaaatattgttgtaatccttctagctgttttgtgagaaaacgtcattactgcggtatgttcatgtcctttttggtttatttctaagtagaatacttacaacttttcttagttccttgcgttgtgtggatgaattcgccatggagtcaagcacttggatgatgcggcgtttggcgtgtatgactgccaggtaccgatgtttttcttttatgttcatggggaggaaaatctgtacaaagaaatcatttgtaggatatattagtagtataaacttgctgaaaatttgatagtattgtggcataaatattaccatatcatgctttagatatctatttgccgttgctttagccattgcccgatcgatgatgtctttggaaacatagtgttcgccatctctttgtagcaaccttgttattaacggtttctctaggaacaccgtaccttctgccctagtccctgtaccttccttcatatctttctcacgtagacaagtaacgtatgcatcgattatttaaaagtagaggaaaatggcaggttatgattgtgctagtagttgcatgagagaatagtttcacgggttagtaaacttacgtgatcatccaaatagctcgtacttgattcagtcactggattagtcagaatttgcattgttttttgggaaattgagacatcatcgatatgcaccactagttgtgattctggtgcactcattatacttttaatggtttcctcatcttctgcggtgcacttgaactctgccattgaagttaaatctgtaagtgaactgcaacacaaaaattaagcagagtaggatgtgatgataattataggacttttaccattggatattaaattctttgcttgcgcattctttggtttcttctttgtagcccctaaattgtagatgaaatcagaatttgatttaattgttgatttacgcaatcttcatgttgatcctgaaagtgacttggcaatgacgggcgtttgagttggtgggtttggtttctgctattcaattggcattttaaaaataattagtattaaatttgacagacactgaagaagtaagatgttgtcttaccttttttttaattatatgtgtttctttgtcgaaacttttgcaaacatttggcttagagttcttggaagttggtattgtcttttcctctttgaatgcagctattatgttggtgagtgattgaatttggttatgcatggactgttgattctgcttcatctccttcatctcctttccttgctcttctatcagcatgattagttttcgggtcagtgactcagtttctggcctatcctgcataatatgtgtttgttaagttttgagacatatgctgttgtaattcaaataaatagtaacaaaagtataattttttg

SEQ ID NO: 6373 - DNA, 773 bp, Oryza sativa
  Predicted polypeptide sequence is orthologous to G2571
gaattaccttttattccccttcaaagaatttacaacacaatgacaatcacaagttacagtcttgctagctctagcacaaatgtcacttcaccagcaagacaaccttcctctgttactcactgaaaatttcagacatagcacacgatgaataaaacacactggaaatttcagatatatcgactccaatcactgctatcctacagacatcattttcagatatgtcgactccaatccctgctatcgtacagacatcttctagcttaattggaatcacggctgtggcaaccctccagcgggtcctatccattctgagacatgctacaattgttgcgctgcctgacgaggccatgctgctgcagcagaagctgtaccgcggcgtgcggggcagccgcagtggggcaagtgggtggcgtagatccggctgccgcagaaccgggtgcgcgtctggctcggcacctacgactcggcgacggagtagcgctcggcgaggacggcgacggagcagcgctcggcgggatggcgcggcgctgctctcggcgaggacggcgccgctctaggtgacgacggcgacgggacggtcctccatcctcgactgcaagtccggatgacgtggtggcagtgaaccctttccttcctcgtgccgaattcctgcagcccgggggatccactagttctagagcggccgccaccgcggtggagctccaattcgccctatagtgagtcgtattacgcgcgctcactggccgtcgttttacaacgtcgtgactgggaaa

SEQ ID NO: 6374 - DNA, 535 bp, Oryza sativa
  Predicted polypeptide sequence is orthologous to G2571
gcacgaggcagaatgcccttcccgccttgcccgtaacatccgctggtaattacgaaattaccctcgcggctccgggattcccatggacgccagcctccgcacactgcctccggcgagcttccccggcgaggtccgctccgccgtctcctccctcctcctctctcccggcggcagcgccctcgacaccgtgttctcccacctcccgccgcccgtcaccgtcccgcctctcggctccagcgtctactaccgccagagcgagctcctgcgccacttcgccgcgtcgcaggcggcgcaggcgcagagcgccaccgccgccgccagctcgtcgtcggccgccgcggcgggtctcgacgatggcgcgccgcggaagctgtaccgcggcgtgcggcagcggcagtgggggaagtgggtggccgagatcaggctgccgcagaaccgggtgcgcgtgtggctcggcacctacgactcgccggagaccgccgcgcacgcctacgaccgcgccgcgttcaagctccgcggcgagtacgcgcgcctc

SEQ ID NO: 6375 - DNA, 495 bp, Oryza sativa
  Predicted polypeptide sequence is orthologous to G2571
caggccatccgcgtccgcatggcgcgcaagcgcgcgcgcgcgcgccgccagcgcgaggagagcaagaagagccaacgcgccgaggacgcgaagtcggcgacgccgtctcgccccgtggcctccgagcgctccgcgtccgagacgacgacgacgacaaccacgacgtcgtcgtcgtacgggtcaccggacggcgtgctctccatgagcgcggcgtccgtcgacggcgactgcccgctcgagcggatgccgtcgttcgatcccgagttgatctgggagatgcttaacttctagctgcgtagatggagtacgaaccatggacacgaaccaaccgacaccaaggtccatggatggccatgattggttgcagagtttgagctcttagaaattcttcgctgttaggtgatgatggattattggttatttgtgaaggttataacctagaaatattagaaggatatcagcaataaatcgtcccgagaaaattgggcttgttag

SEQ ID NO: 6376 - DNA, 600 bp, Oryza sativa
  Predicted polypeptide sequence is orthologous to G2574
atgaaacttttgaagagaatggattacccggccaggcggtcaagcgaagaaagaaaaagttctgctgtcgaggttggcggcgaaagaggtgcgccgccgcccagcagcggcggctctgtcgtctcgcggaggggacgttgtggccccatgcacggcagcgacgcgcgcggctgcagccggcgtccggcggcaacgccgggcatgcacgagagacatcagccatcaagttgggccaaagctcgtgcggtggcgcatcccagatgcgagcgaagacagaggaaggtcgtgggcgtatcgctggcgtatcttgatttatttatttttttgcaaatcacaaatatgtgggatacgtacgggatacgtattggagcgtatccgatacgtatccgtatccgttgccgtatccgacacggatacgtgactatacaagcatatcaggatgggacaggcggcatcgcacccacgtcctaccctgtgtcaggcggcgtggggcaaggcgaaggacgacgctggggcccacctgaggacgagcggccaccttactttcggcctaaggcatgggcggtagctcgacccaggttgatgtgggcccctctctag

SEQ ID NO: 6377 - DNA, 483 bp, Oryza sativa
  misc_feature (297)..(297): n is a, c, g, or t
  Predicted polypeptide sequence is orthologous to G2574
ttttttttttttttttttgtcctttgaatcttatcgatctttaccgaagtggacatcccaggaccacaaaacccacagcatcttcagaacattcgacgaattcatgacatgttacactgagtatgaatcacacaaaactcttgactaacttataccggtaccttcccactcttataaccataacgagaaccagcacttaaggcggaactcccgacttcggtagtaagaattcttaatttggccaaaaggccaagtcccccactaatggaccaaaggggaatcaccaaatatacttgngctggaattctctcgatttattccaatcttcccgaggcggtccttaggtccgacgccctttggtaccctgctgtgctctgccctatagcgctccgaaacccgttagctttacgctaccctcctacgcacggtcaatctcgtcgcgccttgttggtccacactggttctcgccccccaccgttactc

SEQ ID NO: 6378 - DNA, 673 bp, Oryza sativa
  misc_feature (11)..(75): n is a, c, g, or t
  Predicted polypeptide sequence is orthologous to G2574
tgcgcgatgtnnnnnnnnnnnnnnnnnnnnnnnnnnnnnnnnnnnnnnnnnnnnnnnnnnnnnnnnnnnnnnnnnttttttttttcagtagatcatcaacttaatttacaggtggaaaattaaggcgagctatgtagttaaatgcccctatgtgatgtggtggcaaatcttgaccaacaaaaagaagaattcaaagaagaagaagacatattactggcttgatccatacatatagcacagccctagagcacagcctactacccgccggatcttgaatgtgcagcgccgtgcgagcgacccgacactgaacgaacagaacgagcacgtgacgcgaccccattgtgacccattctgtgcgaacatctggcacctcgaaatctaccttgacacagcatctactaccagactcacaccaacaccgaatatctagacaatccgtatacataggacaaagcggttataccaggaccatctgcacgcccatgcataccattactacgctcccatggacgtccaaggtccacagctccgaggcagcggctagcacgactgacgatcgatccttcgctacgagctgtctcgccgcacagcgcgatccaaggggccccttagacccccgcaccccggacccagcggttgacccccctctcggcacagaagaacagagcgagcg

SEQ ID NO: 6379 - DNA, 1947 bp, Oryza sativa
  Predicted polypeptide sequence is orthologous to G2575
gagaggttgtggttagctagctcgaggcgcggacgcggtgttatgggcgttgccgtgcactggcggagggcgggcgattcgcttcacatggggggcgagccgcgcgcgcgcgcggaggcggcctgggcggctgcgttgcctgccgcgttggttgcgctggtgcgcgacacggctacatacacacgaatgatgcaccgtctccgaatggaaacgccacggggccccacctgccagcttgacccctgctgctgctgctgcactgcacatgttattccccctccgcctccggtgtcacgcacgcacgcgacgcgacgcgatgccgaggcgtccgtaccaccaccgccagcatcagcggccgtcagctcgagatcggacggcacgggacagatggcagcaggcgtcacgctggcgtgtgccgcccccccgccgctaagggccccacgtgccagcgatggaggcaggcgccgtggggtggtcaaagggggcgcggggacggacacgtgtcggtcgccgcaacgtctgaatgttcgaccgcgcgagagagagagggtgcgtgcgtgcgtgcgtgctagagccaagaaccacgagcacggccagcgtcggcgagaggcggcggtggatccggctatgtcgggcgagtaccagttccaggacgagctggcgccgctgttcgcgcggccggggggcggcgcgggggagatgcagatgctgccgtcgtcgtggttcgccgactacctgcaggcggggacgccgatgcagatggactacgacctgatgtgccgcgcgctggagctgccggtcggggaggacgtcaagagggaggtcggggtggtggacgtcgtcgcggccggcggcggcggggcgccgccgctgacgccgaacacgacgtcgtcgatgtcgacgtcgtcgagcgagggggttggtggaggaggtggaggcggcgccggcgccggcgccggggaggaggagtcgccggcaaggtgcaagaaggaggaggatgagaacaaagaggaaggcaagggagaagaagatgaaggacacaagaacaagaaagggtcggcggcgaagggagggaaggcggggaagggggagaagcgggcgaggcagccgcggttcgcgttcatgaccaagagcgaggtcgaccacctcgaggacggctaccggtggcgcaagtacggccagaaggccgtcaagaacagcccataccccaggagctactacaggtgcacgacgcagaagtgcccggtgaagaagcgggtggagcggtcgtaccaggacccggcggtggtgatcaccacgtacgagggcaagcacacgcaccccatcccggccacgctccgcggcagcacgcacctgctcgccgcgcacgcgcaggcggccgcggcggcggcggccgcgcaccagctgcaccaccaccacggccaccacggacaccacggcatggcgccgccgttgccgctgggctccggcgccgccgcgcagttcggccggtcgtccggcatcgacgtgctgagcagcttcctgccgcgcgccgccgccgcccaccacggcatgactacgatgggcggcgccgcggcgacgacgacgacgagccatggccttaacagtgcaatcagcggcggaggcggcgtctcgagcgagacgacgagcgcggtcaccgtcgccgcctcggctcagccgtcgtcaccggcggcgctccagatgcagcacttcatggcgcaagacttgggcctcctgcaggacatgctgctgccgtccttcatccacggcaccaaccagccttgacgcgacgaccaccatcaatctgaagctgaattaatcatcagactagctagacaagaggtcatttggctctcgatcgatcatgctgtttaattaattaacatctcgttacatctttttccccccaaatgatcacctctgtttcgtttcttgatttgttttttt

SEQ ID NO: 6380 - DNA, 1525 bp, Oryza sativa
  Predicted polypeptide sequence is orthologous to G2579
acacacaagctaagcttagctcgagctcattcatataccttagcttagctaaagcctagctcactctcactctcactcttgcattgcattgcaatattgcaatattgcattggtcatgaacactcgaggcagcggcagtagcagcagcagcagcagcagccaggccagcctgatggcgttctcggagccgccgaagccggcgagccagccgtcgccgccgtcgtcgccgatgagcgagcggccgccgtcggggcgcagcaggcggcgcgcgcaggagccagggaggttcctcggcgtgcggcggcggccgtgggggaggtacgctgccgagatacgcgacccgaccaccaaggagcggcactggctgggcacgttcgacacggcgcaggaggcggcgctggcgtacgaccgcgccgcgctgtccatgaagggcgcccaggcgcgcaccaacttcgtctacacccacgccgcctacaactacccgccgttcctcgcgccgttccacgcgccgcagtacgccgctgccgccgccgcgccgtcctcggtgcagtacggcggcggcgtgggcgcggcgccgcacattggctcgtacggtcaccaccaccaccaccaccaccaccacggacatggcgcggcgtcgggcgcgtcgtcggtgggcgagtgctcgacgatgccggtgatggtcccggttgatccccaccgctccagcatgtcgtcgtcgctgctggacatggacaggaacggccacgacttcctcttctccggcgccgacgacaactccgggtacctgagcagcgtggtgccggagagctgcctccggccgaggggcggcggcgccgcggccgatcatcaggacatgcggcgctactccgacgccgacgcctacggcatgatggggctccgggaggacgtcgacgacctcgcgcagatggtcgccggcttctggggcggcggcgacgcggcggaccagctcggcgcctgcgggttcccggcgagcggcggcgccgccgacatggtcgcctcgtcgcagggctccgactcctactctccattcagcttcctctcccattgatcgagttgcaccgggcattgcatggctaatcacgcactttgcctctgagcgatcatgcatatatcatttcctgtctaccatgatcagatcgagttgatcttgatcaatctgcgtttgatcgatcgagcaagagatcgagtagtatagcagcagcagcagcagcagctagcagtagatcgaacaagaagagtggcttggcgccatttctagttaattaagtagagcttcttcaaatatgtacttaggcagatgatctctctctctctctctctctctctctctctctctctctctcttctatattagcattagtacctacttagccatcatattcatgcatgcatgcatgatatattgcatggcacagcttgttaatttcttctagcatcttaatcaattaatccatgacctggttcaaaatgtccaattcgattttacattttacaactaacc

SEQ ID NO: 6381 - DNA, 1128 bp, Oryza sativa
  Predicted polypeptide sequence is orthologous to G2585
atggcatttggtcaagataccatagagcagctgtaccgggagctcgccggcggccgccgcctcagcgccaagctccaggcgctgctcgaaggccccctcgatagccgcggccagaaggaggccgtcgatgttagcagagagctcgggcgagtgttcatggtgtctctctacatgctgaagccttgcagcaacagcagcagacgaccggaaggagtgaccaggacggcgccggagacgaggactgacgatagcatttgcttgcacactccggcgagggttaaacgcgttaggagtgaagaggttcttgtcagaaatggcagagaagaggtggttacgaggacggagattattacaccttccccgtacaaggatggctaccagtggagaaaatacgggcaaaagaacattcaggacagcaattatctaaggttgtacttcaagtgcacgttcagccgcgagcggagttgcgcggcgaagaagcaagtgcagcagcgggacgccggcgagccgcccatgttccttgtcacctacctcaacgagcacacgtgccagcagccgcaagctgttcccggcacgcccaacactgcaggtagctcgccgacgacgacgagccggcaacgacagtcgtcctcctccccgccggcggaaatgttggacctgacgatgaacggcgccggcctctttagccgtcttcttttaccccacgccgtcggcggcggcggcagcgccgccgaagaggaggccgccatcgtcacgtgcctcgcggcggtcatcagcggaggaggcgccgcagccgctccgccgccgttgatctggccgacatcggccccagaggcggcgttcgtggcgtccgcggcgggacactcgccgagcgccgcggacgagagcgtggcggacgaggcggcggcggcgcagatggccgacatggactactgtttcggccagtacgatcagtcaacgttcggggcggcagcagcagcggatcaccgtgtgttgatcggtgacgacggcgacgtgcagcgcatcgtcgcggcgcggatcgcggacacggtgtggccgcggtacacgcgcgacacgagtgcatgggagactgctgggacgtcgtcgatgagaggatcgatcgattga

SEQ ID NO: 6382 - DNA, 255 bp, Oryza sativa
  Predicted polypeptide sequence is orthologous to G2590
atggcgcggcaggcaacgacactagatccacttgtcccgaggtcgtcgccggcggatctgcccttcccttggccattggcagtggatctagccctcccgcaatggtcgccggcggatccgcccctccccgcctccgctatccgcgggcgttgctgcgccgctgtatgccgcagcgtcttcactgtctacgggcattatgctgtgcaaccgtatgtcgcagtgcctccgccgtccgccggtagcgccgccgtctga

SEQ ID NO: 6383 - DNA, 680 bp, Oryza sativa
  misc_feature (638)..(638): n is a, c, g, or t
  Predicted polypeptide sequence is orthologous to G2592, G2713
ctccttccagccaccaatccattgcagaattttcgtgctcaatttcggataaatgttgggtgttctgtttggtgggttgagagcttgaattcgagccgttttcttgcttcttcgagctggtggtggttttcttggcccttggattgattctgggattcagcggcggagacacctacctccgcgtgaggatttctgccatttcttgcttgctgcgtcgagggatttggtccccgccctgcttgcttccagctcagttcggtgccttgttggtgttcatcgatggattccggcatgggcggcgacgccatggagacattacggtgaaattagctcggcccgtctctcgcctgcagatttgagagattggaggagaggtgtggattaggagggggaatcgagcgaggaggaagatgtcgttcaggagcctgatccaggagatgagggacgagttcgggagcatctcgcggcacagcctgcggtcgcggtcccaccgcggcggcggcggcgcgccgcgggtggcggcggtggggccggcggaggcggcggcgatgcagcagagctgctgggcgcagctgccgcccgagctgctccgggaggtgctggtgaggatcgaggagtcggaggtgtggtggccgtcncggagggacgtggtggcgtgcgccagcgtctgccggagctgg

SEQ ID NO: 6384 - DNA, 2027 bp, Oryza sativa
  Predicted polypeptide sequence is orthologous to G2592, G2713
gagtatcttccccgttccttcccttggcgtaagagaacgagaaatctcccatctctcagtcgtctcccccgcttccttgcgccaagacgagtcgcggctgagcaggagaggggcgccgatctccatccggcgagcagagcaggggaggggatcctggtatagattgttgattgcttgtgcgtgaacacaactaaagcagtaattcttaccgtgtcagcgtgatctgggactgtggccaattgtaccataagtggaaacacagctgcgaagattgtcggtggtcttcgctgataatatattgggcaggctaagtttcaagttcagtttgctgaattcagcgagcctagatgtcgtttcgcagcattgttcgtgatgttagggatagttttggtagcctgtcgaggcgaagctttgaggtcaccctggctggtctatcggggcttaccggccaccatagaggcaagtctcagagtacggttcacgagctctgtgatgcagatctcataatccaggagagtcgttgggctagcctccctcctgagctcctccgcgatgtgatccggaggctggaggctagtgagagcacctggccgtcacgcaaggatgtcgtgtcctgtgctgccgtctgtaaggcatggagggagatgtgtaaagagattgtgctgagcccggagttttgcgggaagcttaccttcccgctctctctaaagcagcctggccctcgagatggaatgattcaatgtttcataaagcgggataaatctaaatcaacttatcatctctacttgtgcctgagtactgctgtacttgcggatagtggcaagttcctcttgtccgctaaaaggcaccgcaaaacaacctgcacagaatatgttatctcaatggatgcagacaacatttcaagatcaagcagcacctatattggaaaactaaggtcaaacttccttggcacaaaatttataatctatgacacacagccctcttataatggggctgtaatccctcctgttggacggagcagccgaagattcaactccaagaaagtgtctcctaagatgccgtctggtagttataacatagctcaggtgacatatgagcttaatgttcttggcaccaggggccctaggcggatgcactgtgtcatgcactccatacctgcctcctcagtcgagcctggtggcattgtccctggccagcccgagcagattgttccccgagctttcgaggagtcatttcgcagcaccacctccttttctaagtcatccatcatggatcggtccatggatttcagtagttcccgtgatttcagcagtgctcgcttttcagacattgctggaggcaccataaatggtgatgaagaggggcaaaataaggagaggccactagtgcttcgcaacaaggcccctaggtggcatgagcagctccaatgctggtgccttaatttccgtgggcgtgtaaccattgcgtcggtaaagaatttccagttgattgctgcaccagcacagcctcccgcaggggctccaactccgtcacaacctgctccaccagagcaggacaagattattctacagtttggtaaggtagcaaaagatatgttcacaatggattaccgctatccgctctcagctttccaggcatttgcaatatgtttaagtagcttcgacacaaaactggcctgcgaatgagggaaacagtgagctctaatggaggcagaactggaaatgcaacagagagcaacttgagaaatgtaatgcccaagggctctagatcatgtttgcattttgttgtgtcgtcttggctgtatttctgcttgtagcctggaactggatttctcagcctgtatgtttcacctggtagcaccatgataggtttcctttgggacagcggttcatgcattgcatttttccatttgtgtggtgtacatgcggttccggatttaagctgaaaggatccgttcatgtctttgttaagctttgcatggatgccgtgttctggtaaagaaaagggaaagattcagtgcttcactt

SEQ ID NO: 6385 - DNA, 2102 bp, Oryza sativa
  Predicted polypeptide sequence is orthologous to G2592, G2713
ttttactcaagtctacgtgatgtgcagcctggcccaagagacggcactcttaaatgtttcataagaagaaaccggactactcagacatattatctgtatattgggctcacagaagcacttgccgatgatgggaagttcctacttgctgcacgcaaatgcaggaagcccacatgcacagactacctgatttcccttgacatgagtgatatgtcaaaggggagcaacacctatattggcaagctaaggtcaaactttctcggaacaaagtttaccgtctatgatgcccatccaccatatgatggagctgttgtctcaaaaagtcggtctgcacgtgtggttggtctgaaccaagtctccccgagagttcctgccgggaattacccagtttcacatatttcctacgaattgaatgttttgggtgcaagaggtccaagaaggatgaactgcattatggattccatccccacatcagctgttcaagagggtgggaaagctccgacacagactgaatttcctctcagtggcctcgactctttcccatcaatttcattcttcagatcaaaatcagctcgaatagatagtgcaacttcacaattatccactcagaaggaagaaaagctggttctgaagaataaatctcctaggtggcatgagcaactgcaatgttggtgcctcaacttccgtggacgggttactgttgcctcagtgaaaaactttcagctggtggcgtctgatgaaaatgggccaactaaccaggagcaggacaaggtgattctccagtttggaaagattgggaaggacttgttcaccatggactaccgttatccgatatcagcatttcaatcatttgcaatctgtctgagcagttttgataccaaaatagcctgtgaatgagataaggtgatcatttctctctattcagctttactactatcgacatttacacatggttacttaccctgcttgatataatgacacttaatacttgcttttatctagatggtcttcagtttacctaattgtttcttcaacagtattatgaaagctgactcacattttcagaaccttccaaacttcagacactagatagtcagattaggagtactagtagagcagtagttgatccaaaatctgagctggctgttaggcatatctgaattcatcggtctgcccatatgcaaatcgagcttttctgttgggatgtcacatcagaagagaatagatggcaacacatgtatgcaatttgcaccagatgatagctgccctctgtgttttacccttagctccgtaatcactactgattcagcctgttctgtaaactacagttgcatacttgcttgggtacggtttatgtgccatgaaacgtgacacgaagcaaagaaaaataattttagagtagggattttatgtttctactcttagcggtttaaatagaaaacaataagaaaaccacgtagaccaatctgaaattaagtttcaaaaattcaaatttagccttggtttataggctgacgagttgccaatggaactcgcaaaaatacctcttaagctgcagttgcgcagttgttttccatcactgtccaggcatagctgcattcatgcagctaaatcacaatcagatgaaccgcatcctaatcaagatttttggccgcgaatgcaatgtacctgcaggtgctggatgaaggacgaaccgtggaagcatgataagctggatcggcaggcgtagcgtgcacgagtcacgcttgacattgaagcacaaggatttgtttggatttgggcagaaaaaaaaacaccaagtccatctcctgaagttgctgccccggatgctgctgctgcagtgtacataatagccacctgtgatctttctggcctcctggcttgtaattctgttctagtttgttttttttttctaattgttacacattcttgggcggtgccggctgttgaaacctagagagtttcttcttctttttaatctcccccaatttacattgtaaacggcaggcttgtgtagccaaaaatgccaagttgtgtgttgcaagttgcaacttgatgtgttctttaaattagtgtaatacatggagtaataggctgcagtgctg

SEQ ID NO: 6386 - DNA, 1941 bp, Oryza sativa
  Predicted polypeptide sequence is orthologous to G2592, G2713
gaccaccacttgttctttccttcccctcctcttcctcctcctcctccgatccccatgcctcctccgcctccgcctccctcccccgccggccaccgctagctgccgccggcgccacccccgagcggttgcgcctagggttcttgattttgagcttcggagcgaggcgaggcggagatgtcgttccgcagcattgtccgcgacgtgcgcgacgggttcgggagcctgtccaggcgagggttcgaggtgaggctggtggggcaccggagggggaggtctcacagcgcggtgcacgagctgcgtgacggccacgcggccgccgccgccgccaacgtggtccagagcagctgctgggctaacctgccgccggagttgctccgggacgtgatcgagcggctggaggccagcgaggcggcgtggccgtccaggaagaacgtcgtcgcgtgcgccgccgtatgccggacatggagggacatgtgtagagagatcgtcaagaaccccgagttttgcgggaagatcacttttcctgtttccctcaagcagcctgggccccggaatggagccatccagtgcttcattaaaagggataaatctacccaaacttacaacctatatctatgtcttagctcagctgtgctcgttgaaagtggcaagttccttttatcggcgaaaagatactcccgtgcaacctgtacagaatatacaatatttatgagtgctgacaatacatctaggtcaagcaacatgtacattggaaaattgaggtcaaatcttctcggaacaaagtttgtaatatatgatacccaacctccatgcaacacagccaatgtttcacagtcagggaaaacaagccgtaggttctactccaggaaggtgtcgccaaagaacccttccagcacctacagcatagctcaagtttcatatgaactgaatgtcttggggactcggggtcctaggcggatgaactgtgtgatgcactcaatccctgcctcatcgcttgaggctggtggcactgtcccatgccagccagacagtgtgcttgcacgctctcttgatgagtcatttggcagcatctccttttccaagtcatccattatggaccgctctatccgtttcagcagtagcagatattctgacatctcagtaggtggccccatggtcggaggccaggcattgggtgacagtgatgagtccaaggagaggccattgattctccgtaacaaggccccaagatggcacgagcagttgcagtgctggtgcctcaacttcaagggcagggtaaccgtcgcgtctgtgaagaacttccagcttgttgctgcaacacagcctgctgctggagccccgacgccatcgcaacctgccccgccgcctccacctgatcatgacaaggtcatactacaatttggtaaggttgcgaaggatatgttcacaatggactatcgttaccccctttcggccttccaggcctttgcaatctgcttgagtagtttcgacaccaagctggcctgcgaatgaaatcatcggtgcgaaagcatggttatcgattattgtaacaaattgggccccctccaaatttagctgggggctctatcctgttgtttgctatttatgccctattaacttgtagtcattagaaaaccaatgttttttttctagacatgttccctgatttgtagatgctgttgtgttgtatctgtatccctacattctccttttcttttgttttttttaacaggttgctctgtagaagcatatttgctctgcctgtaactgtaataattagctgactgaattgttatgttcatgcttggcttgtgcctagagtttcaaatcttgagttgtatcaaaatttcgtaatggctgcctgttgtgggagatgtgcaatgtatttttgatgaactttgttgagttgcaataaagcaacaatcagttccatgtgcttcc

SEQ ID NO: 6387 - DNA, 1994 bp, Oryza sativa
  Predicted polypeptide sequence is orthologous to G2592, G2713
gccacccgccttccctttcctctcttctcctctactcctcgccttcttcttcttcttcttcttcttcttcttcctcttgctgttcttcgctcgcgcccgcccaccactgcaactcctcgtctccccctccgccgcgttgccgggtggagttgccttgcccgagaggagcgggcacttcgggtttgtgagagtgagagctctgtgcagcggacaggtttgaggcggcggcggcggggctcccactcggccgaatggactgctagtagcggttgcttctatgtgtacagtatctaaccttctaaccattttcaaaggaggtcatattttgtagggcatcgtatgccttattatctggcattggctggtttagatgtcgtttcgtagcatagttcgcgatgtccgggatggttttggaagcttgtcaagaaggagctttgaggtgacccttgcaagtctttatggacttactgggcatcacaaagggaagactcagagctcattggatgagctcgatgactcacctgctataatcccagagagccgctgggcaagtcttccgcccgaactcctccgtgaggtcatacggagactggaggctgatgagagtacatggccatcccgaaggaatgtcgtctgctttgcagctgtttgtaggacatggagggaaatgtgtaaagagactgtgttgagcccagagttttgtgggaaacttacctttccggtctctataaagcagcctggtcctcgagatggtatgattcaatgttatataaagaggaatagatcaaaatccacctaccatctctatctgtgccttagcaacgttgttactgcggaaggtgggaaattcgtcttagccgctaaaagacaccgtaaaacaacttgcacagagtacactatttcaatggtttctggcaacatctcaaggtcgagcagaactaatattggaaaattgaggtcaaatttccttggcacaaaatttataatttatgacacacagcccccttacaatggggctgtagtccctcacgtcggaaggaccagcaagagatttaactcaacgaaagtttctccgaaggttccttctgttacttataacatagctcaggtgagctatgaactaaatgtccttggcacaagaggtcctagacggatgcgttgcatgatgcactccatacctgcctcctcggtggagcctggtggcatagtccctggccagcctgagcaaattgtacctcgagctctggaggactcatttcgcagcaccacctccttctctcaatcattccggagcaccacctccttctctaagtccatcatggacccatccatggatttcagtagtgctcgcttctctgacatcagtggttctataatgggtggtgatgacaatggtgaaatcaaggagaggcccttagtgctccgtaacaagcccacgagatggcatgagcagctacagtgctggtgcctgaacttccgtggccgtgtcaccattgcctcagtgaagaatttccagctggttgctgcaccaagccctcctcctgctggtgctccaactccttcgcaacctggtccagccgaccccgaaaaggttattctgcagtttggaaaagttgcaagggatatgttcacaatggactaccgctatcctctctctgccttccaggctttcgctatttgtttgagcagtttcgacacgaaattggcatgtgaataattgttggaagaaggaaaaactgaagaagggcaagaaaagagttcagatgtctggggataggttactagttgatgtttgcatttttttttcttgttttctcggttgtaattgtgcttgttgtagccttgaactagacgtatatgcaggaaagcatgcttttatgtgccctcatgcatgatagaggtaaggagccacatatcatccactgatccatactccatactgtgatgatgtatctgctgtgccattgccaacacaactgtgaaaggttccctcc

SEQ ID NO: 6388 - DNA, 3316 bp, Oryza sativa
  Predicted polypeptide sequence is orthologous to G2592, G2713
gaaatctttagcctgagagagagggagagtgagagaagaagaagggagggtgattgctctgatctggagctggttggggggaaaggagttgggagaatctcatgggagctgtgatgaaatgggggaggagaagctccttgatccgttcttgagccgggaaatttgatctttttaagctgcggggttggggggaaatttggatcttgaggctacccgagcgcgaagcctggtttcttccggtgctccgttgctgcattgccttgttgcccccagatccgagctgccgtgcgagggaaactcggatctttgcttgcgctctccccaaatctgcccaaaatttgggctctggagcaagctgtgttcgtggtagccccccgtgcttcaaatccttttcagaaagttcatttgtttagttgggggttagatatggcagtgatgcggactactttatgaggtgtctcctgccatttttttttagagtagattcgtcagtaatggcggatcttgccatggagtagtagtagtagtagtagtagtagtagtagcagggggttccttcggtgatagcgaagggtgcttagccattaagcggcggcgatgtctctgaagagcattgtgcgggagctgagggagatgagggacggcatcggcagcatgtcgaggcgagccgctgacgggcgcgccggcggcgggcgcggcggctcgcggcattcttggccggtcctgtggtcggagcagcagcagccgccgcagcagcagcagctgcagcgtcaggagcatcagcagcagcaggggcggtgggcgaacctgccgccggagctgctgctggacgtgatccagagggtggaggccagcgaggcgacgtggccggcgcggcggcaggtggtggcgtgcgccgccgtctgccgctcgtggcgcgaggtcaccaaggaggtggtgaagacgctcgaggagtgcggcaggatcaccttccccatctccctcaagcagccggggcctcgtgagcatccagtgcagtgctttgtgaggagggacagggcgacttccacctatctcctctacctggggctcagcccatgtaagttaaatttacatctctgtttttggttgttgacaaaatatatggcttacaaatcttgttctactaccaatttataagagtatcatgtaccatcagtccatcagtattcagtactagtccagttcatctgcatcaagatgtgttgtttctgccatttgcaacagtgaaaaaccagaataagctgtttgaatgagttactaccattgttaattcggtttaccgaaatctgtgtcaggtaatgaattgtgttccttaaggctaaggttaggggaatgcaatctgctatgggtgtttcatatgcatagcaaattttcattatttacacgagcagatgttttctagtgcctgcatgtatatgaagattttgtttgtcctgcctgtctttgagcgctacattatgcaaaaattcaaccgcggaggagtactcagtgacaagaaaagataatgttcgccttttccgatcacatcagctgaactggttgctcctccagatcgagaaggaaaccaactgtgactaataaacatagagcctgtaaaggttgtttcaacgcacttggctacctcattaacacaagtctttgtagcgtagcaaatgtacaagatcctaagctgaacctaaccgttgaacgtgcggtgctttactattttccggaataggttagacaatatgtgcaggcaatccatgatatgcatgccattctgcagattcctattcactctagatgcataaatatctacttctaacccccctatctaccaggctgtgggtgcagtccacaacaaacttggtacgtatgctgtttagtacttcctctgtcccaaaatataagaacctaggatcgtgtccagattcgtagtactaggaaatgtctcatccgattcgaagttcttatattttgggacggagggagtaggatgtattataagggctaaatagctcatctcctgttttgaaaatttgaatagagctaatatggaactcagaatacggacaattaatgttgactacatcactaactattattctatttatgaatgcagctctacatggagaaaacgacaagcttttgcttgcagcacgcaagattaggcgtgcgaccaggacttcttttgtgatctcactggtctccaatgacttctctctatccagtagcacctatgttggtaaactgaagtaagcactttataatgttgactttaagtaatttggttattctcttacttctagaaagctcactcaaatttattcccctgtatcagaccaaacttccttggcacaaagtttacaatctttgacagccagcctccttgcgatgctgtagtgttgccaaacaaccgaccaagcaaacgacatttcaagcaagtatcaccgcgattgccactaggcaattacaatgttgctacggtctcatatgagctcactgtcctacgtaatcgaggaccaaggagaatgcaatgcaccatgcactctataccggcattgtgtattcaggaaggtgggaaggccccaacccctgccggcatcatccactcacttgacgaacaagttcccgccttatcaactagcaaaggaaaggaaccagccatagaattttcatcgacaagcctcagcgctgatttgtctggaccggtctgtacaaatgaagtgcctcttgttctgaagaacaaagctccccgctggcatgagcagctgcagtgctggtgcctcaacttccgagggcgtgttacagtagcatcagtcaagaacttccagctcgttgcctcagttgatccttcccttggtatccctgcggcagagcaggagaaggtcatcctccaatttgggaaaatcggaaaggatatattcacaatggattataggtacccgctctcggcgttccaggcatttgcgatctgcctgactagctttgacaccaaaccggcgtgcgaataactgaagaaaggtatcaaacctgtgtcttctctctatttagctcaggcagcgtctgattccgttggatgctgtaaaattctcggtcttgctatgccaaaatgagcctactcctgggggagacagtagctttgtcagatcaagatgaacaatggcatctatatcttggcaactggcaaaaccccaggaaagatttgagtgacaatgctgtaaccaacaaactgctattgtactattgttcttggaatgtttagcggtgaaatatcactgcgctatggataatatggacgctgttcatcgtgccc

SEQ ID NO: 6389 - DNA, 1826 bp, Oryza sativa
  Predicted polypeptide sequence is orthologous to G2592, G2713
cttgcataaaagaaaatcccccgtctcgtctcctccgctccttgtgcctgcgcccatcgactccatctggcgactcgcgagagcagagcaggggagggggaggggaagggcgccgtcgtcctgttgttcactcctgacctgcatcacatctggagatgtctttccgcagcatagttcgtgatttcagggacagtttcgggactctatccaagcggagtttcgaggtgaaaatttcaggcttttcgggccgtcacagagggaaatccattggaccatcaagcgagctggatgacacgcccgtggtagctcagcaaagcaagtgggctggtcttcctcctgaattacttcgcgacgtgatgaaaaggctggaggaagatgatagcaattggccctcccgcaaggatgatgttgcctgcgcttcagtttgtacgacttggagagacatgtgcaaagatattgtcaggaaccctgaattttgtggaaagcttacatttccagtgtctcttaagcagcctggacctcgagatggagtaatccaatgtttcataaaaagggacaaatcaaaactaacttatcatctctacctgtgccttagctctgctgtgcttgatgagactggaaagttcctactatcagctaaaaggagccggcgaacgacacacactgactacatcatttctatggactccaaaaatatctcccgatcaagtagtggctatattgggaagttgaggtcaaatttcctcggcaccaaattcatcatctatgacacgcagcctccatacaatgctcggacactttgctcacaagaacggacgagccgtcggttctcctctaggaaagtttccccaaaagttccaacgggttgttatcccatcgtgcaggtgaattatgagctaaatgtgcttggaacccggggaccaagacggatgcaatgcgctatgcattccatcccagcatcagcagtagagcctggtggcattgtgcctggccaacctaaagagctcctcccaaggttatttgaggagtccttccgcagtatggcaacttccttctccaagtactccatcacagatcattcgacagacttcagtagttctcgcttctctgagtttgggggaggggctctgcaagggcaagagcaagagcaagatggcgatgatgtgaacaaggagaggcctttggttctccggaacaaagcaccaaggtggcatgaacagctgcaatgctggtgcctcaacttccgtggccgtgtgacggtggcttcagtgaagaacttccagctgatagctgctgcacctcagccatcttctggagccgcctctgaaccttcacaggcagggcaggctgcacaacagcaaacccaaccttctcagccatcgagttcgtcgtcgtcgtcatcatccaaccatgatacggtgatcctgcaattcggcaaagttgcaaaggacatgttcaccatggattaccggtacccattgtcggccttccaggcttttgctatctgtttgaccagctttgacaccaagctggcatgtgaataaatgagtagaatagcgatcagaaagcactccagtgtacctgaggacctaagccactccaggcgtatggtattttaggataggagaattctgtgtctagtcacttgtgtgtattcatgtgcagttctttggttgaatccttgtgttcctccggcgtgcgtgtttgttagaagtgtaaaaaggggattgaagtgtagatgtctgtaagatagaacaagatcttgtttcttgtatgttgggcttaaaaagttttgagcaagagaatgaatgaatggttgagggagc

SEQ ID NO: 6390 - DNA, 2073 bp, Oryza sativa
  Predicted polypeptide sequence is orthologous to G2592, G2713
ggtctcctctcacaccacacgcctcgcatcgcatccccacctccgccgatcccgccgtctccggccatctccgccgccggcagccaccaccacctcctcctcttcccctctcccccttccgcccaattggttgccccgaccaaaccctacacgcggaagggctcgctcgctcgatccggtgcgggcagcgcgcgcgcggggctcgacgcgggcggcgacggggggcgggctcgatccggcggagcagtgggcgctctcttccacgatgcgtctaccctcttcgcgcgagcacgacaaggttctttttgcggggtcaacaataatgaggagaatttgagttggtctggaattactctgggatgttatcattggcgaaaagtatagatcccttttggtagctgaggagagatctcaattttttcagagagtagatgtcgtttcgcagcatcgtgcgcgatgtgagggatggatttgggagcctatcgaggaggggatttgaggtcaggattctggggcatcgcagggggaagtctcatggtgctgtccatgagttgcatgacccggtgcctgtaatccagagcagctgctgggctagcttgcctccggaattgcttcgtgatatcattgagaggttggaagaaagtgaggctacatggccttctaggaagcatgtggttgcttgtgcgggtgtctgcagaacatggagggagatgtgtaaagagatcgtcaagaatccagagttgtgtgggaagatcaccttccctatttctctgagcctgggccacgagatggaactatgcagtgtttcattaggagggataagtctacgcagacctactatttgtacctctctcttggctctgctgtgcttgttgacaatggcaaattccttctatcagcaaaaagaaactggcatgcaacatgtacagaatatgtgatatctatgaatgctaacaatttatctaggtctaccaacacaaacattggaaaattgaggtcaaacttccttggcacaaagtttgtaatatatgatacccacactccgtacaatgcaactagtgattcacagtcagggaaaacaagccgaagattctccaacaagggaacagcaaagcatccctgcagcacatatagcatagcaaacatctcatatgagctaaacgtctttggaactcggggtcctaggcggatgtgctgtttaatgcactccatccctgcctcatctcttgaggctggtgggactgttcctagccagccggatagcatccttgcccattccctcaatgaatcctcctttaggagtgtctccttttcgaaatcgtccgttatggaccattccatgcatttcagcagtgctcagttctctgacatctcaattggagatggcccaaggattgggggccgggtattgagcgatgatgaggagtgcaaggagacacctttgattctccaaaacaaggctccaagatggcatgagcagctacagtgctggtgcttaaacttccggggccgggtaactgttgcttctgtcaagaacttccagctcatcgcagccacgcagcctgctgcgggagccccaactccatcacagcctgttccaccacccccaccagagcatgataaggtcatactgcaattcgggaaggttgccaaggacatgttcaccatggattaccactacccgctctcagccttccaggcatttgctatctccctgagtagtttcgacaccaagctggcctgcgaatagaacttccaggcaggccagaaacatcatggatgcttcttatttgacgccctgagggcatgcccctggatggagctgaccatccccaagtttagcctgggacgccgttctgttgtatgttactgatgatgtgttaactcagaaacacccaagcaacaaaaggcaaattgttattttagcatttagcttatttattctgattttgctttgtaattgaatgttatctttatttctttttgacccatagctctctctataacaggtattctgtatgtgcatcggataattttcgcagaattcatttgactgttctccagtgatttatt

SEQ ID NO: 6391 - DNA, 3119 bp, Oryza sativa
  Predicted polypeptide sequence is orthologous to G2592, G2713
ggctgtttctctttcaactgcttcacactgttgctctcttccctctctgcacctgcaaccaccaccacaaccatataccagtaccatcgaggaggttgccttctcttccggtcggaagcttgctttccttttcttcttcttcttttcagatccaaggttaatttcagccgacacacacaggaattgaacctgtgctcttcccaggtttctgtctgtctgcaaagttggccgctttctgcagattcatttcctttgccacgttttctgctgcaaaagttggatctttgcaagggggactggctgatttcatttgaggtttctgaataagttggggagcttgatttggagagggttacttttttgggggtgatgtttcgatttgcaaatcagaacaagattacttaagtgctgctaagctcaattggaagtggaagatcttggtcacgcggcatcaggtgaaagtttggtcgctgtgcatttttcacaagggatgtctttccgcagcatagtccgtgatgttagggacagcttcgggagcttatcaagacggagtttcgaggtgagaatttcaggcctccctggtctttctggccatcacagagggaagtcccttggatctttgagcgagctgcgtgacagacctgtagtagtagatcaaagcagatgggttggtcttcctcctgaattactccgtgatgtgatgaaaagactggaggaaggagagagcaattggccgtcccgcaaagatgttgttgcctgtgcagcagtctgccgaacatggagagagatatgtaaggatatagtgcaaagcccggaaatctgtggaaagctcacttttcctgtgtctctaaaacagcctgggcctcgagatggtttaatccagtgttttatcaaaagggacaaatcaaaattaacttattatctctacctgtgtcttagccctgctgtgctcagcgagaatggaaaattccttcttgcagctaagaggaatcgtcgggcaacttctacggaatacataatttctgtggattctaaaaacatctcacggtcaagtaatggttatgttggaaaaatgaggtcaaattttcttggcaccaaattcgttgtctacgatacacagcccccgtacaatgctgggagcctcatgtcatgtcagcatggcagccggcgaatctcttctaggagggtttccccaaagttacccaccggtagctacccaattgctcatgtgaaatatgagttgaacgttcttggcactagggggccgaggcgtatgcaatgcaccatgcattcgatcccagcctcagcagttgatcctgaaggtgtggtgcctggtcagccagagcagcttctcccaggtccattcgaggagtcgtttcgcagcacaaacacctcctccaggttctctttcatggacagatctctggacttcagcagctcccgcttctcggaaatcagtggatcagcgaaccaacagggcgaggatgatatacctgaggctaaggagaggcctttggttctacgaaacaaagtgccaagatggcatgagcagctgcaatgttggtgcctcaacttccgtggccgggtaactgtggcttctgtcaagaatttccagctgatagctgctgcgtcctctgaatcttcacagttggagcagcagcagcagcagcagcagcaaaaccatgcttcgagttcttcttcggcatccgatcatggcaagatgatcctgcagtttggtaaggttggcaaggacatgttcaccatggactaccggtaccctctctcagcattccaggctttcgccatctgtttgaccagcttcgacaccaagctggcttgtgaataacatacatcagtactataagtgtgtttgtatagcgtgtcagtgtgtgtggatagtataaacatcagtcagtctcgttgtgtgcagatgcaggtgcagtttgttgttgctgttgatttagttgtctgttcttcttgtgtggcagatgtgaacaaagaatggcaacacatctcaagtgcagttgtttgctgctactacatttatatcatgtaagtatttggaggttggaagtggaacaaccccaggctcctctagtttctcgagagggtatgcatcttacttgcgaatgtgatttatctactcggtctatatatcttggtatcctttaggatcatagctgctatatgagagaagctacactgctacagcctgcatatgtgcttgaaggagccacttggaaaggaggcaatatcagttgatcgattcataggcatgcagattatgtacaattaacacttaacagtaatgaagcaccattcctgcaatcttggaaacaaatcctagatgaaaaaaaaaagaaaccttcataaactgcttaacgggagatcgttacaggaagaaccctatgatatgactgactaatcaacagcccactcaaaatcccaggaagagatggcaacactcaacatacgtcaaatgacatccggattccatttgtacacctgatgaataacaagttgttggttgtcagcaatccatgaaaacaacttcacttttcacagccacattcatgtatttgtcaacaaagtacatcaggatgttgtttcttctcaggagatgaagggagtgcagcattgccagttggcaagatctccagatctctaacctcactagaactctcaatcttagttcttgtaattgggatctcattgtctaaaccaggtgagcagtcagctctgcgatatttcacgccattgctttcaactcccaactcttcgtcacccagttcatctgaccgacgttgtgaggtcttaaggatgtcgaggcccatctcaagatcatcctcgactttggctcgtggacggtggggtgtctcctcttctgctacattggaacggctgattcgtggtggtgctaccccatggtcctcttgaacaattgctctcaggttgatccttgaaggcgctcttttggtgcagaagaattcagaacagttgttcatgcaaccacggtcaaacacgttggattggttgttgtatttgtacttgaggttctcatatgttgccttcaaaaaaggaagtggaaattcaattcagatcacagttttcaatttttc

SEQ ID NO: 6392 - DNA, 1949 bp, Oryza sativa
  Predicted polypeptide sequence is orthologous to G2592, G2713
gacgacgaaaaggccacagctttcaatataaacaaacaccaaacgaatcccttcttagcggtagtgcatccccatccatccattctcgcacaagattccatcttttcatccaccaatctcgcgaaatctccgtctaattcaagaaaagatgagctgaggaatgagaggaaatattggtgttgcgaattgtggattgggaatttggagtttggattaggaggaggaggaggaggagaagattaggcgatgtctttcaggagcgtgatccaggaggtgaagggcgagatcggcgccatctcgcggcgggggttcaggtcgcggccggggcgagtccggcgagtggcggcggcggcggaggagccgccggacgagtcgtcggcggcggcgctggtgatgcgggagagctgctggacgcagctgccgccggagctcctgcgggaggtgctggcgagggtggaggagtcggaggggtggtggccgcgccgccgcgacgtggtggcgtgcgccggcgtctgccggagctggagggggatcgtcagggagatcgtgcgcaccccggaggcgtccgggaacctcaccttcccaatctctctcaagcagcctggcccgagggatgctcctatgaaatgtttcattgtaaggaaccggaccactcagacatattacctgtacattggactgactgatgcattaactgatgatgggaagttcctacttgctgcacgcaaatgtcgtaggaccacatgcactgagtacctgatttcgcttgatatgaacgatatatcaaagaggactgatagttatgttggcaaactaagatctaacttcttgggaaccaaatttactatctatgatgcccatccaccttatgctggagatgtgatttcaaagggtcagtctgcacgtgtgattggttcaaaccatttatcccccaggatacctgctgggaattatccagtctcacatatttcatatgaattgaacgttttgggttctaggggcccgagaaggatgcactgcgctatggattctatccctgtatcagcaattgaacaaggaggaacagctccgacgcagactgaatttcctttgagttaccatgaatctttcacatcaattccctttttcaaatcaaaatcagttcgagcgaataattcaactgcttcattactcactcaaaatggaagcaaactggtgttgaagaacaagtccccgaggtggcacgaacatctgcagtgctggtgccttaacttccatggacgggtaacggttgcatcggtaaagaacttccagctggtggcttcagatgagagtaacccaaccaaccaggaacacgatgatgtgatcctccagtttggtaaagttgggaaggacatgttcaccatggattaccgctatcctatctcggcatttcaggcgtttgcgatatgtctgagcagctttgacaccaaaatagcgtgcgaatgagtgaaggtgtgattctttcttccatgatcgaatgaaccgtttcctgatgacccacattgcaagctggccatgcactctgcttagttgcttccaccttttggaagcatgcagaatagagacataaataaaagttgctttaaatctaacattttagttgggtagggatatgtaacctgcaatttagctttcttgaagtatgttcaacctgcaacatttgagtgacttgtaagtcttgagtttaactacaggtgttggataaccacaattgacagctcaggattatgtgtatacttgtccctttggaaatccatagatgtatctgtttgcatagatatgcttatgttacattcttctattaccagaatgaagcagagctattggatcttgtttcaaaaaaaaacatgaaatgtacatgagacccttttttttcacatcgaataatgttctggctcaattgttcatggaaaaaaatgttaccatgt

SEQ ID NO: 6393 - DNA, 401 bp, Oryza sativa
  Predicted polypeptide sequence is orthologous to G2592, G2713
gaaaccaacgaaaccatccgaatcgatgatcgaacgattcaaagcaggagatacgactggtctccattgttgtgtaaataaggctcctacttggaacgaagctaccaattctttcgttctaaactttaataatcgagtgaaacaagcttctgtaaagaacttccaaatcgtcgaagagaatcatcctgaagacgtatggatgcaattcggaagaatcagtgaaggacaattcgcattagattacagatatcctctttcactcttgcaagcatttgctatcgcaatgactggattcgataataaattagcttgtgattaaaacatgatctccaaagaaaaacaaacgaaattgtaaagaagaaaaaagggttttcatcaaaataaaaagccgtttaattctc

SEQ ID NO: 6394 - DNA, 581 bp, Oryza sativa
  misc_feature (27)..(27): n is a, c, g, or t
  misc_feature (43)..(43): n is a, c, g, or t
  misc_feature (53)..(53): n is a, c, g, or t
  misc_feature (59)..(59): n is a, c, g, or t
  misc_feature (62)..(62): n is a, c, g, or t
  misc_feature (68)..(70): n is a, c, g, or t
  misc_feature (77)..(77): n is a, c, g, or t
  misc_feature (84)..(84): n is a, c, g, or t
  misc_feature (86)..(86): n is a, c, g, or t
  misc_feature (92)..(92): n is a, c, g, or t
  misc_feature (99)..(99): n is a, c, g, or t
  misc_feature (102)..(102): n is a, c, g, or t
  misc_feature (115)..(115): n is a, c, g, or t
  misc_feature (122)..(123): n is a, c, g, or t
  misc_feature (221)..(221): n is a, c, g, or t
  misc_feature (311)..(311): n is a, c, g, or t
  misc_feature (340)..(340): n is a, c, g, or t
  misc_feature (365)..(365): n is a, c, g, or t
  misc_feature (373)..(373): n is a, c, g, or t
  misc_feature (421)..(421): n is a, c, g, or t
  misc_feature (436)..(436): n is a, c, g, or t
  misc_feature (438)..(438): n is a, c, g, or t
  misc_feature (440)..(440): n is a, c, g, or t
  misc_feature (443)..(443): n is a, c, g, or t
  misc_feature (460)..(460): n is a, c, g, or t
  misc_feature (471)..(471): n is a, c, g, or t
  misc_feature (497)..(497): n is a, c, g, or t
  misc_feature (513)..(513): n is a, c, g, or t
  misc_feature (515)..(515): n is a, c, g, or t
  misc_feature (522)..(522): n is a, c, g, or t
  misc_feature (528)..(528): n is a, c, g, or t
  misc_feature (530)..(530): n is a, c, g, or t
  misc_feature (532)..(532): n is a, c, g, or t
  misc_feature (534)..(534): n is a, c, g, or t
  misc_feature (539)..(539): n is a, c, g, or t
  misc_feature (548)..(548): n is a, c, g, or t
  Predicted polypeptide sequence is orthologous to G2604
tttaaggtttttggcggggaaaggganagaccaacaacctccncccccggaanagtttnttnttaacnnncccgggngggcggnanaaaaanttggttngtntacaatggttctngctgtcnnctggctatggaagcaaatcaagttgcgcatgttaaactgcgggaactgccgtatgctgctcatgttccaatatggcgcaaggtctgtcaaatgcgcantctgcaattttgtgacatcagttgggggctcacctggtatagaccagaaagcccagcagctgaaactgctgaagtgccataaatattcanaaaagaacttctcaaaccgatgctttganttgcacatgtttagaattcttcccngaaacatnttttttctcccttttttatctccctttccccccaatttccaccttccntccttggatatgganananccngcgggaataaatgaaanttttgctaaanacctatgctcaaaattcgtccaatcntctgtttgaccgaacnanattgacnattatntncntnaaccnatgataatntttatgcattaaaaaaaaaaaaaaaaaaaaaaa

SEQ ID NO: 6395 - DNA, 832 bp, Oryza sativa
  Predicted polypeptide sequence is orthologous to G2604
gtgatttcagttgcctgactgttgctggaatctgtgaagcatctacaagcgatgccatcggttcaggcagctggcacagcaatgccggttccccttgccccatatccaactcctgtgccatttacacctcccaatggtatggattccaacttggcactgcaagaacacagctacattttgagttttttttccctgatgttggttggtcacctagaaatgttggtacatgccatagtgttcgccctgatgcattcttttggactagaaatcttatgaactgaatttcaatagacagctttttcttgaatcagatgttactgttcctggttcagaggttgcagtttattctgctcatagaaatcctgaaagtttagagagaactccttgttgagaaaatggaagtttttttactgctgagtttcgttgtctgaaatgaaaatgatgcatggaagatgcttttgttgtctgaaaatgaaaatgttagctgctgaaatgcgacattcagtcagtctctgaatttcaggggcccaaagccagctcgtttgctctgggtgccgtaatctgctcatgtatccagccggagcaacgtcgatttgctgcgcagtctgcagtaccgtgaccgtggtgcctgcccccgaaatctagctgcaatgttcacgaaaataaagagagattaaaggggaatacaaatggcttcagggctccgcaacagtgcgcgtgtcgcgttgatggtgtgcctgcactcaggtcgctcgagaagaagtacacactgaagttgctctggtcatatttacattattgtgtgtaactcttccttgtttgcttttcagtc

SEQ ID NO: 6396 - DNA, 1713 bp, Oryza sativa
  Predicted polypeptide sequence is orthologous to G2604
ggaacagatggcggtgctgtacgtcaccttcttgaggttgattgactaaaaaccttgaaaatactccctccgtttcacaatataagtcattctagcatttcccatattcatattgatgttaatgaatctatacatatatatatatctagattcattaacatcaatatgaatatgaaaaatgctagaatgacttacattatgaaacggaggaagtagttggcaagggaggtggatgtggggaggggttgagttgctctatgtgctcactggttgaagctgattgttgcgctcctatctacctcacttatttaccaggaggtgttaagctcattcggtgagaattttacctactcctttcactgcattttccttgaccacacttagattaaaattatagcttccttcctggtagtagcaaattgtggcaccaatgtggcacatatttattggttatctaaattattttcttatattgtgtcttgactctatttggtgttgtaaggcaggttagtggctgattaattagctgcattatgctaccccgttattactagcttaaataagttgatctgttcttgatgcaatttatacatctatgagctggtcacttcatcagctttactcaggtaggggtctttcctacatgagtggctattctctccaaactaataaaaattcatgtgagttttgttggtattttagcacaaaaaaaagtactcaaatagctgtttgcctggatgctatacccaccaatgaattttcaattatgggatggttcttattttttttgtacatgtaaacagaacctgaacatcagatttgatgagagattcaaccaagaagctaaaattttttgcgactgatgtgcattgctgaaccagttttctgttgcataaagagtcctgaaacttcttgttgcaaactgaagtggtgttctaaccagttttcttcttgctttctcattagcttctcttgaatctttctgtaggtttctttcctgtagggaaaggaaaggtgatttcagttgcctgactgttgctggaatctgtgaagcatctacaagcgatgccatcggttcaggcagctggcacagcaatgccggttccccttgccccatatccaactcctgtgccatttacacctcccaatggggcccaaagccagctcgtttgctctgggtgccgtaatctgctcatgtatccagccggagcaacgtcgatttgctgcgcagtctgcagtaccgtgaccgtggtgcctgcccccgaaatctagctgcaatgttcacgaaaataaagagagattaaaggggaatacaaatggcttcagggctccgcaacagtgcgcgtcgcgttgatggtgtgcctgcactcaggtcgctcgagaagaagtacacactgaagttgctctggtcatatttacattattgtgtgtaactcttccttgtttgcttttcagtctaggatagagatttacatgtcaaagagtcaagtgcacttttgaaagtgtaatgcgatgcaagtaaaaacaattttggacaagatcaaaaggatccatgtcatttgctgtcagaatagtaatgtttgttacttaatgaggtttgttacaaaccttaattacaggaatatcattgtagtagttcttaactttttacactcctatttgtagatgtacatatatttatgtacaattatcagatggactattttatacact

SEQ ID NO: 6397 - DNA, 1555 bp, Oryza sativa
  Predicted polypeptide sequence is orthologous to G2604
ttgcgccgtcccggttgccgaccgccgccgctgccgcctccgcctccccctcgcgccgccaccgccgccgccgctgagcgccatcgccgtcccccatcgcgctgccacctccgcctcccgccgtccccattgccgaccgcctccgcctccgcctccgccaaccctagccgccgctgccagtcccctcctcccttcggtgaggcgagcagccatctccgccttggccaccgccgtcgctgagcgctgccgcttccgcctccgcctcacgccgccgctaccaacagccgcctccggccgccggcgtccggatctgggctccatgtggccgcaggcgtacagatccgccctccgttgccgctgccatcaaagaaacgacggtggtgacgaagccggcatcaatgaaggcggtggctgcggcgagaagaggtgaaccgtacatcgccaggctgatctgccgacgagctcggcggcaacatggtcggtcaactggcgctacggtcgatctggatggctcactcacaaggcaagcctgtcatcacaatgtcctagagccgggtcgccccattgagggtctggtgctgcgtccctcctcatcctctccctcacgcagctacaagattggaatcactccggttaacgagaaacgcgtccagccaaccacttctcctcggtgactatttttctcttccctccagccctggcagcaatagagcaagctcatgtcaccgtagtcgcatgctcttgggggaggagatactagcagccggcctaaggaaatcttcaattcttcatcgccgtcgcttcctcaagttcaagaactggtgtaatagttgatagagctatacttgcagaagataaaaaacatggtggcttcaagagctccaaggagtgaatctccatggctaaagaagcccatgcatggagtttcaggctcaactgccatggctagcaccccatggagctcgatgccaccaagcagccattccctgggggcccaaagccagctcgtctgctctgggtgccgtaacctgctcatgtatccagccggagcaacgtcgatttgctgcgcagtctgcggtaccgtgaccgcggtgcctgcccccgagcagaaatctagctgcaatgttcacgaaaataaagagagattaaaggggaatacaaatggcttcagggctccgcaacggtgcgcgcgtcgcgttgatggtgcctgcactcaggtcgctcgagaagtacacactgaagttgctctggtcatatttacattgttgtgtgtaactcttcctggtttgcttttcagtctaggatagagatttacatgtcaaagagtcagtgcacttttgaaagtgtaatgcgatgcaagtaaaaacagttttggacaagatcgaaaggatccatgtcatttgctgtcagaatagtaatgtttgttacttaatgaggtttgttacaaaccttaattacaggaatagcattgtagtagttcttaactttttacactcctatttgtagatgtacaattatcagatggactattttatacactactttctccctctct

SEQ ID NO: 6398 - DNA, 1462 bp, Oryza sativa
  Predicted polypeptide sequence is orthologous to G2604
aagtaatgtggcatctgaaaattgagtttctttgcatctaaattttatagtagtttagaagtttatattgtaccctctgttttatttacaaaagtgagtagtttttggtttttagagcagaaatatagctgcaatgttcacaaaaatgtaaagagagattaaaggggatagcctgtcttcccttgaaatcgatgcatgagttttgcatttgctgaaattttgttctgaaatgcagttttgccaatgattttcctacctggaatttctgtgcaggaaccgagatggcgcagttagtttgcggaggatgccacactctcctgatgtatacacgcggtgcgacgagtgtgcaatgttcttgctgtcacactgtcaacctggctatggaaggtactaccaaaatttatcatcctcctcctctgttgcaattggtatattctgtggctttgattccagtatgcaaaatcctcctcctgaacagaatattttcctgtggctgaaagcaacagcaatcagtcggtagcaataaacatcgtcgagttggcttgtattccagtcatattcatgagagttggctatggttcagaaaacaaaaaagtttgacaaggatacactagatttaccagagtatgatgaaatatctcctacaattacaagatgtgctacagtagtatcctatacttactgaaggtctcacaaggacacctaatttagcatcaagttctgaagttccatataatttgttcagagttcagagttttctttaaggcagacttctgaaagatgagtgtttgttcatataatcttaaacacactgaataacaaatgattcccatgttcttgatggcagcaaatcaagttgcgcatgtaaactgcgggaactgccgtatgctgctcatgtaccagtatggcgcaaggtctgtcaaatgcgcagtctgcaattttgtgacatcagttggggtaagtgttcatcaacaggacacttcaatttcatatttagttcctttatctgaaaacattcaattttacagtagcatcatctaatggctaatattgcactgcaacctgatttttttcatgatgtgaccttagttgaagagtgtgttttttttctgaatcttttcaggcctcacctggtacagaccagaagcccagcagctgaactgctgaagtgccataaatattcagaaaagagcttctcaaaccgatgctttgagtgcacatgtatagagttcttccctgaagcattttttttcttccttttttatctccctttccccccaatttccaccttccttccttggatatggagagagcctgcggaataaatgagagttttgctaaatacctagtgctcaaaattcgtcgaatcgtctgtatgaccgaacaagattgacatattatatacataaacctatgataatatttatgcattgctcattgtttctgaatagttgaaacatgt
